United States Patent 7,745,391 (HUMAN THROMBOSPONDIN POLYPEPTIDE) - sequence listing, part 211

SEQ ID NO: 519182 - DNA, 2087 bp, Homo sapiens
ggtggacgccagccgaagcaagcatcgttaaagtctctcttcgagccctgccgtcatgtctaagctcacgagtctccctaaagagcccgaacagctgcaggaagctcttcacttggagggcttgagcctttgcaacacaacctgaatgacgagccctgaggagcccacttttgacgcaaatggaggaagcgcatctacggacctgatgctggataacctgagcagactccagaacacaccaatgccgactccaagaggagctatctggcgctctcagtatcacaagtagtggcccacactgctgcggacgggacgagctgcgacttgtcaaggcctactggaacactgccacaaggcctcaacacaccaaaaggcttgagaacttgggcacaccgaagcctctggcctggcgaaaagcccgagcaccacgcagcaaggccttggaatcattccccatgtgaagccaaacccaagtattcgttcgacaagacggaaccccgaagagcttggccaccccaccgtataacaacctatggccatgccaagcacgaccccacggccattcacctttctgtggggcacctcggaggcgaggcggcccatttatcagcacacggcaacatggcaaaccaagcgctggccaaccagcaaagaaccccatttgcctaggccgcgttttaacaggcaaaggcaaaagtcgttaagatccaactcgtggggaaacacccgacatggcgttacattttgcgcggcaacacaccccgcaaccacatttcctggacaaccacgcgtttttggcaaagactatctggggcagcacaacgtttcccaacgtatggcacagccctatgtgtacaaccccccggggcaaaatgcgggtcccataatgtgattcgacggccagaacaacggcacatacacacacaacacgcggggaggaaccaccaatcgtagaatggcgaccccaattgattgatggcgacattacaagactgccccatctctaccgtggcgaacagcccgcaaaacccaccgcgtaatttggcaacacaatttaccccccctggacagtatagaccagcagaagtttaacaagtgggaaaaagttgtagcggattccaaaacatttatccaagtggacaaccatcaccgtttaagccgcccaaacaatatagacacactttggcgcatcgtgaacacaccagtttgggcagtgacccccgagctcagctaagagaatgcagcacttgtggtactgtggccaacacacgcgcgaccggtagctcaccaggaacatcaaacgtagcaaacgcgcgcccacgcgccgtttggagcgctccaccagcaactacaaacggccgcgagtaactaggcgacacatgcgaaaccattcgggtggggtcccgcttaacgggtcatttgggccccgactttctccagaaaaggttcagaccgcacgacaacgagagacgcacgcccgaacgacagcctaccccgaccacaacggacgggtcactacccgacgagcaaacacaagggaatacttggcgggcagcagctaaccaccggactcatgaggaggggaacaaagaacagacaacgcacgcagtacgaccagtagggaccgacgacatcggagcagcaactaggagcagaactaaccaccaggacatcaggccagcaacaaacgacgacgccaactgcagagcgactagtactagacgtcacagcgcaggcgctcatcggcgcgcaggacaacaacacacgtgtgggtacaaccccacacaaaacagaccggctgctagtcacccgacgcacggcagaaccacgaggaacctggccgaccatcaacacgaatcgggcagacaaccacacagcgcgctacacgcaccaacagacaccaggaccgccaggaacatgacccgcggacacagaggtagcagacatggcgggacgacaacgaccataaatccggcggacgacatgcgaagcacaccaccagcagccaccgaaggagcatcagcagcgatcaatcggtgtgagaacaacggaggcagatcgataggcagggaagaacacacagacat

SEQ ID NO: 519183 - DNA, 743 bp, Homo sapiens
gcctggtgtgattccgtcctgcgcggttgttctcctgtgagcgagcgttctgttgtatctctcagtcacgctctatctgctccgtacactaaggtgtcgtgcctgacatcctcgatgggaagattcgatgggacatggatcatgagccccctgaggccccagaactatcttttcggttgtgaactagaggcctgacaaagattatcgactttaaggtggataagtgatgaaaagtgagcatccagttagtctttaaggaagcggtcaagttctagggcgctgggtgcatacaggcatgacgttgcgacatttgttgacagcgagagtgcatatgtaattatcgaacgtgcatgtccaatataaggtaacatatggcaactttgatgatgtctgtacagccaacggtttcccgttgaggggctttgaaatagtcaccagccagtggtcttaaggtcgaagtgtggttcagggccatgtgcatattagtggacagcacttaggtagctgtggcggcaatgatgcagagtcagaagatgaagaggaggaggatgtgaaactcttaagtatatctggaaaagcggtctggccctggaggtggtagcaaggttccaccatgataaccagtaaaacttgctgctgtagtgcagatgatgacgatgatgatgacgagggtgatgcatgaagatgatgatgatgatgatttggctgattgaggaagttgatgaaaaagcgcagtgagaaat

SEQ ID NO: 519184 - DNA, 100 bp, Homo sapiens
attaacaacctcaggaggagctggacacatcgggggggaacgggtcgctggatcggagtgagaaactgcggactgtggggattcagaacatttgggtgac

SEQ ID NO: 519185 - DNA, 135 bp, Homo sapiens
cgtgctgcaggatctgaaggagataccgccctgcgcccagcacaatgaagatcaatgatatgcacccccagagcgcagttactcggtgtggatcggtggctccatcctggcctcagtgtcacacctttcaagggc

SEQ ID NO: 519186 - DNA, 123 bp, Homo sapiens
ctgatctagaggatccctgacatatctcataagtgtaatactcttactaaccgatagcgcatagtacctgtgagggaaaggtgaaaatgaacccctggaggggagtgaaatagaacctgaaat

SEQ ID NO: 519187 - DNA, 260 bp, Homo sapiens
aaatcgagctcggtaccagtatggagaccaggtctgagccggactagtgacagccctgggcctccccacactccccatggagaagctggcggactctacagtagccccaaggtgctcttgtcttggtccatgggtcctgtgagagtgtgcaggtgcccgatgaccaagactttcgcagcttccggtcagagtgtgaggctgaggtgggctggaacctgacctatagcagggctggggtgtgtgtctggtgtgcagtgctg

SEQ ID NO: 519188 - DNA, 500 bp, Homo sapiens
  misc_feature (263)..(263): n is a, c, g, or t
  misc_feature (278)..(278): n is a, c, g, or t
  misc_feature (309)..(309): n is a, c, g, or t
  misc_feature (315)..(315): n is a, c, g, or t
  misc_feature (359)..(359): n is a, c, g, or t
  misc_feature (366)..(366): n is a, c, g, or t
  misc_feature (374)..(374): n is a, c, g, or t
  misc_feature (390)..(390): n is a, c, g, or t
  misc_feature (407)..(407): n is a, c, g, or t
  misc_feature (410)..(410): n is a, c, g, or t
  misc_feature (422)..(422): n is a, c, g, or t
  misc_feature (430)..(430): n is a, c, g, or t
  misc_feature (473)..(473): n is a, c, g, or t
ttatatattaaaaaatgaaagaataacatttatgcagaggaaaaacaaaaacatccctgaaaatatacacactcatacacacacacgcacaggggaataaaataagaaaaccattttcctcaccatagacttgatcccatccttacaacccatccttctaacttgatgtgtataaaatatgcaaacatttacaaatgttctttgcatttcaaaatactttagtatatcaatatagtagatccagtgggtgggaaagggcattncatgaaaatatgaanaaatagcatatagtttttaacctgcaattgncttagnaacaaaaagtgaattttaatgctgaagataaagtaagctaaagnccagcanaaccttgntattatgcagtctganatagtttatagactganagnacagaatccttntggatccngcatctcttgttccctctgaatcttataaagtggtggcaaganaggggataatctgagaattttgatgtt

SEQ ID NO: 519189 - DNA, 1011 bp, Homo sapiens
agcggaatcgggatgtgaagaatccatcaactcctccactacctggtggtcgcgtagactagacacagtgcgatcgggcggagcgcaaacagagggagggctcacatactttacgactcgctttgagtcgctgttacctcgtactctggcatttgcgttggaatggagctcaccgtggcgggtgcgattaacggttaagctctatgttacgtagaaccacgcggcgatttgtttaacagtccggggtatgcttgagctcgtaagatccccgtgctgagtccggttacctaaacgagtgtttccccgagccagacctcatcggttggaacctctggtctgactgttggggaacccacgtggagagataggccacgcacttcgtttgaccgagcatgagcttgtggtcctcttgaggctcgaacaaacttccttggccctcttcacttcgatcgaattggtcgcctcgcgtcgctcgacaaggctccgaataaaccattgccctgtttcgacaaagtccacgtaacgcgcgctccacaatttttctctcaactaggcagacggagctagagaatgttcgaccacaagggttgtgcgtgcaaggggtgatctttccttctgggagttgctagggcgagttgaggattgatggtcactcattagaaccgggaaagaagggagactttgtatgatccagcgcgcgtcaactttggcaagggtgcgctgccgagggatggccccgctaatggagcaccagtttcctttggtgaggttcgtaccgttgttacgccgtaacccaacaacagaggtggtaaggcctggtgctttattagacaaattggggggggaggcagggcccatgactgtccgagaaggggacacgtgggagcttttccccaaaagtatcgttagaaaactctggtggagtaccttacacttagttcgaccaattcaattgtggataacccgctggtttttcgaaaaagggtccccacccttcgtgatctccaagtg

SEQ ID NO: 519190 - DNA, 316 bp, Homo sapiens
ttttcgcaacgcattcgtttacaacagcaggtcgatcttggcttcagtcgtgccttagagactccgggctcccaggtgtcggaagggcatttgcctttccccttggtcaccttgttcggcgaggaaacaccttcaaaagctctttcaaggacccctaaggttttaggcccattttctggttcaagtttcacttcaaccttgtacttctctgtgataccttgggcccttaaccaaagaaaaacaggacgaatacaacactatttttgtacccatttacaaatcttctaccttaaaacccaaaaaaacaagaaacaca

SEQ ID NO: 519191 - DNA, 332 bp, Homo sapiens
gcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggtcctcattgacgattcaatttgttgaaggccaatttgtggactcctacgatccaaccatagttgtagacacagccgggcaagatgaatattctatctttcctcagacatactccatagatatttggctatttcttgt

SEQ ID NO: 519192 - DNA, 141 bp, Homo sapiens
gctagctgggtgaggtggctcaggctgggcgaggtggctcacaccaggcgaggtggctcacacccctaatcccagcactttgggaggccgagatcatgccattgccctccagcctgggaaacgagagcaaaactccgtctc

SEQ ID NO: 519193 - DNA, 1277 bp, Homo sapiens
ggtagggtgcgtgggttttattacatctttgggttggtggttggaggggtgggtgtggttgctgccggtttgcgtgtgtggcgatatgtgtttgatgtcgtagtggcgcactgtttgtccccccggtggggcccccctgtgtaccacacgtgttgtggtttgggggctacccgggtttgggttgtgggttctcgtcacggggttgcggagtggtccccgcggtgtgaagccttgcttcctcccggacaatagcccccgtttgggagtcagaatggggttttgggtttgagacgtatggtatcacagtggggcttcctgaggggttttatgtgtggggggggcaccaccggtagagtgtgcccactaggggattgttacgttatggcccctggggggcagtttttcgaccgtccgcgtgcccatgaatgctttcggttgtcccccccccgggggtgcctagagtatttttcgtggcgttgccccccccgtcccccgggggagccccttagtgcgaatggatcttgctggcccagtgctttgtggggcccccttgggagtatcgatctttgttccgttttttcgcgcccgttaggttgcgccctggacatggccagtgtgatttagcccaacttgcggatcccactttagaccatctctgacttacccccggaccaccgttattttaccgttttgtgagcgcccaccgtcgccccgtcgatatgcgctgatcccaattaggaggcctcggtgatattggcgcccttcctataggagggcgtctcacatttcacctgagttttccccctagtgttgtcgcacgggttaccaccgccctatgggcgccacagcgctatggccgcccacaagtgtccactcttgcacctgatgttcactatgtgtcactttcccgcggtatatatttataactttcttgtcgccaccacacacacactttttctcgcgcctatattccgcgagaatgtgccccgcagacgcttatactcgcgagtctataccccgcagatgcacataacacccaccactgtataccacatcctattcacattctgtataggctcacttcacttttttcttaccacgcacgtaatatttaataattttcactgagatttgaggaagccttcgctttcgagagcgagaaagtcctatatatgtatgagagaaccctccactaaccctggaggtgaactatatatatggatgccccccccccttccacacattcgaagaacccgtctacattaaatttagaccca

SEQ ID NO: 519194 - DNA, 171 bp, Homo sapiens
ggatttgctggtgcaggacaactaggcttaatagggacatgtcaaatctacttgacaaagactttgaacaactgtcttaaagatgcttagggaactaaagaaaaacgtggggaaagtcaagaacataatgtatgaacaaagtggaaatctcaataaacagaaaacctaaaa

SEQ ID NO: 519195 - DNA, 160 bp, Homo sapiens
ctcttaggatcccgctgatgtgcatcttgacacttgaaggctcttgagtgtctaacaagttgcttcttggctttcctgctgctggatttagtactttaatttggagagttctgctaaatcttttctcactcatccaattttccaaaattgtgttattatt

SEQ ID NO: 519196 - DNA, 1040 bp, Homo sapiens
gaggcattgagggagacagtcgcaggggcttctgctgagggggcaggcgtgagcttgaggaaatcgcagagtcagttttagtctcttggacacagatagatgatgagtacatacgtacttcatgtatataagtcatataggttactactgatattggcttagcgttaagtatgtccaagtgtaatttcaatgagcttatgattgttgagaggatgaagaagatactgtatcgtaacgtgtgagtaaagtagataggacattgagtgaacgtgaataatggaatgatgagcgatttctaaaatacatgacggatggtagagaatgaatgcttctttctattggaggatattaagaattgtacttttaaaaagataaagtagagaagaaagggactatcagagtactccggaatttgaattaagcaaatatgataggggcaatcgtcattgtacagacttaataagtgaagagagtgaacttaaggcagttgaatatgtgaaagtttgtaggacgttgggtatggtcgagtgataataagatgtgaagaggggaatacttgtgcttaatgatgattagagcgcggacaggtgcattcaatgaggacctttgaaatccgatggacaggcacgggtacgaatgtgcagatccattttagaagacgcgtaggttatccgcactttatctaaacagcagcacgaaataatgtgtacaaggatggattgggggaaggtggaagggatgaacataatgtagggagtaaggagtagcatagttacggaatgctggaagaaaaccttgggtgggtaccagaaagtttagcggggtaaatggggcgaaaagtataccagggaatttggttgggagtattcgggggcaacaggtgaagaatagagtttcatagtcagttacgtgtcttagatggcacatacagtgtagttcagatttcaataatcttggacaagggtattggaggcaggacacttaatataatgatcaggggtaggaaacaatagaagaattaagggggaaggaggatcaag

SEQ ID NO: 519197 - DNA, 784 bp, Homo sapiens
acttatgcttctgtggaaatggacagttcacactggcctttctcagaatgtggcactgccactgactaattctgtgaccggggcaccttttataggcctccatcagcctgtgtccccagctgtacaaatgctgaaaggtgaaacctaggcttaaatggcgtttcttgaggaatagaaaagaaaccacgtataaactctctggtacatagtaggtgctcagcgaatgtccatgccctttctctgtggtgctattgctctttgaagttcgagtgctttaccaaggcatttccgtctcattgccgtgacgttgctttatgtccaccatcctgttcaccggtacgtttcggttgagaaagaagaatgcaaggcaccggagggaaagttctggagcagaaaagccttgtttacaaataaacttgggaagctgtctagaggagaacttgtgtgacttgaaatcacattacttaatgttcagtatgatatttgcagtttgttccggttctatttagtagagaaaagtagtttagtccataatgaaaagaatttagaattattttaagaattagcctccagtttatagaatctggattttaatctggccagtaagtatattcgagtaatatgtacatgggtgctaaaacagtgcattatcaggttgcagaaatgtacggtaatctgatatagtcccgggtaacagcctgtaagaacagttattttttcagagatggtttgaaggaggtgggataccaataaatggaataatggctacatgggcggcctgggt

SEQ ID NO: 519198 - DNA, 597 bp, Homo sapiens
acatgggaaagtatctagtggtgtaggataggagacaggattcggaggagcgtaggatatgtatgagttgttgtgtgtccggtgatgggagtgacgaaggagacagactatgtcagagagagcatatgaatgtaaagcgcagggggaggaagtatgaggtagaggatggtcgtggtagtaagctaagatgagatgatggcgaatcaggggtatgtcggttggagtgaaggcggcaggttaatgggtcgagtgattgctgtgcgtggctgtgagtgaggaggtggagggagagttcggagctgtccacgcgcgatcgtgcaaatggtatgcgaagcatactctgtcagttggcgtctgaagaagtgctcatctagcaccatacagatcgactgggacagtgcgaacagaatcacgagacagaaataagcatgatgtgaccacgatacggtcaactaacgagaggaagagagtagatgagggcaatgtgcatatgagagataaagagcagaaaacacattactagcgcatacaactaacagtgagtaagtctgtgatctgcgaccgcatcacgatacctatagcagataccatcacagg

SEQ ID NO: 519199 - DNA, 392 bp, Homo sapiens
ccgcttttttgcaacaaaggaatcccctcccgattattttttggggccaaaccttagaattttaattatggggttatcccccaaaaaaggccccccccggacactattgcccctttttccataaagtgaaaaaaaaaatgtttcccacatatttggggcccccctttaaaaatttttaagccccccacccccccaaattgttaaaaaaaaattcattttggggcccccctttagcaagttaaaacacctgtttagcaagttcaaaaacccccttttaaaacccccaaaaaaaagccccttttttttccctcccacctggggaagggaagggactttccttttttccaacagggaaacctttttggaatcctttggccggggtttgccttttc

SEQ ID NO: 519200 - DNA, 106 bp, Homo sapiens
ttatattggaaaatagatggtacgcgtgccacgtgccggcctcccgctatcgtcacccctgtcccaaacactcgacccaccacttcatcttcaccggcggctgctc

SEQ ID NO: 519201 - DNA, 270 bp, Homo sapiens
ctggcaggctgccagcacatctgggagaagctgtcttctgaggttacgcccctcccctggtgatctttgtctcctttctctgcgtttcataccatgctgtcatatctgtactctgatgtgaaaaggtgctcaaggaagggagagaagcagataaggataccagaggcagctgaagtgtttttaatttaaattatcctcctcctcagcctctggaacctgaggcggctgcttgaacctttggatgctaatgtcgatgcttaagcggatcag

SEQ ID NO: 519202 - DNA, 1042 bp, Homo sapiens
  misc_feature (257)..(257): n is a, c, g, or t
  misc_feature (275)..(275): n is a, c, g, or t
  misc_feature (451)..(451): n is a, c, g, or t
gcgttctgatagcgaacttaaagatgaaaaaccaaagagaccttaagatggagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaacgccgtaggcagaaggagcgctatgagaaagagaagacttttaagagaanagaagaagaaatgaaaanagagaaagacacacttcgggataaaggaaagaaggctgaaagtacagaatcaataggcagctcagaaaaaactgaacagaaagaagaagtggtcaagagagatcgaataagaaacaaggatcgtccagcgatgcagctttaccaaccaggagctcgaagccgaaatcgactctgtncccctgatgacagcaccaagtctggagattcagcagcagaaaggaagcaggaaagtggtattagccatagaaaagaaggaggagaggagtgatacgtccagatggcttaggtgtcctgacgtctaggcagccaaaagagcacacgtaagcaatccagaggtgccttcaggggcaaagcaatagagagaaagggagccgctgtgctggtggggtacactgccagaggagtaagtcttgtgtccacagcaggaatctgatcagaggttcagaatgggagtacaatttgagtggtttgaatgtgctaaaagttactttacagtgtggaaaggtgaggagtaatgattgaattgcagggggatggaagtgaggatcatacttgaacgagaaacagtgaagtgtttaaatcaagggtgtaaccgattgaattctgatgttggcaaagtcggtgagactgtagaataagtagtaggcgggaagggatgagaggaatacacgggtatgaagcgtggggacactggataaagaaagtagtagaagaattagtggaagacagtgaataagagggaacgtgttatatctgatataggcaat

SEQ ID NO: 519203 - DNA, 118 bp, Homo sapiens
ggcagagagggtctcatctataccgccggcaccacacggtgcccaggatataaacggggactgaagaatcaccttctttgattgagtgagtgagtaacatgaatgaatgggtcacgca

SEQ ID NO: 519204 - DNA, 976 bp, Homo sapiens
  misc_feature (191)..(191): n is a, c, g, or t
  misc_feature (209)..(209): n is a, c, g, or t
  misc_feature (385)..(385): n is a, c, g, or t
gcgttctgatagcgaacttaaagatgaaaaaccaaagagaccttaagatggagcggcagagactatagggagagggaacgggaatatgaacgagatcaggagcgcatacttcgagaaagagagaggctgaagcggcaagaagaagagcgccgtagggagcgctatgagaaagagaagacttttaagagaanagaagaagaaatgaaaanagagaaagacacacttcgggataaaggaaagaaggctgaaagtacagaatcaataggcagctcagaaaaaactgaacagaaagaagaagtggtcaagagagatcgaataagaaacaaggatcgtccagcgatgcagctttaccaaccaggagctcgaagccgaaatcgactctgtncccctgatgacagcaccaagtctggagattcagcagcagaaaggaagcaggaaagtggtattagccatagaaaagaaggaggagaggagtgatacgtccagatggcttaggtgtcctgacgtctaggcagccaaaagagcacacgtaagcaatccagaggtgccttcaggggcaaagcaatagagagaaagggagccgctgtgctggtggggtacactgccagaggagtaagtcttgtgtccacagcaggaatctgatcagaggttcagaatgggagtacaatttgagtggtttgaatgtgctaaaagttactttacagtgtggaaaggtgaggagtaatgattgaattgcagggggatggaagtgaggatcatacttgaacgagaaacagtgaagtgtttaaatcaagggtgtaaccgattgaattctgatgttggcaaagtcggtgagactgtagaataagtagtaggcgggaagggatgagaggaatacacgggtatgaagcgtggggacactggataaagaaagtagtagaagaattagtggaagacagtgaataagagggaacgtgttatatctgatataggcaat

SEQ ID NO: 519205 - DNA, 928 bp, Homo sapiens
agcgggaaattggtgcttctgtggtatacaataatttaacataatataattactgataacgtacactaagtcatatcaaaattataggtgttccagtattttggaacacataccaattaatatatttatatagatacaacccaaagaaagccaaacacaacttcatatataacaaaagcttcctaattgattttaatataccaaataagccaaataatatcattttttacttagagaaaccaagatacaaaaagaaaaagaagataaagacaagaaaagaagaattacaaaaaaaaaagaaacaaagatacaaataaagaaagacgagaatagaaagagagaaatgatgataataccgaaatacgacagaaaagatacaaatgaaggctaaagaaaagaggggtaagaggaatgagtacgaggaacctaagaccaagaaaagaacaaagaaaactaaagcgagaccaaagcaaacgacgagatagatggccaaccacgagagaaaagaatgctaaaaacgaagacgaagatgatactaaaacgagagagacaatgaaaggagacagaaatgagaacaacagcaagagccgaaaaacaccgaaataaaaaatggaacaaaaaatataagaaacgcgcaggaacaaagaaaaagatctccaaaagacgaaatatggagccaggacatgacagcagtaaatgagccagaaagagaagaaaaaccaagtgagcctatagaaaaatcaaaagctaaaaaagaaaatagaagggaccctcggcgtggaaaccagggtcgaaagtaggcgcagattcgaacgaggattgattgtccggaaccagcgagaagaccccaaggtgaatgaaaagtggagcgagcaagggaaaaacgaaggcaaacgggacccaaagaagaaattaacggggcaaggcc

SEQ ID NO: 519206 - DNA, 145 bp, Homo sapiens
ctggctggttggcctagaggatcccctgcgggctttcataacggatttagaatctgtcgacatatgcaccatgaaggcttggagtgaagctcttcctggggacaactgtgggcttcaatgtcaagaatgtgtctgtcagggatgt

SEQ ID NO: 519207 - DNA, 213 bp, Homo sapiens
caaatgttttggcgatgatgcccgcattgaacagggggagtccgtcagaccgtagatcctgcgctggtgccagggaaatctcactatattctaccacctggggaactgcatccactcggcataccactccaactggttctgtagggggcggttactctaccacctttgctccatagtgtgctcctttctgaatgcaaagatcaatgcaccgtg

SEQ ID NO: 519208 - DNA, 121 bp, Homo sapiens
  misc_feature (87)..(87): n is a, c, g, or t
gatgtctcccaggtctgaccatccacgttcattcatttgttggacagaaattaaacatgcatctagcacatgcaatggtgccaagcnttctctagtaggccctaggggtgccacatgtgaa

SEQ ID NO: 519209 - DNA, 1034 bp, Homo sapiens
ggccacacaggcctgcggcggctggctcgtggcccctacgtgtcccgtgctggcggctggagtgagagaacgccaggcggctggcgcgaggatggagagacggaggagtgccgagaccggagctgccgctcgcctgcagtacttacttccccgtgctcagcatgggacaaggttcctagaacggtgacgcgccggacgcgtatgcaaagcttgctgaatccacgttggttgacagctgctggactgacctctctcacgtcgcggccctacggagcaagggcgcacagcctcgctgctgcgctggtgcactcggcgccgcgccttgcgcctgtgcctgcgctgcagccacacgcacattcttgcagcagggctttcacggcatgtcactgctgcttgcaggcttccagcccacatcggaggccgatgctgccacagctgtgacaccttggcacacgccacctcttgagctgggacgccacgctgggatccatggctcccaatgggcaaccccctatctatcactctagcagaagccaccggccctcctggacacagaccacaacgcggactgcgcgcgacacgcaagcgctgcggccgcaatcagcctctattaccaacgcaaactgcgcgtggccctgcctaccttaccaaacaacgcccgccgcgactccccccccgcgcaccccgggccttgacgcgaattccagccgaatttataccaaccgacggcctctcctaaccttgacccctcgaaccttccttccgtgacaccactcacacccacgttcaagtgggctgaccaggtcaccacacagccggtgcagcgggatcgtaacaccccgaacgcacggacgggtggaatcacccccgcgcactcacggcaccctgaacccccttgaacggagcgccccgcacgcggcttcgcaaccggcggcctgagccgcatccgccaacggacacccagccgcgccccctgcaagggctgctcaccgctcgcgcaccagtgcagctcaacgaccgccagttccgaagat

SEQ ID NO: 519210 - DNA, 414 bp, Homo sapiens
aataaaggaatattacaaagggtatagatagaaaagatgcctaagataatgagatgaaagataaacatggagcattgaatatcctcccaggcatgccaccctccaggtaacttgcatgagcttcaactatacagaaactgcccacaccctgttcataagcaagtaaaatatggatacgctcttgttagtgtccggcatacttgcttcaatccatttgaccgctgttgatcaacttacccttgagcccctttttcctgctctaagggatggggctcgggcctaaagtccgcaagcgtctagtcataactggtgaccagcccccatcctgacgctatctaggagctgccagtcatctggcacctcattagcacacaaagagacatcactttggagatgcccaggatcttaggagtt

SEQ ID NO: 519211 - DNA, 217 bp, Homo sapiens
cagatgccagatggagctgtgtggtgggatcatcagctcacgtgctttcctccccttccccggttcatgtgattctcttgcctcagccttctgagtagatgggattacaggcacacgtcatcatcatgcctggctaatttttgtatttttagtagagacggggtttcaccctagttggtcaggctggtctcgaactcctgacctcatgagccacccg

SEQ ID NO: 519212 - DNA, 677 bp, Homo sapiens
  misc_feature (5)..(5): n is a, c, g, or t
  misc_feature (21)..(21): n is a, c, g, or t
  misc_feature (446)..(446): n is a, c, g, or t
  misc_feature (513)..(513): n is a, c, g, or t
  misc_feature (605)..(605): n is a, c, g, or t
tggcntcaaaaagctttattnccattgggtccagggcttgtaaggatagttaaaaaagctgcctattgggcgtggagggagaggcttaggcagaaagccctattacttggcagaggggccctttcagaaagtctcgcgtgggcctcaagaaaggcctctatagctcggtgcttgagaaggtgagccttttcagaagaagaatactcgcccagcccagccttcgcgggccacccaagccgtggtgggaggtgtggctcagggtggtctccacccattctttctgtgaataagccttacacttctcctctcaatcttaggagaaggtggagtgtcctctcagagagaagagctctcacagagaagatgtggggggctcccgggtgcgggcaaagaacaccccagggggcatgtgaaagatatcccaaaaggggcgccgtgggtctcangcttttttctcctcccaggggcccatgtggccagagcttttctcatgtggcgcgtctcgtgggggtntttataccccccaacttcattcttctcaggcgtgggcttctcttggaagtgtctccgtgggaaagaagagacggcggccgcccacgcgtggnttttgcgcttcttcagggagaccgcctgatggcccctcgcgctttcctcccctcggccaatttcgcggaaga

SEQ ID NO: 519213 - DNA, 500 bp, Homo sapiens
  misc_feature (5)..(5): n is a, c, g, or t
  misc_feature (21)..(21): n is a, c, g, or t
tggcntcaaaaagctttattnccattgggtccagggcttgtaaggatagttaaaaaagctgcctattgggcgtggagggagaggcttaggcagaaagccctattacttggcagaggggccctttcagaaagtctcgcgtgggcctcaagaaaggcctctatagctcggtgcttgagaaggtgagccttttcagaagaagaatactcgcccagcccagccttcgcgggccacccaagccgtggtgggaggtgtggctcagggtggtctccacccattctttctgtgaataagccttacacttctcctcatctaggaaagttgagtcatccaggaagtcacagaaatgggggtccgtgcgggcaaaacccagggcatgaaagatccaaaagggcctggtcacgcttatttctccagggccagtggcagctttcacagtggcgtcgggggtttaaccccattcatctatcagctgggattctaggatggtcctgggaaaagac

SEQ ID NO: 519214 - DNA, 209 bp, Homo sapiens
cgggagccttaccctatagataaaaataaaagttatctggacatggtggtgtgtcctgtactcccagctaccaagaggctgcagtggaggacccttgggccgggaggtagaggccacagtgagctatgatcacatcactgcactccagcctgggtgacagagtcagaccctgtctctaaaacagaaacccagaacttactgtgaaatgg

SEQ ID NO: 519215 - DNA, 174 bp, Homo sapiens
caaggacgcatcatgtagtacacttaactgcatttagacatactggagcttttgccctctgaatgtgtgtaagtatgcacattattatgctccgttaagtcagtttactgtcccaacatggtactgaaacacttcagatttttttttttttttttttttggtttttgggaaaaa

SEQ ID NO: 519216 - DNA, 421 bp, Homo sapiens
  misc_feature (259)..(259): n is a, c, g, or t
gattcggcaccatgggagcctggggttctgtccagataggaccagggggctcactttggccaccagttcttcggccagcacctctgccctccagaacctgcagcctggaggggtgaggggacaaccacccctctttcctccaggttggcaggggaacctcttctcccgtctgccctgcgggttgcccgctcctccagagacttgcccaagggccatcacactggctctgggacttgtctgagactctggacccaggagngcaccttgtacatgagagatttgggagtgttgatgtagcagaggtcctgtctgggtgccacggggccagcattttggagggagcttccttccttccttcctggacaggtcgtcatgatggatcactgactgaccgtctgggctcaggctggtgtgggatgca

SEQ ID NO: 519217 - DNA, 890 bp, Homo sapiens
  misc_feature (1)..(1): n is a, c, g, or t
  misc_feature (91)..(91): n is a, c, g, or t
natcttggacgaggcctgcactctcctgatccctgctgccctcgcctctttcatcctggcctttggcaccggagtggagttcgtgcgcttnacctcccttcggccacttcttggagggatcccggagtctggtggtccggatgcccgccagggatggtctggctgccctggcaggagccgacagcattccttgcccccctggcatgggatctggaggctcgctgtcttactgatttgttagtggtcaagtcagcatgcctcatggcagtctgaaagagtgaaggcgtggacttcccggtactttggggtccttcagatggtcatctgtattgtggcctgcactagcctgggccttgcagctggctgatgcaggtactgggacgcccatatccagaaggccctgctgtggtggtgacggctcgtggctgagccactgggccgtcctgggtgccgtctcctcgtgctttgtgctcctagtgtcagtctcctggctccgtcatctttaggcatccttctcgtctttgactatgctgagctcatgggcctcaatgcaggtatcactacctatgttggtggggctggtgcgatgcctctggtcccgtgcagtctccccgggctctcagagctcttctcgccgacctgcgccacccagtgtgtgtggagctgctgacggtgctgtgcggtggtgcctgccctgggctcggaccggctcctccttgctgatcgctccttaccgctctacctgggtcctgggtcgcgggcttgatcgagtactgagctccgatagctccgtggccccgtcgtacggtgatcagtccatctgctctctcggccccgatggggtggcacgctgaggagctcacttctggttctgccctgttcttctctcc

SEQ ID NO: 519218 - DNA, 189 bp, Homo sapiens
caactagactgcagtgtcatgctcgtctgtgtgaagagaccaccaaataggctttgtgtgagcaacagggctgtttatttcacctgggtgcaggcagactggttctgaaaaagaagtcagcaaaaggagatggggtggggcagttttataggcctggggtaagcagtggatagttacagttaaaggtgg

SEQ ID NO: 519219 - DNA, 104 bp, Homo sapiens
gattgggccagaaattaggaagggctgtcactggtcctcagctgctcctggcacctggctcatcttccttccaaatccctcccactgcaaaacctcacccattt

SEQ ID NO: 519220 - DNA, 228 bp, Homo sapiens
  misc_feature (160)..(160): n is a, c, g, or t
  misc_feature (188)..(188): n is a, c, g, or t
cttcctgatcggcgtggtgcccacctatgacagcatcggcatctgggcgccgatcctgctgctgctgttgcgcgtgttccagggcatcggcctgggcggcgaatggggcggcgcggtgctgatggcctacgaatacgccccgcccgaaaagaagggctantacgcctcgctgccgcagatcggcctgncgatcggcctgtgcctggcgtccggcacggtggcgctgct

SEQ ID NO: 519221 - DNA, 868 bp, Homo sapiens
ccaagaaaggttcaaacttttgtggaccacaaatgttcaaatgcccctgccttttttcgtctgaaccaccatatccttgtaaaaaagggtcgtgcccccccgcccggtccactccaaattattgcccccctctttgctataatctgtaacccttctacactctccccccaacgcgtattggttccgccccctacacttgtagtccagtagtcaattcgcacctgacaacccactctgtgttaagcagaacattctgcctcacgcgatgtaaacacaagtcagcacatgggcggcgaggaaatactgcgaggcaaaatatattataacgcccttggtccaccacactttagtacaagatcagccatgcgggaagtgggcgtgtcctcactaaggggggcgatcactctccgtggggtacatgcctccctctctccaaaaaaaggttgctgttttttcatttcatgtggaggcacgctccacgccacacgtggtttgttgctagatatagatgtcgcgagagagttcaatacactgccaagtgcgagcgtgtacaatttggagcacacggtcccccacaaactgcatgctttaataatgtgacacattctgtctccaagacgagcgctgtcacacccccgctattctcccaccttatttatatgttccattcgagtcactcttttcctcgaaaatagcattttttagtttcgtgtagcacatgtcttgctataaacttctttctaaaccacccttgttcaattctctgtttccgcacgccgcatatccgcctcctcacaaccaccgtcgaaccaacaccgtaacaacttctgcttccccataaacaaatgacaattacccccacaaaaca

SEQ ID NO: 519222 - DNA, 619 bp, Homo sapiens
gaattaagggctcaaaaggatggctatattgatagattgcttcaatatgatcagttgactcaagaaataaataaaggagtggtatttcagggctttaaagaaccgaccctccaattccgtccgacctataaatatgattatggcacagataattatgatacttctgaaaaggcgagaactccgtcttggactgatagaatcatatataaaggtgaaaacctgcatccattggcatattcggacgcacctttaaaaataagcgatcataaaccagtttatgctgcatatagggcaaatgtgaaatttgttgacgaaaaagagaagcttaacctagttgagaagctgtatgcagaatataagaatacgcaccccgaagcactaactacaggtcctgacgaactttctcatgcaagaatggaaaaacaaaaggaaagtatacccttagatgcaaccgttcaatcagcgggcataaaactaattgacctagatgatacttcctcgtgcgtttcacctctactttctggtcccagtccccaaccgtctgttgttggccctggaggactcagtaacgtatcacccgataaaagtaagctcaatgtgcttcctccgcctcctccta

SEQ ID NO: 519223 - DNA, 138 bp, Homo sapiens
cgcatgacttcccatttgtcacatccgatgtcgcagtactgcatgatttggcaccatcactggctgcatgcttcatttttatctcactttctcactctggcaaagtgggggctcctctagacgatcgaccatgcacgg

SEQ ID NO: 519224 - DNA, 670 bp, Homo sapiens
aacaagttgaacatttccacatgattacacatgtttatatcacagtattacacattcccacagaatataccttgcagagtgtacacctgtgtcccacactgtaatatcactgttcggccacaatatatgtcaaacttaagcactgcacagttcacaacttttgggaaagtgttatagggaactgtatcacaggtaaccgtgtcacacataaagtgtagctctctgaactggtgtgatcgtgtctctgctgaatggtggtgggaatacctggctccaccacacacacttgttttaattaggctgggtaatgtgcacgaagaccaaagttcacagactaaggaccactcagtcgaatatttgctttgctgccaaagatttaacccaagatttaattatctttgcacacatataaagattttgttccctcccttatagcaatatattcatgacagcccatggttacctacatcagatacacgtaccaccggtgaccaagacatgtgtgccataataccaagtgttcttgggttaaagccaggcgcgctttttaattaatctcttaaagcactgcaattactggcaacacagctggtcttaaacagttttgtgactgcccttttcatccaccacatgactattgcgccctttctagagcacttttgaatatcca

SEQ ID NO: 519225 - DNA, 276 bp, Homo sapiens
  misc_feature (252)..(252): n is a, c, g, or t
  misc_feature (270)..(270): n is a, c, g, or t
gcgaacttcaaaacctgggaggtggctggttcaatagaccatcattttgaaaagaactgaagggcaggaatatgatgattattagtagggtgcctggatatgctagatacaaatcatattaacaatgaaacaatttccttccatcccaagataactggttttggcttggaggcaacagaaagtggatttagaggaatacagagggtcaatggagaaataactctttagtttcttctgaattctagcctgggnagccagcccatgtacganttcccc

SEQ ID NO: 519226 - DNA, 1248 bp, Homo sapiens
ggctgagcatgggagagtgagcttcaggccagagaagccatcaaagggccagtctgcggggccgtccatgcggctgtgcctacttcatacatggcgccgatcaatgcccgagcagtaggcccaagtgtgtcaatcttacacatgcagctctcagcgtcgtcccatggccatgcaatagggtggcacgacgaaggttgctggtcaggggcaggtccgtggcagaccatcaagcacgagcttctacgcgtgtccgctgtggcaacctgagacgggccatactaaagtccggtcacgggacatactaccgaaactgaagatcgtaggggaatttatctattagagcatccaagtaagaacagagacaggaggctgcagtgcactgtgcatgcgaagctagtggatagatcgtgattcacatctatgctggacagagacgagcatggtaggaccctctaacatcacaggtgggcacagaaacgtgtgcccgtggtacacgaggcgaccccaaaccgtgggtgctgcgagctgtatgaaggcgcgctgggagcacattcttctttcgaacgggagcctggagagcgggacgaaagactgtgtccattctacgcgggacctgggccctgacccatggcagtgactacgtggcaaccgcaaggacggacgctgcggcatgtgcaacaagctggtggcactgctggccacgctggaggagcccaggagggcttggagattgccacatggccctagcactcagatcaccctgggggaccggctgaaagagcgcgtgggctaccagcggatggacgcctgcaacacgactgggccatggcgagctgggcagagcattctaactcaagggcctgaacgctctgcactccgccgctggagtaggacgaggaagacctctatacgtgaaggggtccgggggccgagaacaataatcttattacgacctgacaggccccgtgggtgcagcccgggaacaaacaacgatgaacgtagggccagcggtgcgcccctggccaccagaaaggcaacgagagaccctacggcggggggcccccactccaacgccccccgggcagagaagagggacctcacacaagaggacggcagccaagagaatgagaggagaacgcccaaaaaggggaccagagagcccccataggaaagggaggagggaggccacacaggagaagagcagagggcctacagcgcgtcgtccacgcaaagagggagaacgacgga

SEQ ID NO: 519227 - DNA, 283 bp, Homo sapiens
aggatggattttagatcttgtagaaagcaggcacatccatggactgcacagtagtcctcaagaagcagtgatctgctcctccagacatatctgttccaactttatcatctgcaactacacactgtatgtgaagtttgcttaattccgtatcccactggaactagttgtagatgagccccagactgacggtgagtgagggaatgtttgggacacaatggtcttggtgacggcggtatgatgttaatggatagtggggttacagatcgtagtagagagaggaaga

SEQ ID NO: 519228 - DNA, 119 bp, Homo sapiens
cgtaaccaaaagcctggtcgtccaaggcaagagagtaggttaaagtccctggctcggttacaaagctggttgcgtagattcctgtcaagtgctcaggaatatacgctggaatggaattg

SEQ ID NO: 519229 - DNA, 764 bp, Homo sapiens
cggctaggtcgaggctgtgtggtgaatcggccgaggctctcatgaggcacagtccaagccaagcgctcatgttgagccagtgggccagccacagagcacacagagggtttacttttcagtcccctctctctgggttcagcaaccagagtggcatgctgatagtgccccctgcttgacttgtgtgcatgggtgccccgtcctgatgtcatgtgctctcagcatggccaagctgcgaatgctctggtatgaacgatagtgagcgaaacacgattctcactgggaaagtaagcaacgtgtgcaacgaactccatatgtgcctacacctcgagacatggaggccctgttcccctggagtcagggtgaactgctaaagctttgggctgagacctgggatttgcagataccacaacacccctgctgaacacagctgtcctgttcagcaacactaaccgagcattccactatcagccgtaggtgcacgtactaatacgtatagaacgtctgcgcaataagaaacaagaaacagaatttgcagaaccttggaccactcctgtccctgttagctcagctcatcaaagcagcaagtctggctttgctctattcacagaattggaagatgtacactaccaaacactcagtccactgttgagccccagtgctgccaagggacggaaggcctttcttctgtgttaattgcgtagaggctacagggcgaagcctggactaaaggcatcttgtcttttgacgctattcaactcagtaga

SEQ ID NO: 519230 - DNA, 391 bp, Homo sapiens
tcagcccttttctagtttcattttttaggattagaaaagttttttccactcaatagaacaggttccagcctgaggtgtgggaagctgggttgtaatcccttttgcagcctttgtggccctgggcaagctttttccttccacctgttttttttggccacaacaaagcaataaccatccccatccccgtgccctttttttccccccccagcccaggggaagttgagcccccgcagctttcagggtacttcaaaaggaaggtgctacatttgtgtcctgggtgtatgtgtcgtgttttgtgtaaattgtgagccccctgggcagggatccctgtttgcaaacatgttccatgtggcacgcccaggtgtgttaataaacgttctttttcagaaca

SEQ ID NO: 519231 - DNA, 304 bp, Homo sapiens
aggctatggtggataccgaggaggctatggaggacatcgaggaggttacggaggagatcgaggaggttatggaggatatcgaggaggctatggaggagacagaatccgggggggctatggaggagaccgtgttggtggaagtggatccggcggacacctgaagtggaggctatgggacgagacaggaatggtgtcggctctggagagaaaccgaggtggcgacttcggaggatagcgaagcggctatggaggccaaatgggcctaagagcgcactaccgaaatgatgggcagcactcagcttta

SEQ ID NO: 519232 - DNA, 124 bp, Homo sapiens
ctgagggctgcctcaccctgctgctcagactgagccaccgcggctccagcttggagttctggcacttggcattctccacctcggccgtcagcctttggctcatgcggttcagttcattgatctc

SEQ ID NO: 519233 - DNA, 635 bp, Homo sapiens
  misc_feature (431)..(431): n is a, c, g, or t
agtgagaagagaagtttagagaaaaaagagtaaaaagaaatgaacaaagcctccaagaaatatgggactatgtgagaagaccaaatctacatctgattggtgtacctgaaagtgatggggagaatgcaaccaagttggaaagcactcttcaggatatcatccaggagaacttccccaacctagtgaggcaggccaacattcaaattcaggaaatacagagaacaccacaaagatactcctcgagaatagcaattccaagacacataattgtcagattcaccaaaaaaaaaaaaaaaaaaaaaaaaaaaaaaaaggggggggggctcgtgccaaattctgcacgagagacagtctatggtgctagaaacccaccattgcctaatgacctataaggctttgttgtctctgatcttgactaataccatacctanatcacaagtattattactccacatgaaccttcacatttattcactcataatctacttactgcctaaaaactacaaaaccagcctaagaaataccaccattcattacatttacttctacttctcctagattatttactacaaatgtactttggcttaataagggattgatgatacaacatactctaacccaacttggtaaaacca

SEQ ID NO: 519234 - DNA, 604 bp, Homo sapiens
  misc_feature (577)..(577): n is a, c, g, or t
gggggccggttcgaagtcaaagggccacctgtctatgggccgatccctcgtggcaaggttggggcaacccttcggtggcgtctacgtgtggtgggagcctgcagagttgccaccacgggcccctatgactctgaatagccgggcttttggggtcctcgtgacgtcgacccaagcctagaagggtactcgcgcagtgttctccggctgcagctgtaatgcagcagtgctggcgttggacaacaagctactttgatagatggcactcgacttctgcgcctcgcgcagtatggaggcgactgagcacctcgggcatgtaggtcttgactggaactagtgactggaggaccgagtggagcatgcaagctcggttactaccgagaaagagacccacgggtcgttgcgtgtggagaacgacctgaggatcattcctccggccttttgtatttctatatgttgattcatcgattgctgtagacactgctgcggagttagggcgagtccccctccctccctttcccccccaagcacagaggggagaggggcagggaagtggatgtctcctcccctcccacccacnctgttaacccctcggaccccctcccat

SEQ ID NO: 519235 - DNA, 112 bp, Homo sapiens
ggtctcttcctgacgccaaagagagggaagcgaggccggatttccatctctacagagtcatccaaaataaggagggtgccagggtgaagaccgatgggccctttggtggagg

SEQ ID NO: 519236 - DNA, 121 bp, Homo sapiens
cgtcgaggattcgtaaaaacactgtagcacactagtagaaacagatgcccccaaggtttttccatttttctttattatttctcctcctctgggtttttctcacaatctcttggagtgcttt

SEQ ID NO: 519237 - DNA, 426 bp, Homo sapiens
ctggaattctcactgggcctcagccacctccccacggggcagggctggggacctgcagcctgccatgcctgagaccccttggggacctgcagcccaccatgcacgagcccccaccttggtgggctcccgcgcggccggagcctcccccacgggtgctgccccctgctccacggcacctggtcccattgacgcccaagggctgaggagtgcaggagggcagctccacccacggccctggcccgggatccactaggggaagccagctgggctcctgagtctggtggggacttggagaacttttatgtctagctaaaggtttgtaactacaccaatcagcactctgtgtctagctcaaggtttgtaaacacaccaatcagcaccctgtgtctagctcggtttgttgcaccagcgagtgctctctgtctg

SEQ ID NO: 519238 - DNA, 276 bp, Homo sapiens
  misc_feature (3)..(3): n is a, c, g, or t
  misc_feature (31)..(31): n is a, c, g, or t
  misc_feature (44)..(44): n is a, c, g, or t
  misc_feature (95)..(95): n is a, c, g, or t
  misc_feature (101)..(101): n is a, c, g, or t
  misc_feature (134)..(134): n is a, c, g, or t
  misc_feature (235)..(235): n is a, c, g, or t
  misc_feature (246)..(246): n is a, c, g, or t
  misc_feature (268)..(268): n is a, c, g, or t
aantgccaaaaagggaatgtcctgaaaagcnaataaaagtgggnaaccccccaggtttcccccaagtaacgacgtgaaaaaacgacggcaaagtnaattgnaaatacgactaactataggcaaaattgggaccnggccccccctcggagtttttttttttttttttaaaagttcaaaagttttaatccaaatttagacagtgttgagaaaaccaaactttggccatagaaaccanttcctcccggnccgcaatgggaccagaccacgncccctgat

SEQ ID NO: 519239 - DNA, 946 bp, Homo sapiens
gtctgcccagttttcgcgataggctgtctggcgcgcctggcgtgcccgcaggctcccggcgacgccgccttccccgcaggctcccggctcgcgccttccccgtccgtcactgatgtcccaatgagcgaagtgtcggagcatccgccgatggcgccgccaaggacagagccctagaggagatcgtgtcgcggttgtcaagtctaaacctctctgcaacaatgttggtaagtcgaatacgcccgtaacacaacgtgcagcgggcgtaaggactaaatctttcagtactaacactatagttgctacatacaaacaaaaggcgataaagcgtgcgagtctacatagggatataaactatggctctgatagtgagctaacgcaatatactacataagacattacctgcggacaaacggggaaacgaagactgaggagagtccagcctctgactcgaagcaggcagcagaaaggaagccaagtcatgattaataaccgatataccgagtgtcttcatcaagtggtccctgttcatcccctttcgtttgtacgaatccaagcaggaaatatttttatatcaaagcgtagttgctggctaccacttgcacacggttatgtgtctacgcgtagcttcgtacggagaaacaatttttttaaggcaaaggcagcgggcaatccccatccttcaattcccacagttattctctacacggtggtacaaattggcatttaatttgataagtaaagaaagcgttgaaaacactcacattttaggcatggagattaaaggtaaataagatttgtaatatagagttagcaaaagccaagaagtagacttagatggttgagagacatattttggaaagtttactttggggaaaggggcttaccttgaacttggatctcagggggttggttcagagacttaaacagaattgctcacgcagaaatg

SEQ ID NO: 519240 - DNA, 189 bp, Homo sapiens
gatactcctccttagccaagctgctcgtgctgtcttccctcctctactcttggtgctttccctctgaagatctcttaggagtgcaccagtactctcagtccctccggggcagctcttctacctggctgcgtctagtcagccatcttgccccaacatctacttttataaagtcagtctcttggcacacat

SEQ ID NO: 519241 - DNA, 103 bp, Homo sapiens
  misc_feature (103)..(103): n is a, c, g, or t
gattcaggcactatgggtaaatcgagcaataaatacctgtaaaaacgttttagcaaggtcacagacgggtatcaactatccctgttatcgtaaagcaaatcan

SEQ ID NO: 519242 - DNA, 381 bp, Homo sapiens
tcagctatcataacatgtccacatcatcccctcacactgtcggtgatcgtgtgcaagaaactactctctctgctgtagacagtttgcgcatgtggagaatgccagtctcgtcaagacgcgtggcctggagtctcttgcatggtcaggactgtccctccgtacaccagaggactttgtgttccattgcttcccaatgattaattgagagagaaatacaggcgctacctcttcagggactatgtggagagtcattaccagctccagcgtgtgcctggtgcagactgccccatggttattcgggtacaggagcctagagctcgccgggtacagtgcaatcggtgcaacgaggtcttctgtctcaagtgtcgtcagatgtatcac

SEQ ID NO: 519243 - DNA, 922 bp, Homo sapiens
gcaggtgcgacgcacgaaggggatcactgacactacagacccgtgctgtttcgaccgaaacctcagtgatgacagatctggcatctgggagaacagtcggtgctccttgtaacctctagagactggatctggcgagatgatgagcagctcataccatgtctgattcttggattcctgcccacactcgctggggcgagtccctgaggagcttatgtcgagaccactggcttgaccattgttcatgaaggcgtcaccaggacatgtgtgagtgtgacgcataacgaaggatcaccaagtatgggagagaaagcgggtgctgaaagtagggaataggttggtgccaccgtcgtaatgtgtgagtaccgtgtaagagtggtgggggaaacatggtcggcgaggcggaggagtcatagtggctcctttgtgtaatcgatcgcaacagctctttgttctgcgtttgaacttctagtgttcgatgggtattaagtggtcctgtgtgtgtcagtgaccctgtagatctgtattcacgactgcatatctggggttacggttagaattagtgcaaatcttccggtgtttttcgcccagtaagcatatctcctttgaaaatgttcgaccaatttgctagatgataatccgccgggctgacttcccagaaacctgtcactagcggtctgtgtgtgccccgctgattgcatcggatatgtgtgggcttagaggtcgtggcctatggctagtatagcggctcccgatggacagtccgggggcgtggggagacctcttttatgcctggatttccctctgcgcagagggtccttttggcgggcccctttcctctggcgctctggggcagccccggggtggccaatggccagccgatgctgcaccggggctccttccagctcttcgcttgcttgggcag

SEQ ID NO: 519244 - DNA, 152 bp, Homo sapiens
ggttcctacctcaggacctcaatcgataggttcaggtacacagaccaagaagtccaggcagcatgtagccagtgagcttgtcacgtttatctccagaagttaaccaacattaccccaaactaatgatgacaattaccgggaaaacatacgca

SEQ ID NO: 519245 - DNA, 107 bp, Homo sapiens
gggttacgaagaggctcgttaataaaattgtaaaggtaagttgttttttttttccaggaaggcctcaagggtgggagtctctaaggattattttactagtaagatcc

SEQ ID NO: 519246 - DNA, 121 bp, Homo sapiens
agagcgactgagggcgtgtggggtggtcatgggtgcatttctaagtcattttttagtgttttgttaccccgctcttttgcccaggctggagtgcagcagcacgattatggctcactgtagc

SEQ ID NO: 519247 - DNA, 383 bp, Homo sapiens
cagggtacagaaaattttggtttttttttttaaaaaaaccccacaaaggcttttttttggcttttggacaaaaatccggggcatcaaaagttaagccacccccccaaaaaaataaggtccccgccccaagaaaagggtggtttcacagggaaaattgtgccccccaaccttgttaaaaaaaaaaaacggggggacccttcggccagggttggttcataaaacagggctccttgtgcccctggccaaggggtttttttccctgccccccaaattttccacttttgggggtttttattgttataaaacagaaggggctttttgggtttttaaattgattttccgggccgggccctttaaaaaaactaggatacgcctttggtgca

SEQ ID NO: 519248 - DNA, 654 bp, Homo sapiens
  misc_feature (254)..(254): n is a, c, g, or t
  misc_feature (256)..(256): n is a, c, g, or t
  misc_feature (277)..(277): n is a, c, g, or t
  misc_feature (302)..(303): n is a, c, g, or t
  misc_feature (337)..(337): n is a, c, g, or t
  misc_feature (345)..(345): n is a, c, g, or t
  misc_feature (401)..(402): n is a, c, g, or t
  misc_feature (429)..(429): n is a, c, g, or t
  misc_feature (438)..(438): n is a, c, g, or t
gggcttccctactttccccactatgttaacaggtaattctgatttatgcctttagttgacttatttttaacaaaatattagaagttatgctttaaaatgtttaatgtggactgaaattttcatctttgtttgagaatctatgaagtgtatcatatacgtggcctaaagcaaggtgtgtatttgttattctgaaatgtttgcatctggacaaatactaaatatcccagtggccttttttttttttttttaaaccngngtttccatctcatcctttggngcattcctagtaagcaaaaaatttnngttatgccatcttcatattcgaattacagactgnaaaaatanttggccagtttttaaagaagtttagattatgtttccagggaaggacaagtctgacnngtcataggcggatttcttaagaggatnatcgtgttnacaatttcaattctagatcacattttaatatagtgcgtgagtgccaaaaaaaacaaccgggagaaacggcgctttccgggggggggggggaagaaaccttatttttcacactaccaagtagagttcaaacacggttttcctggagaacctttccggcaacgttcaccaggcttcgttttggagccttcggcgcactctattcagaagaggttcatg

SEQ ID NO: 519249 - DNA, 175 bp, Homo sapiens
tagagcatggatgtcaggagtgagaccatgcctctaaaaaagaaaatcataagaaaagagaatagatttactgtttgttaaatggaggtggatcgtcataaagatcttcatccccattgtcttcatgtcaagtagactgaggaggaggaggggtcagttttgttgactagagtgg

SEQ ID NO: 519250 - DNA, 186 bp, Homo sapiens
acattctataattgataactccctgagtctcaagacaccttcctgagtgtgtgctctatacccttacaccctcagtggatgataatctcaagacacctcccgagtgtctggtcactcccctttcaacctcaggtctaccctcagtggatgataatctcaagacaactggcgagtgcttgtctatcc

SEQ ID NO: 519251 - DNA, 418 bp, Homo sapiens
  misc_feature (25)..(25): n is a, c, g, or t
  misc_feature (369)..(369): n is a, c, g, or t
  misc_feature (399)..(399): n is a, c, g, or t
aaaagtaccatgccataccatatantttaaaagaaactcaaacctggtaatgccgttaatattccagagtagagggtaatatgtcacccactgtgagccctcatgccctccctagaagatcacatcttggttcaataacccactggtgtcctggcaccccattttatctcattatagttgacagtgcgctccctgcaaagatctcatgtagttccaaaatctctgaacagcaacaacaatattcagattagaaatgtaagaaacaggcccaggtgtggtggcacgagcctgcagtcccagccactagggaggctgaggcaggacaatcgcttgaacatgggaggcagaggttgcagtgagctgagattngccactgcactccagcctggcaacagtagncactccgtctcaaaaaaaa

SEQ ID NO: 519252 - DNA, 268 bp, Homo sapiens
  misc_feature (5)..(6): n is a, c, g, or t
ggagnnggaaagatggaaacgctggaaatgatactggcgctcactttgccatccgaccaccctcggctcccgagtccacgcgtgcctgtgcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggag

SEQ ID NO: 519253 - DNA, 282 bp, Homo sapiens
acccagccatccaagagtggatcaattagttacttcccaggaattgggaaaagagggccatcactttcacaatggctgagctagagacctccccacccccgaaccaagagcggtttggtgaccctatttcccatcatgttgtctgggaaggagagcctgcatacagatacatggcaaagagtggagatgagccatgaggatgcagtcatggcaacatgtgctctcacaggaagctcctcgctacccccagctgctgagcttccttcctccacttccttgttt

SEQ ID NO: 519254 - DNA, 130 bp, Homo sapiens
  misc_feature (27)..(27): n is a, c, g, or t
  misc_feature (75)..(75): n is a, c, g, or t
ccccattctatatcaacgggttacaancgagttctggccttgtctgtggagacggaattacaccttttccccttnctaaaaggtcaaggccttcttggctgatccattctgcctttgtggctgctgcccc

SEQ ID NO: 519255 - DNA, 313 bp, Homo sapiens
  misc_feature (41)..(41): n is a, c, g, or t
  misc_feature (187)..(187): n is a, c, g, or t
  misc_feature (220)..(220): n is a, c, g, or t
  misc_feature (222)..(222): n is a, c, g, or t
attttcggaggtcaaggcaggtgcattgcctgagctcaggngttcaagaccagcctgtgcaacatggtgaaaccccatctctccaaaaatacacagaaattagctgggcatggtggtgcgtgcctgcagtcccagctacttgtggggctgagacggagggatcatttgagcctagggggttgaggcngcagtgagccgtgttcatgccactgcactgagntngattgattccaataaaagcatatatcattgtggtagggtaggtgggtggctggatagggtagcctgggtgacagagtgagtccctgtctcc

SEQ ID NO: 519256 - DNA, 550 bp, Homo sapiens
  misc_feature (52)..(52): n is a, c, g, or t
  misc_feature (109)..(109): n is a, c, g, or t
  misc_feature (123)..(123): n is a, c, g, or t
  misc_feature (136)..(136): n is a, c, g, or t
  misc_feature (226)..(227): n is a, c, g, or t
  misc_feature (259)..(260): n is a, c, g, or t
  misc_feature (269)..(269): n is a, c, g, or t
  misc_feature (315)..(315): n is a, c, g, or t
  misc_feature (317)..(317): n is a, c, g, or t
  misc_feature (337)..(337): n is a, c, g, or t
  misc_feature (340)..(341): n is a, c, g, or t
  misc_feature (345)..(345): n is a, c, g, or t
  misc_feature (356)..(356): n is a, c, g, or t
  misc_feature (360)..(361): n is a, c, g, or t
  misc_feature (363)..(363): n is a, c, g, or t
  misc_feature (370)..(370): n is a, c, g, or t
  misc_feature (375)..(375): n is a, c, g, or t
  misc_feature (377)..(377): n is a, c, g, or t
  misc_feature (382)..(382): n is a, c, g, or t
  misc_feature (406)..(406): n is a, c, g, or t
  misc_feature (416)..(416): n is a, c, g, or t
  misc_feature (419)..(419): n is a, c, g, or t
  misc_feature (454)..(454): n is a, c, g, or t
  misc_feature (461)..(461): n is a, c, g, or t
  misc_feature (490)..(490): n is a, c, g, or t
  misc_feature (545)..(545): n is a, c, g, or t
atggacattttttctagagaaacagatctctgagcgttagaatggaagatantgaaacaagagatttcactttataatttacctttgtcaaactatcccagagcatgtnaattctattatgtnagtattactttgncgatctatataaccaattattaatagaaaacacacatgccaaaaaaccttaaattttgtaatcttcaagtcaatcatcaacttttcttgnntttttgaagacccgaaaagaaaaataatttcnnacaacagcnctcaatatcatcatatgcatttgtaatgtggcacagcaatcttttncntttttttttttttttagttnggnnctcngtcccccaggngggnntncgggggngtgancngggcncaccgcggcctccacctcccaggntcatgtgatngtnctgcctcagcctcccgggtggctgggactactggngcctgcnaccacacccgggtgttttttgtttttttngtagtggggggtgtttcgccatgttgtctctgcgtctggatctcgaaactcccgncgctc

SEQ ID NO: 519257 - DNA, 788 bp, Homo sapiens
  misc_feature (418)..(418): n is a, c, g, or t
ggttggtgaccaggccaatcccttctccacttactataatggttggaagctaaatgtcaccaaggtggcttctccttggctgaggatgatggaaggcgtgcggtgggatttgcgtcctgggttccactaggcccttagtgagggcatgaagagaaatcaatccttctcgccttcttacatcctgtgaggccatatgatcccctcagaaggcacgtgagtgctgccctactcccatggtgcccgtgtctctgtgctgctgtatgtgaaccacccaatgtgagggaactaaacctggcactagtgaactcacatcacaaatgtcaatttatgaataggagcgttaaagtctactcgggaccaaggcaggaagtggggtgtaacaagttgaattaaacgtgcgccaatgccaaccgttgcntccgaggaacaccagtgagaccccacagaatattctcgtgtggaaacacacacagcgggggggagcacatacatacgcgcgcggcgcgccccccgaaataaaaagagagaggcgcgagatatacaaatctccgcgcagaaaaaaagggcgcgcgaggtgggtagagcgcgcgcgcgcgatagaaccaagagacggtggtgcgggaaaaaaaggcaccccaggggggggcagaacaaactctgcggcgcggggcgccaccccccaaataaaaagggagaagcccggaattataaacaagcgccggaataataaagcgcccgaggggttataacccacgacgaacatataaacaagaaccccaggggaaaat

SEQ ID NO: 519258 - DNA, 279 bp, Homo sapiens
gctctccaaacatctatcaagcttgtccaacctccagcccaggaccacatgcagccaaggacggcttggaatacagcccaacacaaattcataaactttcttaaaacattatgagattttttcacattttttttttttagcttatcagccatcgttagtgttcgtatattttatgcttggcccaagacaattcttctcccagtgtggctcagggaagccaaaagattggagacccctgatctaaatactccatgtacgtgaaggtcactttcactgctg

SEQ ID NO: 519259 - DNA, 788 bp, Homo sapiens
agcttacaatctaagcaatgagagtaaaattagaattctaaattctcagacatcgttccctcatgtcgtatgaggtggagagacgagaggaagcaaacgccaaggagccttctaattttgactatatgatcattaactaaaggcagcaagggattgtgaactaatcttagatatgtcaaatgttttcactagaatgcttttggttactaatcaggttttttaatagtattttaaaggttttgcgtatgtcatatatagtatatgcattatgatttctaatagaattagtgtccagtatagacaataggtgcattaggtcagaaagtgtgtttccctctgtgattttatgctcatagccgtagaggtatatgatttgcttgtattcttgtagtatgtctttgagagtaaatgttatcgtttagtctgatatgatggtctctactctgtatgatctcttcctgttcttattttaaatgttcaagtatgggattgggtcttgtgtaagtctggtcgtctttccatattgccacctgtccagtctcgtaacagttaatgtctccaggattccattgatatggatgtccgtttgggagaacataggttatagagttatctaactaaaactattgtggataaggataatatccttatgcatattttgaacgattactcttgattctggctgactggcaagttattaataagtagacattatctatgagaggtcaccagatgtgtaggtatgactcttgtggtttccatttgagaaattttccttcttaggaaga

SEQ ID NO: 519260 - DNA, 141 bp, Homo sapiens
  misc_feature (87)..(87): n is a, c, g, or t
tctcctttgatagggtggagaggtaaggacacttatagtatgttgatagtagaatgatgctagggtgacttcatatgagattgttgngctactgctcgcgtgccgcgatcagtgcgtagttttgagtttgatgctcacctg

SEQ ID NO: 519261 - DNA, 694 bp, Homo sapiens
tcggcgtataccgtatactgagtcctcaagcttcttgagggaaaggacatagataaaatactacttagttgtctagtactagtaccttggatgccgatgggtgactatactaatagtaatagaatagcacagacacagactatgcttcctgcatggtaaggagagacacaaaagatgggaaactgcttttccacaaggaatctccgtagaattcttgcggcgaccagatggtgcataggtctggaaagtctgatctcccttggtcttccatgggatgcttagtagtggaggggagatatagattgtccggccgctttgtgattccatggattgattcagtcttctggatttattttactttaatatttagggtactggagcttttaaaaatgtttggttatcaggtatttttattcatgtgaagtgtctatgattctcttgagataaggttttaagctaaaatgttactccctgtattagtttctgacctctgacagattgacagggactttgctggtgtagtctcagaataggtataataaaccactagagcctatatcagtcgtattagtgtctgacctaatatttggagctatcagtgctatgtcgattaagatgatgactcacgatattgactggtccattcccatttcttttcttcctgaccccatacctaaactttaaatctctgtac

SEQ ID NO: 519262 - DNA, 1935 bp, Homo sapiens
  misc_feature (875)..(875): n is a, c, g, or t
gctcagtaggctgcccaagtgatacaggttttctctactactttttccagaggtgtcccagattttttttatatcctcctactaaagtggtccctaagtggaattcccaaggggtcagataaagttcttgggtggaattcataaaaggtaacgtctaaaaagagttttaacaaaatttttatccataaaaaattggtttttctcaatattcacactgttactgtgtcgaatttggtacactcagggataacatttggctagagaattactaattaatttggtggcaatttcatatgcaaattgtgtgggaaaggatctggtaaacaatctctgtgctaataaaaccttatttggtctctaaccaaggcatataaggtagggattaaggaacaaataccttaaagtgtcacgtgggggtcgcaggcagcaccacgtatgggcccactagtggtctaccattattgtacttaaccctggcccaaaggtgtgccctttgtgtcccctaaaaaagatttacgggtcctcattcaacccacaccacacgagcaacaacgacacaaacaatcagtggggcggcgggcgccatgcggcactcgagaaaaacagttttccaacagccactatcgtggaggggggccccgacgaccccaagtgacactgcagcgacagcgacggggcaacaagctgtgcgcccgacagagaacctcctgggctaagcacaacggcgcggggggtacccccccaaaaaaaaaaagcggggtgggggaacaccgggtgttgtaagaaccacacccgaaggggttccagcggccatacagtgggttccacaaagaggcggcccaggatgcgaaatacatcgcgctggcgaggcagangccaataaacgaggagcggcgggagaaagagaggacaacgggagacaagggagaggccaagagggagacgcagactgcaggagagagcggtgcgagtgcaagaagagcagagcaggcgtagggagggaacagacagccagatacgaagcacaggcagagccgagcagggaagcagagaggcagacagggcgaggagaggaagccagacgagcgcgccacccagcagcgggacaacacaccagacagagcgcgaaggacgatagaaaggaaggacacgcaagggagagaaacgacgcggaggacgagggcgatagaaagaggaggaagaggcaagagcgaggagaaaaaggagaaaggacgaggagaagagaagagagacacgaacgaagcgacgtcgagcagagagagcagacgcgaagatgggcgaaacagagcggagaggacgagggaagaaaggagaaacgacagagccagggagaaagaagcgagcacgagcagagggaggacgacgggacgaaggcgagcaagagacacacagcagacggaagaggaaagaaacacagcgaagcagacagatgcagggacgaggagagagaggatgaagaacgcgagatgcagagagacgaagtgtgaatgaggcggggcgagagggaaggagagggagacggaaggcgcaggaggaggagtgagagggagacgatggaggatggcagggaagagagagagggagcgaggagcagaagggcaaaggacggagggagagcagaggggagaataaactacaactaggaagagccagggaagaaacgaccacgaaagagcaaaggaagcagaggaagagagaggatagcgaccgccacacagaggtcggaggaggcgagacaaaagaggagaagaaagggcgaacagacagagaagcagacagagggagagagagagcagagagaagagaaacaagagagacgagggcaggacaggaagacgagagcatagagagaagaaagcacagagagcaagagacaagctaagagagaaggagtagaacagcggaaagagagag

SEQ ID NO: 519263 - DNA, 351 bp, Homo sapiens
gcacagacagctcagcacagacagcacagacagtacagcacagacagcaaagcacaacacagacagcacagcagagcacagcacagcagagacagcacagcatagcagagacagaacagcacagcacagcacagacagaacagcacagcacaccacagcacagacagaacagcacagacagcacggcacagcacagacagcacagcacagacagcacagtacagcacagcacagcacagacagcacagcacagcacagacagcacaacacagacagcacggcaaagcacagacagcacagcacagacagcacaggtttatccggccgcgaatttagtagtagtagtagacc

SEQ ID NO: 519264 - DNA, 247 bp, Homo sapiens
gtgcctgtataccctgcggagtatgtaggaggctgctaccttcctggagaattcctttatttggctctgcgcgggagcagttacttgaagctctccaggacttgggactgctgcagtctggctctatttcaggccttaagatcccagctcatcactagaggcagccctccatggacccatgaaaactgagatgaggaccttggaactaagggacgggtgaatggcgcgtccaggggtggtaagccag

SEQ ID NO: 519265 - DNA, 257 bp, Homo sapiens
tttcagccaatcccgcagggggcttttctgttgcttccactgggaagaaggcggtgacccccgctcctcccctaaaggggtgggggttttcctcgggccaccctttcctgtgacaattcaccctcacggccccccggatacttttcccccttgggtttcccccaggggggatttgaccttatttttgccaaatacgtagggctcaggtttcccttctagttttactttaaaaaataaaaaaattggggccgggtcca

SEQ ID NO: 519266 - DNA, 213 bp, Homo sapiens
ccaaccaggatggcgcccgcggcctggccgaggtcaagcgccagggtggcctgaccatcgtccaggaccccagtgaggcccatgtctcgaccatgccggccgctgccctggccctgcaccaaccggattacattctccctttgcgcggcatcagccgtctgcttgccgagctggaaggaacccatgttaagtaatattcaagccaagctgctg

SEQ ID NO: 519267 - DNA, 227 bp, Homo sapiens
tccagctaaactttatttgcagggcagcacggtgctcacgtgggggcgtttcttggacaggggggcatgcaccgcagtggtgaatacacgtcgacctgcctccatctaaacaatatttggagatcagcacggatcttatgtagcgacgctacttgtatacagagtcatgcaccgcagtggtgaatacacgtggacctgcagccatgcatgcatgctctgcaactgaa

SEQ ID NO: 519268 - DNA, 136 bp, Homo sapiens
gagagcatggctgtgttgccagtggataggtcacctggtttacgacgatctgtagggcatatggcctgggctaggtgtacggctaattacctgaacatccgacaggtatggacaatgcatcgcatggagcgtactt

SEQ ID NO: 519269 - DNA, 968 bp, Homo sapiens
taacccctctttagttttttgcgctcaaaaaccaatttaaacccccccccattgtaaagggggggcggggaaaaaagcaaaaacgcgaaagccggcctgggaaaccaccagttctggcccccgcgcattttatcgccctggttggggttttgggtgtttccatcctggtccctggtggctggggtgtggatgtgagaggggtgggacgcctccttgggggggcatctgggccattggagcccctttggtgaagattgtcacgaggggatgtgggaagaaggccatctgtccgcgccgggtcttctggggaacggtggtgtttggctccccacaatgtctctgaggcgcggaggggggggtgggcacagggtctctctcaggggttgtccagggagggtgttgctcggagagggccagcaggagagggggcgctcctgggtctgggcctgagtgttggggccggagacgggagaaggggctctgaccctgtggttgtaaccagggggcgtcccatcacggctgggggcagggtgggcccgcttccggaacatttggggaaaaccttccctttttccctcgggagaatttttggcccggcccttaaagacccttgctttgtctcagagggagggtccagaagtctcggggggaccctcttgggggggacaaggtgggggtagaaggccggggaaataggagaacggacaggggggtctgaagccaaaaaaaacaagagaaagttgacagggtctgacacatgaacactgggtgtgtgggccccggacccaggtttttggttatggcataaaagagcacaacgggggccaataggtgcgggacggaccctgcctgggaagttactgcgtccatgtgtcccatatagccctgacaggccagaaatctaaaaccgagattgaccggaaggcgaaacccgggtcatcaaccagctagaaggcctaacgttatgt

SEQ ID NO: 519270 - DNA, 404 bp, Homo sapiens
gagagagagagagagagagagagagagagagagagagagatagagtgagtgagagtgtgacagtgcacatgggtgaccttgcttcaccacattgtttcccatggaattatggttaggctcctttgtgctctactgctacaacaagattttggatggggcacttctttcctcattgaatatccacacagcctgacctctgatatgccttatgagatgcacttgctgaccgttttgccacagccagttgtgctcattctgtctttgtctctggcacctgaccctgactagagccgactatcatctcccctgttggtttgcgtggcagctggacatgacatggatgtgttcagtttgtgcatattctcgcggcttgtcacctcccctactggcttgacatatccgct

SEQ ID NO: 519271 - DNA, 233 bp, Homo sapiens
tgcgattatgagcatgtctggtgttgcggtgccagaggacagtgtgctccctggtgcatcagcctggggtgtcccttcggctgcctgaacacgcccggtacggcatcgcgtgctgcgtgcttggagcttcggaggttctgcgttgcacacagcccggctagttacgccctcgacaggatgcagtttggtgtcccactggccaggaaccagctgattcacaagaagctggcaga

SEQ ID NO: 519272 - DNA, 215 bp, Homo sapiens
actccaccccctgccaggatcaagggatcatcctggtctcaagcaattcttcctggctcaacctcccaagcagtcgggaccacaggtgcatggcaccatactcagctaactctttaaattttttttgttggagactaggtctccatatggttggctccaaggtgagtctcatatattatttacttttttcctttctttttttttttttttttggg

SEQ ID NO: 519273 - DNA, 880 bp, Homo sapiens
  misc_feature (632)..(632): n is a, c, g, or t
cggacgcgtggggttggaaaacacttccatcctgggttcttcctggtccatctccagggccctgaacattctagctattctccgaccttccagactagaacatgtacccttgcttaggtgacacttttgaaactcagcttcatccctcagggagcagttgtcttccttggctttccttctgctctgacagactgccagcaagcctggcctcacacctaacggggaagaactgagacaggaagtatgaaattatcagaaagaaaggacaactataataaactagggcatttttacagtcccatctttgggttacagacattgaccaagcctcactcaagttttattccttagtggggatgaaagggagacaggagaatgagggaagcacgagggaacaggaaggcgtacattgtccaggagtcttccttgtagtcagaactggaatcaagatataatgtggggggaaaagtctatgttatcacttacttggcctcaggaagaggacagttacactttatattccactccattacttgaaaatgaattactccctctgtcttgtagtagatgtgagttctggaataatctaccctgtttgaacccatgggaaacagacaaaagcagactactgnacagctctgccttcctttgcccacatgtcagtttttaccttgtcctgatcttccttcctgcccactcatgtcaggactgtctactcctctggtatggagaggtcctaacctcaactgtgtagctacaatgtattcctactatcaagcgaagtatcgggagaacaaggtggccggatttaagttctgaacatagtgtctagattcgaggtccctcagccaggtcggaagttccttccgtctccaaggga

SEQ ID NO: 519274 - DNA, 360 bp, Homo sapiens
gaagacctgggaccttagctcatgagaaaaaaaaagggtatgaaatatagctgtactcttatgcataaatacacccagctaggaccattactgaccagagaaaaaaatcgtattgaatggccatttccctactatataagatgtactcaatgctgaatttatttaggctacactaaaaaaatgcagtatatttagcttttccactttgcatatatgtttgtagtgctcatagatgatattttaacattgaaaagttagttttaaacttatttttacagtagaagactgtgttcagcctctttttatattcgtacatatgtcttttatgtacatttactgtgcatatgtttctgtagactg

SEQ ID NO: 519275 - DNA, 251 bp, Homo sapiens
  misc_feature (76)..(77): n is a, c, g, or t
  misc_feature (89)..(89): n is a, c, g, or t
  misc_feature (96)..(96): n is a, c, g, or t
tagccaggcatggtggcacatgcctgtagttccagccacttggtgggctgaggcaggatcacttgagctcaggtanntgaggccatagngagttgngattatgccactgcactctggcctagacgacagagcgagaccctgtctcaaaaaaacaaaacaaagaacaacaacaaaaacaacaacaaaattaccaagagctccccgccagccaaaacaaaaaacatcctcaaacagtaaagtccttcatatca

SEQ ID NO: 519276 - DNA, 182 bp, Homo sapiens
tctctcacccatttagatgcctgctgcttgtataccctttggacaccctggggtgaccaaggtttggaaaagccacctgagaccacttcatagcaagggaaggctttaagcagttactagaaagagatggggattatggcccctgtgctcctcacaacctgacatgagctatttaataccac

SEQ ID NO: 519277 - DNA, 175 bp, Homo sapiens
ctagttttagaacgtcaacgagcgagaaaatagcaaaggagcaatagatgcacttcaagacgatattacgagtcagcttgccaggaagtgcaagggtttcgagggagcaagcgggctctcctcactcatggctgccggggggttctggtgctatgtgctatggaaacttctaaaa

SEQ ID NO: 519278 - DNA, 814 bp, Homo sapiens
tggaggttggcagctatttaatttacaagtatacatttaacacaaggaaataaacacggatatactgaagcctagtaaatagtagggtaacaatatgcatcatttggatgattacattattttaaacaacaaactacactgaaaaattaaggccgataaaattctgggtcataatattaagaaatacaatatataaatggaaaatatgatggcttaaaattggaaaagggaagtgaactcattgggacagactcagagttaacataatctgaagggaggggaagctctgacccaaatgatatctttgcaggttaacagaagaaaaaagaagcatagttaatcttcaaggaaaacgggcagttggcttctatcaggtagaatatattcccagtgtcctcaggcttggcagcagaatcacatcaccgagcatgaagactgtgcctgggtgaagctgccccgatccatttatacggcctccaaaataatccttcgaaaaacatccacagaagtcaggatatatctatgagcagaagattccaaaaaagctgcataccagaaattctgccaagagacttacccttctatcataacggatcacccttttccatatgcaggtcttacttattcccaaacaacataataggatattggaccttcccccaacatatccaaaaatttgccagggataacattagttcacttcaacaattggatcgattgtaacagaatacaccaagactatagccataatatatagggcgaatgttgaggaacagaaaactttctctggccggtgtgtttacaatggagatgc

SEQ ID NO: 519279 - DNA, 108 bp, Homo sapiens
ggatatcactgagacttatctgattactatacgttatacctcaacgaaaaacgaaaaacaaaaaagacaagaagcaccaaaaatagactatttatataccaaccggtg

SEQ ID NO: 519280 - DNA, 461 bp, Homo sapiens
caaaaagcctgagtagtaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggctggccatatgcagaagatcgtaactggaccccttttactatgtacaaaaattaagatggtttaaagagttaaaacccaaaattataaaaatcctgaagataacttaggcaataccattctggacataggaactggcaaatatttcatgatgaagacaccattgcactctagcctggtgaaggagcaagactccatctca

SEQ ID NO: 519281 - DNA, 329 bp, Homo sapiens
cttaaatgtattgtggagtgtgatgtgctatgggatgtggacatccctgtaggctcgcagggggattgggggctggcaggacgacggatgctactcagtcctccaggaggatgggcgaacacgatgtgcctcttcttggcccagctggaacagacaccgccttctcagtgatgaagcggtgggcgctcagggggcgccttgtcggtgttgccaggtacatcttgaccacatcatctaagcgggccctttctcaaagtcgtggtaagggcactgaggtgtggctcttttccctgcagtagctgtcgatgaccattcccattagaccagga

SEQ ID NO: 519282 - DNA, 722 bp, Homo sapiens
tggtctaaaaggcaaaaaatcctacaaacagcccaagtcctgagctccccaatgacctggatcctccactgtccccctgaaacccggcggggggagcattggggatgccctacagagcgtgtgggatttgtctaagacacagagtcacaccacgtggatctcggagaagagatacctctatagtgtcgatatcactattctgtacactctcttatgtgtccaccgataaggagaccataccaagggataatatacacgctccggagtaacgcgcgcgagaaatagtatgaaccaaacgagaaggtgccgagctagagtacatgcgaccccaattaggagaagaaaaagtggagaggggaggtccaaaagagtgaactagagtgacacagaacaagcacgagagaggcgagcgatagcggacacaaatctcaaggggcgggatacacctatagaatacaagacaatacctaatacaccctgcagaacgtcgagaaggacaaacacgacaaaaaagagactagacggcgaccttcgacgacgaacgcgcgatacgatgacagccaactgcgcgcaaaatcacacaagagagctcgaggcaggtactaaaacagttagtagatatcatgcgagcaaaaccaccacacacagaaaaacaacacgagttgacgactacaaaaacaaagtggagggaggaagtataacaaggggggagcaaccatgag

SEQ ID NO: 519283 - DNA, 123 bp, Homo sapiens
tgaatgctggcaatgcacgagtcccagcaagactactccaaaggattctggcgggaagtatggtggtgcagaatggatctggatgtgataatgaatgcagtcaacctattgaggattgtcacc

SEQ ID NO: 519284 - DNA, 641 bp, Homo sapiens
  misc_feature (272)..(272): n is a, c, g, or t
agagtaaaaatgtcctgcataacttgttgttccctaagtatggtatactgagtaaagtagggtggagactcgtagtcgtcccccgctggtcttatagtgttgtttacacgaccaactattggtgtgttggtgaaccgcacactctttttctgatatcacgcacacagagcgggatgtaatcctttcagatatgggtcacgtacacacctctcgggtggttaataagggcttgtggttccccttgttgtggtgtaacaacggcgacacgtcgnggggttatatagaaaaggttgtttcgctcatcataagaagaccccctgcggtcacaatgtatcccctcttctggttttgtgctgctttattccatagtaccggtgctctctattaacaagtttttgaggaacatcctgatcaaagggggcatagatgccccacgtgtcctattacccgcgccttctgtactattggatgaacggatgaagagggtatgtttccaaagatttttttcattgaagatctgattttttctcccctttatcctaaatgtgcacacacactttgtgttatttatttccttttcacaggagggcacaaaagagggagacctgatttttaattaatccgggattgaaatttaatta

SEQ ID NO: 519285 - DNA, 1044 bp, Homo sapiens
ggcggtggtgcgctgaggatagccgattcctgcctggattccacagcttcgtgccgtgtactgtcgccccatccctgcgctgccagcctgccaaaacagtgtgcccggttgcaggcgtcatgcagcgggcgcgaccagctctgggccgctggctgactctgatgtttgctgtccgggggccgcgatgggctgggctggtgctgagctcgtggggcgcgttggtgtcccgtggtgctgctgatagcccgtgcggacgtcgcgtgcagtggtccacatgcgcgcctctgacgcgcggcgtggtgcgctgagaattggtacgctgagccggggctgggttgtgtgcctgagtgctgcactggagcgaggtccaccgtggggatctacaccgagccgctgtgggtccggctatggtggcgagcgttgccgaattgagggctcataaccgttggaaggcacttgtttggaaggagtcgcgaggattcatgaggttcaacacgctaattgcaagtaacgctgcctgttgtgcataatcctagctgcacggagacctgacaagactccaagggaaagtgctagttgagtacggaggaagacccgcaagcaggccggcaaagagtggcaaatccccgtcctgttgccagtaccgcaacgggtgtctagattccaagaatccagcccatctagtaacaaagatatcatcattcattaacgtggcaaggttaaagatcacgcaagggatactgacgtttcacaactagttccactatgagagaaataccagagaactttcgcccaggcccagcggggcacagaatattggccctgccctttagaaatgaaaagcctgacatactgaaagtcataagggtagacccagggtgaagctcccgctgggcccacggctctatagaaaacgcggcctccacagacgagaccagacaatccggtagcactctagccataccatataccacagggagaggtcgtacatacaaaccaggttagaagatactccaagcaaaccggcacattcgtgttcacaca

SEQ ID NO: 519286 - DNA, 800 bp, Homo sapiens
  misc_feature (542)..(542): n is a, c, g, or t
ctgtccgctcttcacggatgagctgtgctgttatgtgtctgtgctgcagattggcccatgtggtgcaccgtcgggggggacctgcatttcctgcttggaagacttgggggactgccgagcatatcacacatgtgtttatagtcaccaagtgagactgcagctaacaaacatctcctctcacagcaaaggcccgtgaatgtcatctagatgcctgcgaggtgaaaccaagccagccctgctgttgagaggaggaaaagcggcagatgacagtggagatgtctcctaagtcctgtgccatccacctgccaagggaaaagcacagaggtgctatcttacttttctctctaggcaattcagatccatcattgtatgtgcttgtgtgcgcagtgattaacctcacctgtgtgggcgtgaaagctgattggcatggttttgacttcagcttcttggatggcctaattgttgcactgtgctgtgggaaatgcctctgtatattttcccctctttgaccattcttttttctggaaaaataaacgtgatgnggtcctctatgcttaaaagcccaaacccagaattgccactgaaccttctgggcgcggaggacggcccacctagaggtgatccaacagcgaaccggtggggacgcggggcccgcaaagtggaatggcacctgggaacaggcttgggcccaaggaaaccgtgacccaggtgggggcgagggttccaccgatcaaagacctccgggcggcacggccttcgtacacaaccgcagagctgcggcccacaggccccaagagccg

SEQ ID NO: 519287 - DNA, 273 bp, Homo sapiens
actctgcgacgcccgcgtggtgtaagtataaacttattgaacgtcaatgtaactaacatattcacagcacctttacgtggttgccaagccagaggtgttcaagtctgctgtgtctgactgctacgtcattttcggtgaggtgaagagcgaagacatgagtgcttttgctcaagctcaggctgctcagatgctcaggcccagagcgtctgttagcgatgacgctggaactgcttcttcggctcctagctttaacttgattgaccttacatctag

SEQ ID NO: 519288 - DNA, 128 bp, Homo sapiens
ctatctacagtaaaaaggaaaccacagaatgggagaaaataattgcaaatcatgtatttgataagggattaacacccagaatatatagagaacacctaaaactcaatcgcaaaagaaaaaaaaaacaa

SEQ ID NO: 519289 - DNA, 377 bp, Homo sapiens
  misc_feature (98)..(98): n is a, c, g, or t
  misc_feature (104)..(104): n is a, c, g, or t
gggcccctttacactgacccaggcaatcgcgggtgggccccgaaacccttaagccccttcatttgctctctagactcatcgggctgccccaaggtganttaaanctttgtggtcagtggcccctgggcccaacaaatgtacggaaagggtgagtccctttgggagccccacatgggtccgggtcccctgtttgaaaccctctcccaaaccatgtttaattctgtgggccgggaacaagggtcaggcatgggggtcattgtccccatcatcgaaaagggcaaaatccccccccgggccctaaagggccgaatgggctaaccctggtcccagagcccccttttttttttttttttgaaaaaaaaaagcccgtctttcca

SEQ ID NO: 519290 - DNA, 971 bp, Homo sapiens
tgggcactgggtagaaaacacaagtgaaaaaccctaagatgggccctgccacctgacacagttatacagcaggacctgaaaggatcacactgcttcctaggacaaagctcaaaagtacctctgggacctacaaaaatattcaggtgcccaagaaggtaaaatgtacaagtgtctagcattccagtagagaggcatgaaaagcaggaaaatactttgcaataatacagagaaaaattaatcacaactgaccgtggatctcagagtgctagaaatagtagacaaagagtgttattctcccagtgcaaataaagaaataaagatagcaaaaaaaaaaaaaaaaaaaaaaaaaaaaaaaaaaaaaaaaaaaaaaaaagaaaaaaaaaaaaaaaaaaaaaaaaaaaaaacaaaaagaacaaaaaaataaacacgaaacaaaaacaaaaaaaaaaaaaagaagggggggcgcacacaaaaaaacctacacctggaggagcacacaactaagctaccccgacaccacacttacgattgcgaaccggaggcctaccccacaaagaagggtatacaaaacaacaacgccgacccctcgcggatcataccaaaccagacgtgggaacacaacactacctcgatgcttgcagtctaggatgcagacagccacacacattttgtgggtgcacaaaaaattcaagatccgccaccaccaccgcaagatataggctacagccggcgggattaaaaaccaaccagatgtagtggatgagactaccaaccatcgtatagtcgcggtcagaagaaagagctcgccgacgtgattattaaaaattttaacggcgtcggtcttaaaattctgtcatctagatatagataaccaatcatacataaaagcaacgatgctacacactgctaccacaacattaacgtcgctagctacatgaccgctagacacagtagcgaccacagtagataaa

SEQ ID NO: 519291 - DNA, 275 bp, Homo sapiens
  misc_feature (9)..(9): n is a, c, g, or t
  misc_feature (20)..(20): n is a, c, g, or t
  misc_feature (65)..(65): n is a, c, g, or t
  misc_feature (102)..(102): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (152)..(152): n is a, c, g, or t
  misc_feature (154)..(154): n is a, c, g, or t
  misc_feature (163)..(163): n is a, c, g, or t
  misc_feature (166)..(166): n is a, c, g, or t
  misc_feature (174)..(174): n is a, c, g, or t
  misc_feature (184)..(184): n is a, c, g, or t
  misc_feature (189)..(190): n is a, c, g, or t
  misc_feature (197)..(197): n is a, c, g, or t
  misc_feature (219)..(219): n is a, c, g, or t
  misc_feature (222)..(222): n is a, c, g, or t
  misc_feature (229)..(229): n is a, c, g, or t
  misc_feature (233)..(233): n is a, c, g, or t
  misc_feature (268)..(268): n is a, c, g, or t
  misc_feature (273)..(273): n is a, c, g, or t
cctcccaanaattttttggnggaaattaaaagaaaaccaaacgaaacctcccctatccaaggggnagaactttatccccatattgattgaatataggattcnagatttaaaatgttgtaggcagttanantttnccccttttttttttttcnantggaaaggnccncaaatgtnctattgacanttttnnctttaanccatttggatttggggtacatnttncgatttntctncgttaatttcccttttaaaaataaaaataattccncaacncc

SEQ ID NO: 519292 - DNA, 145 bp, Homo sapiens
cttttttggcatttatttctctctatatattgtgtttataaattgtataagaaaataaaaaaatagtggccggatgtggtggctcacacctgttaatcccagcactgctggaggccacggagggctgctataagtggcgtgtatt

SEQ ID NO: 519293 - DNA, 1575 bp, Homo sapiens
gggctaaatcatgcttattgccacacaggcatcaacacaggcacagccatttgccaagcagctgacatcaccagggcaaatgctttcattcaacacagcgcacaggcagggcacatgcagcctccaccaagtctcccttctggcacatggccatgcaagtgcacaagcaccaaagctgctggcgcagggccgaggagccatggtgcctgtgccacattcagccagctcattcccaggcaacccataatgatcatcagtgagcagagtacccagcgcatcttacacctcataacaacaggcactaagtggcccccacacggcatcatgcgctctagcgccttacaccaaccacacacttcaggtccaacgtttgcctcctcacacccattatcacatccatgccagcgcttactcgacccaggccccccttactgcccagtggacaccgtggggaattcaatacagggctactttaattaaccccaattcacgtgacgccatgtaatctttgacaaagagagccagagtgtcctctctgagcccgtaacaggatctccttgaactctctccctcttaagacaaccccaatggcctccatgggactgtcgggcatttacccgtgcacagcttggcccaccttgcatatcctccggcacctatgtaacatcctggaaccccaagaccacatttaagaaacaacaattctacaactagttccaaaaagtggcgacacacattctgtggggcccacacttacctggttcacacccgcttacagccacagcctattacgccccgacaccacgaacgatatctctggccttagcctttggcgccctaccttccgctcctcacttaacgcccagttcccaacgaaccgccaacgggcatggttaccccatatgctcacacccacacactggcacgtgacaccaagcacacaccgcaccgcacacttgagaatctccacacttactaaacgcgcacacggccatgcatctaccgcacgcttgggctcctcaaactcagctgtcatcatgtgtgcaccaagttaacgaaacccccggtgtgccccaactcacacactggaaccccaacgactataccataaccatcagacgcaaccccttttgtacacaccttaggcagtacagccaagtagacgatgtccctcttcactacgtgccgcccaccaaccacacggcgttaacattccaagcatcactaacacatatcgtcaccaccacgtctctgcacacctcagcttcatactcaccaccacccacgaccccccaccaccccacctgccgcggctgtcacaccccgacaccagtccgacatgtgctaccacaagcacaccacgaattccatccccgccaccaaccacctacaacacacggcgcaaatcatcacaccacagtctgacacacgctagcatgtgctagacaagacatcccgccagcgacctacgacgccatccgcgactacactgcacaccaccgacgcactccgacaccacgaccacgcagaaccaccagcactgacgccacacgcacacacgcgcgcgcgcacgct

SEQ ID NO: 519294 - DNA, 249 bp, Homo sapiens
aatcgagccggtacccctccactgaagcttaaacccccgagttccatgagggctggaatcaacttcctccaaactcctgttaatgttgataattttacttcctctcatgaatcacaaatttcttaatggcatctacaatggtggatcctttccagaaggttttcaatggactttgcccagactcattggagaaatcactgtctatgtatggcagctatacagctttataaaaacctattttttaaatag

SEQ ID NO: 519295 - DNA, 312 bp, Homo sapiens
ggcacgagatgagaattaccgaaacacctgcctcaaagagattgggagatgacacaaacaaatggaaaaacatccccatgctcctgtgtagaaacagtcaatatcattaaaatgaccatactgcccaaagcagtttacaggttcaatgttattcctatcaaaccaccaatgacattcttcacagaactagataaaactattttaaaattcatacagaaccaaaaaagagcccaaattaccaaggcaatcctaagcaaaaagaacaaagctgaaggcatcacgttaccccacttcaaactatattacagggct

SEQ ID NO: 519296 - DNA, 340 bp, Homo sapiens
atatttagttcatagtgaaatataacacatatgaatcatacatatacaacacacaagaccatgcccggttgggtcacgccttgtaatcccagcactttgggaggcaaaggcgggcagattgcccaatgtcaggagttcgagaccagcctggtcaacatggtgaaccgctgtctctactaaaaatacaaaaattagctgggtgtggtggtgcgcacctgtaatcccagcttctcgggaagctgaggcaggagaatcacttgagcctgggaggcggaggttgcagtaggacaagatcgcgccactgcactccagcttgggtaacagagcgagactctgtctc

SEQ ID NO: 519297 - DNA, 489 bp, Homo sapiens
  misc_feature (94)..(94): n is a, c, g, or t
gctggagtgcagtggtatgatctcagctcactgcaagctccacctccggggttcacgccattctcctgcctcagcctcctgagtagctgggacnacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcactaacaaaaacaattcactaaaaataaatatgtcattgtgctttaaaaaaataacctcttgtagttataaaataaaacgtttgacttct

SEQ ID NO: 519298 - DNA, 339 bp, Homo sapiens
ccggcgctcaacgccgcattgctatcaatcattgcactgcctatatttcccgcctgggccatctacgccaccatccgcggaaagggctgcgcaacgtaccttgactgaatatcacatttctacgactcccaaccttaaagcggacaaggtttgtgcaaggagatcgtatgtcgcaatcattctcgtccgctaacggccgtatcaaccttgagcagcaacgcaagcgcgccaaggagcttttgctgcgcctgaaatgcgccgatgccgctgatacgcccaccttgtccgaggctcaatggctgatcgccaaggaactcgggttccccagctggcccaagc

SEQ ID NO: 519299 - DNA, 157 bp, Homo sapiens
cacatgaagccagtatacggatcgtgggtagctaggctggacttcccgtttaggagaagaaggttttgcggaatctcagactgtggtaaggcagacaaacgaaacgcaatcgacttcgttaatacatggttcgatacgctatcgtaatggatataca

SEQ ID NO: 519300 - DNA, 1231 bp, Homo sapiens
aggctatcttcgtcccgtcatgtacagactagagacgtcagtaacacaataaacgcatatctcagcagggtcctgtgttgtcgtgctcacattgcctctctggagatgatcacgcaggccgctcgcgttcatcaatgtctcgaatccgtctgagcgaacgcgtgataagagagggtgcgcgcgacagtatgcagcagccatagctctgacagtgaagatgaatgctcattattacaatcggattcatgatcatcactacgtgaccattgacgtcgtggagtgatacctaatgaacttgcaagactcacagaaagtgggagcaccttgagtggtgtcatgtcaatgcgcggctgcggcaaacatcggaattgagtacgcattgccgcgaaaaaggcacgacaatattgccagcatggcagtttcattcaggtaacactgggatggctagtcggaatgtcaaagtgaggcccgccatacaagggtcttccgaccaacggtgtagtttcggcggaggcctagtgctatgttctgggcccatatactagaaccacctcgattatctacaatattcgcgaaaccccttgtcttggtgcaccatggattacttagagagaaaaagggcatctcggaagtcatataaccaattcgtctgcgcacgtgcaatgtcgttcatgcaaagaccgccatgtactccattgtggccttttttgggagtggggtcacctccccacgagagtcctagggagaagtacccaagactaaggacagtgggaagaactgaatgtttgcttaaccaacagagactggtgggggtttatttctgaggttaaaacaattaccatattaacatggaaaagttcggaaatataggctattatggaaacagagaaataaaaagagacatattaagaaattattggatgacgagaaactcatcctttgggtgaccacacatacaccggtggccagttcgagtacattggccaattggcaccgggaagtttctgcaatatacacttggaaggacatcctacgtacgtttgagtcggggaaaaaaacgtcgtgcacaacaaagaagtgggcacaacataaaacctctaccatgtattgtggcccctgtttcaccaaacagtagtgtgcgttaacgttcccacaacaagagtaggaataaattagaacaaagacaagcacgcaggaggcagccccacatggcgtagatcagcaacacagt

SEQ ID NO: 519301 - DNA, 111 bp, Homo sapiens
tagaggatcgctcggagtatccaaccgtcactccagctaggagggagcaaaggagagggactctttggcgggcccaatttcaactggtgagacagacgggaagaacagcta

SEQ ID NO: 519302 - DNA, 103 bp, Homo sapiens
aactacaataatacgtcctgctttacttgacgtgcggctgcgactgccagaccaataccacctaaaccaaagaccgcaacactatcaccttcttgtactttag

SEQ ID NO: 519303 - DNA, 792 bp, Homo sapiens
ggcagggcactgcactggccccgtgtgcccaccgcaccctactcttttagagcactgacacgggtcccgggacctcgtgcagtcatggaatggagcgccagctggtgtctgtccctccgcctggggcccagcacagtgcctgggactccagaggtgcctctggctgtgggtccagcgagtagactgagccctgctcccctatattctactacccgcagagaagctgaagaaaaccaagatcatcttagtaggtgggtgggccctggctcacgggaagtggcacccagtgtgagaagatcgtgcacgaagtatgcgctacaccacaacctctccaccgtgggacctccctgcgcgtcccgacgggtcacggctcagggctaccggccaaggggcgccaaacgacaggcctgggcccgcgcaacaactccactagcgaccggcacacggggcgcccagcccacgcggcttaccccaacctcggcccacgaacccacgcctggcacaggcggcacccccttcggcccatcacccagcacgcggcaacatgccccacaacagggccagaagcacgacccccacaaccacgcgacgccagacccagcaaccacactaaccaacgacccaagagcacaccgcagcgggccccgcaacaccccccccatcggaacgagacctgcgaccgatccgacgagccccataacaccgcgcccatgggaccaggcacgaggaaagcgcagcagacttaccgcccccagcggagccgcacaacacaggtgggaaacgacgccacag

SEQ ID NO: 519304 - DNA, 215 bp, Homo sapiens
gtcgacctgtggtttgctggccaagcaggctggctgagtgagagaactccagggtccgtatgagatgctttctcaaaaactgaggagctggggtgacaagatgactcatcagctaaaaaggtatttactgtgcaaacctgacaacctgcaccagaaccactcatctccccatgaccactttgtctgttgagcagtcgacgcggccgggaatttag

SEQ ID NO: 519305 - DNA, 440 bp, Homo sapiens
tgccgtcccgcttctcgcgcctacgagccacgcagtgagtttgaacgatgataccatcctggtatacctctggaactcaggcctggactcgagtgacatgagttacctgcgtgcttacgtatcgaacggctgctgtagaccgacaagcgggtctgaatggctccacgacactcaatgggtccatcacacaattcaccaatctctgtacgaccccaataatgcaagctgcggccccaggatgggtccccgggagacaccagacaggctcagtgcgcagtgatggctaataccctatcagcaagaaggagaagctagtggagtgcccgggtagaaagctgtggtgtcctagaccagctggggtccagcatatgccccttttcaccgtgactccttccattctcctatagtcatcttgaagttttgcccggattttgcattgt

SEQ ID NO: 519306 - DNA, 1516 bp, Homo sapiens
ggagagaactagtctcgaggttttctatttttttttttgaaaaaaacgctgtatttgatttccaatgaacaaaatttacaaaaaggggtgggggtggctcttggaacgtgctctcccagttcccccgcggaacgtgggtgtggggcttcatagggacagccgtgctcgtgacagaaccaggaaccccaggagtgtcgtggcgccccgaacgatagagacttgaccatacgtgtctcactgtgaaccttgtgaagcggtgggggccccagacgagccggtgagagtctccacgcacagaaggtgccggccaccctgtggggaaggccgggagagaggtcaggaaagggcattcgataccgcttatttactctccttccttccacatatcttgcggtggtgtggaaaagaacaagaacatatagagatctctgtggagaaaccatgtgccacgtgtgtggtgccaaaaggggccccctcaaaatatccccacagggggcccacaaacactatagggggacatgtgagaggggcgagcgcgtgtgcgagtgagagcgcgcggatggcgcgagagacgcgcgagagagagggccgacagcgtgtagccccaccacaaagcccgtgtgagcaaaagcagaggagtacaaggggccgacatatccttcccacagaagttacaatcactgcgacaaagagcacactgcgccaagaggagggctggaaacaacacaccgcgccgaaaagttgagcagtggggggtactacagggccggacggacccccgtgacagaggggcacgcacctgagggggcaccgtgcgcagggccacactggggctggacccagggaagatgaccacggagagagaccccacacgaggaacggggacaaacaacgtcggagctccaaagagacgagaacacaagaaagcggacccaaacacagcgagtccaagaaagaacccgacatgcagcgacggagaagtactcaccaggaggaggaaggacaacacgaccacaccaccagacggaggcagcgtatgagagacaggaagcacagggcatcacccaccaagaggaagagaaaaagagagagagtaaccgagcgagaggcagcacgaacaacggacaccacaaacacagacaccaagacagccacaggagagcaccacctcaacccgcccacccgcacagagaagggagagggagaacaacaccccagcagcagggagtagacaccaaccaccaacaaggacaacaagacagagacacatagacacacacacacagaggtgagagaagcagaactaacgtgtaaaagacaagactgacaaacagagaacaaaacaagcagatcagaccgaagcaaacccaacagatacccacacgaccagccagccagaaggggagacaaacaagccacagataagcaccaacagcccggaaccacaacgagcgaagagacgagaagcaacgccaaccgaagcacagcagcgtacaacaagagacacagcacacaa

SEQ ID NO: 519307 - DNA, 417 bp, Homo sapiens
  misc_feature (215)..(215): n is a, c, g, or t
  misc_feature (277)..(277): n is a, c, g, or t
  misc_feature (343)..(343): n is a, c, g, or t
  misc_feature (378)..(378): n is a, c, g, or t
  misc_feature (381)..(381): n is a, c, g, or t
  misc_feature (410)..(410): n is a, c, g, or t
  misc_feature (413)..(413): n is a, c, g, or t
  misc_feature (415)..(415): n is a, c, g, or t
caatcaataagcagggtgtccttattattcttttttaagttctcccaaaatcggagaatccaccttttcccaggtgggaagttggtgatgccggcccttcctactccccaagtcagtgttgctggtctttgccctgctcaggtcctgctggttctgccctccagggtgggcaggggtctgccccctcccaaccgaccttggcccacttccagganttcccaggggattccctgccttgacgctgtgccctcagacaacacccagccgcgcaacacgnacagccctagcatcctacagaaatatggggcaggccaggccactttatggactccaccgtggcccntcagccttgagagtcaaagcagggcccaacacatnctnccagcctccaacctccgtgtacctggacnccntncc

SEQ ID NO: 519308 - DNA, 1758 bp, Homo sapiens
  misc_feature (313)..(313): n is a, c, g, or t
  misc_feature (352)..(352): n is a, c, g, or t
  misc_feature (409)..(409): n is a, c, g, or t
  misc_feature (419)..(420): n is a, c, g, or t
  misc_feature (434)..(434): n is a, c, g, or t
  misc_feature (441)..(441): n is a, c, g, or t
  misc_feature (444)..(444): n is a, c, g, or t
  misc_feature (491)..(491): n is a, c, g, or t
  misc_feature (507)..(507): n is a, c, g, or t
  misc_feature (515)..(515): n is a, c, g, or t
  misc_feature (546)..(546): n is a, c, g, or t
  misc_feature (603)..(603): n is a, c, g, or t
  misc_feature (609)..(609): n is a, c, g, or t
  misc_feature (635)..(635): n is a, c, g, or t
  misc_feature (646)..(646): n is a, c, g, or t
  misc_feature (684)..(684): n is a, c, g, or t
  misc_feature (688)..(689): n is a, c, g, or t
  misc_feature (726)..(726): n is a, c, g, or t
  misc_feature (732)..(732): n is a, c, g, or t
  misc_feature (740)..(740): n is a, c, g, or t
  misc_feature (748)..(748): n is a, c, g, or t
  misc_feature (759)..(759): n is a, c, g, or t
  misc_feature (790)..(790): n is a, c, g, or t
taccaacttaatgtttgcactctgaggtgcaacttaacagggagggcctgagaaaagaatgggagggggctattaattatttttagcaaaatgttgccttgtcttgtgcaaacatgtagaatatgctctttaatttagtaaaatatttttttaaaaggtagagatgcttgttattgtaatcataaacttcctgaaattcttgtaatttttttcccatacttatcagaagtgtgtttacctctcccacattcataccaatatacgtcaggttgcttaaccattgattttttttttttttttaccaagtcttacngggattattttacgtgttccaggtatctcacttggggcngtattaaaaaaacctccatttggaaaatctacgtggtacagaagccatgtctttaangtcttcagannaaaaaagccttacnttaattnaangttggactctgaggtgcaacttaacagggagggcctgagaaaagaangggagggggctattanttattttnagcaaaatgtggccttggtctggtgcaaacntgtagaatatgctcttttaatttagtaaaatatttttttaaaaggtagagatgcttngttatngtaatcataaacttcctgaaattctngtaattttttncccatacttatcagaagtgtgtttaccaacttattttngttnngaaagtgtgattttttttttccttcccaacctctctngcaaanaaagaaangggtttcngctaatgaatngagcagacatctaatattttatatgcctttngagctgtgtaccttaactattgggatacttgcacaattggtttcattatgtaatcgataaaatggtgatgtgtattacctgttagttcaaccatatatttatactgtctggggatgtgtggttactacttctgtggcgagcacaataatttcggtcagtgttcaccagcttgtaaaaacttagtgcgagagctgaaacatctaacataaatacatgacactgcattatatcatcattgagatgggttggcttaaaccttaacttatttggtcgaagacaaacactgaattgcaccttcacttaatgtgtgtcctacatcttttaacaaatcaacatgaaggcttataaactgatgtcagcattcttagctaacctttaagccaaaactggtaaggggtcattccatgaaacactttatactacataggcacttaccattatatacctacacacacaggggtctaagaataagtatgaaaccacaattaactaaatcggcgaccggaagccacaaccataccgcaacacgccacaacagcacaagcattgatgctcggaaacagctcacaccccacacatcacgcgatagagcaaccttgcaagcacaccaaatcacgcctgagaacagcaaaatccacagaccgtaaacacatagcaagcgcactcagcatcctacagcatcgggacaagaaaggaacagaacacgaatccctcaaggagaccaacgaaaaatactagtagaggagacataaaacaaaggctaggtacaagtttagagagacataataatttgagagatgacgtagtataaagtacacccgtggttaagtagagtgtacgctactacagcccagaaatacactaaaccaggcccaacgaactgtcggcataacgctacagtcaacacatacagcggctcaccactgccgacacaatacactacgcacgccagcatattcattcgctgt

SEQ ID NO: 519309 - DNA, 616 bp, Homo sapiens
cacgctacagcggcagctaagtagaactgaaagccccggatgatgacacatcccagcgaagatcctttcttataagcgtgaccaatcgagctgtgcaagtgcttggtaaccatcagaggtgtcaccaccaaacaaccttttgagaacgtctatgatgaacttgcaagctaagattgatgccagagaaggatacagcgtagcagatgcccgggagacgacctgaaaagtgctaaggctgatgccaaggtcatgaaggatgcaaagacgacgaaggtagtagagtcaagagaacgaaaggctgttcagagactggtgtggaacagttgatgaagctggaagttcaatgccacagaccgagaggaacaaataagacagatttgccctgtggaaaccttccaaaactcaagttatctggaccctaggatcacggtggcttggtgcaaggaacgctggggtgtcccaattgagaagatttacaataaaagccagcggggagaagtttgcctgggccattgacagtggctgatgaagactatgagtttaagccagtctcacgaggcagagttctgtgaggaggcacagtgcggttgggaaagattggtaaactgagctcact

SEQ ID NO: 519310 - DNA, 139 bp, Homo sapiens
ggagacagtcctgctagaagaattgacgcctcggccatcgctgacagtgatgatctcgtgccttgtgctcctgctgtagtggcctgcagtagccctgcagtaatagtggcttcatccagccttgtggtcccacctctgt

SEQ ID NO: 519311 - DNA, 124 bp, Homo sapiens
tgtcacaaccctcagaggccagtatttgctgtcccttttttgtgctcatgagtcctcatcattcagctcccacgtataagtgggaacacgtggcattttctgttcctgcattatttttagcaaa

SEQ ID NO: 519312 - DNA, 820 bp, Homo sapiens
tgggaggatcgcttgaggcctgaggtgtgaggctgcagtgaaccatgttcaacaccactgtactctagcttgagcaacagagcaagaccctgtctcaaaagtaaataaataataaagtaaatataaatccatgatgccgttactcaggggtagacagactttctgtaaaaggccagataataaatctgctaggcttgcaaaccatgtagggccttgttgcatacttttgtttttttctccaactcttaaaaaataaaaaactattcttagctcataggccgtataaaagcaggccagatgtgcagtaatttgctgaccccaggatgttacccaatacataagccaacagattgtccttcaaaactgatgagcttctcagtgaagcactgagactatttcagctgccaaagtcccagcccatcgtttcttacgtgtcttgtgtatcgagttcttgtaaagcatttcaccaaggccaggtttttaaatacctataaacctcacacacctgagatgcttagtcttgtggatagaaagagtttcattaatgcaaatcgttattaacttgtaacttcttgtgcataaggctgaatgctttggacatctttcctttgtatggctgagctgccttctgtggctgcttccactttcaatacaattataccttctggcacagagggaggtttccaatgccaagaagccctgggttaggcacctccaattccaaaacgggtttaaattacactatgacacattcccaagtgggactcagcaacgattggttgggcaggggtcaggtgtcggtggcagcccaatggattca

SEQ ID NO: 519313 - DNA, 618 bp, Homo sapiens
ctaccagctggaggcagagctcccagagaaatattcccagaatatctatattcaaaaccggaatatccagactgacaacaacaaaagtattggatgtttgggcagtcgaagcaggaaagtaaaagagcaataccaggacgtgccgatgccggaggaaaagagcaacccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagtggtccagaaggacaagtggcctgcaggaacccgaaagatgctgcatgttggtgacccaagtgtgcacaaagacagccatctcgctgctgaggaatctgtcccggaatctttctctgccagaactgacaattggccacaagaaactctccctggattccggtttcccattcattccctgacagagtcccgagtactgaccttctcattgaaactacagcctctgcctgtcacaccattgcacaacataatccacaacagttaccagaatgcacgcgacttctaaacacggggc

SEQ ID NO: 519314 - DNA, 126 bp, Homo sapiens
gctctaattcgtttgacttgcgggggacgagtatgcaagcacagagcaactgtgagtagccctcagtcccaggacactaggattggcaggacaacgcactgagcagcgctcccagcagggtgtctt

SEQ ID NO: 519315 - DNA, 519 bp, Homo sapiens
gcccctcctcccccccctcgtcgggcgcgcgcccgcgcgcggggggagtctcccccctctctctctccccagcagcacaagaggaggacacagagggaaaggagggccccccgcggccgggttgcgcccccccccctcccttcggggggtgcttgcctccgcccacccccgccccgcgcgataattcttccaccaccctctgtgggagggctttaggggcgcgggagagaggtttatcctctcgcggggtgcccgcggagtgttgagggcgcccgccctctgcccccacctcggtgggaaacccgcgtgttcttctcctttgtatgacccccgccagttattgccccgcgcgccctcgtgtggggcatgctcagctgcaccgctgtgagacgagtcgcgcgcgcgctctgtctctctcgcgagagggccgaggagtcgagtgggcgcctctcctcccctcgggcgggccacgcgcgcccaccgagatttcttgctcgccacacacacaatagatacaca

SEQ ID NO: 519316 - DNA, 686 bp, Homo sapiens
gattctcattcgtagaccactaatataatggaaatctttgagcaggcgattgttgtcctgcagaccaataaccgtgataatacctacaagcgagtgtccagaggatctgagaagcagaattgcagagtcactgaagcgcaacagtcgatagaaaaagctacagctatatccagcttctgcagagaaaatgttagagcatcagttggttgagtatgaaacgcactgggaggctggacgattgagtattgaagcatctcgactcattgctcagaggagtcactgcgagtgtgcttgtagcgtcgtgaaagtagagtactgaacggacgtagtgtaagatcgaagcaagaagacagaggcttgtaactaggtctattgtccaaatgagcttgacttacccatctaggagatagtgcaactacgttaccactgtataaacaatgtaaaccaagttccaggactatgagttcctcggaccagttttaatcgagccagcattcagaccggtaccccacaggagtggaacggcattaactaggacagtgccgcatgatgacgaatggagtttagagagtgccgagcaccgagatagaactgtgtcacttgctaaaggcagataaagagctcaggactggtatagagaaggtcacctctggtagacagaatcaccgacgcgtcgttcatgctct

SEQ ID NO: 519317 - DNA, 498 bp, Homo sapiens
aacgacagtgagatagacttacaaggtagcccaaatacctaaataacagcattacattaggataaaaaagtgcaggaaaacaatgacatcccaaagcaaatctccaagtacgcacaaacggaatgatccagacattaccatagagtcctatataatcacattcagcttataaaaataatgccaagatgcagtgaaaagttaccggatgttccatccactgggtgatgtaggatgggagagtttcttccagtaccggtcatgtgacaattgtggcacttatcctactgactggagtccagtagggcttattccagaaaaaaggtcaaaccaggaaaggtctcacttcctgaagagaatcacacttaggacatggcaagagtctgcattaccttctagatacatgaactttccagagctcaacaagtggtcctcactcttctgcttggcaagtctctctcccagcgtctccaaggcatccagcagggtgtggacagaggc

SEQ ID NO: 519318 - DNA, 137 bp, Homo sapiens
  misc_feature (95)..(95): n is a, c, g, or t
tgtcaatcgcacactagtctcagtgtgacacacggttggtagcttctcggcatcgtcctaaggtcatgactcagaagtggggagatcgcactcgncagctcaccatctccatacgagctcgcatgtacccggcgctg

SEQ ID NO: 519319 - DNA, 178 bp, Homo sapiens
tgggttcgacagtgagggtatactgccttgtggggggcttgtcgatcttgggctgttccttgtccgttcagtgttttcatctgccgcaggcttatgcggcggcgactgttttcatgttacttatactaacattagttcttctatagggtgatagattggtccaattgggtgtgaggag

SEQ ID NO: 519320 - DNA, 411 bp, Homo sapiens
  misc_feature (390)..(390): n is a, c, g, or t
  misc_feature (393)..(393): n is a, c, g, or t
  misc_feature (395)..(395): n is a, c, g, or t
tactagtgatctggacaatcataactttaaaaataacactttctttatccctcttctcagttttttccctattgagaccatatttgacagtccctaaatgcccctaatataaatgacccatatttttttccccacccaaaatgtcctagtcttagttaagaactgctcagagtaaaatccctggggaagcccaggtgaagtaactcacgcctgtaatcccagcactgtgggaggctgagacaggcagatcgcttgaggccaagagctcgagaccagcctggccaacacagcaaaaccctgtctctactaaaaaatacaaggattagccaggtgtggtgcacatgcctgtaatcgcttgaacccgggaggcagaggttgtggtgaaccgangancnccatggcactccagcc

SEQ ID NO: 519321 - DNA, 456 bp, Homo sapiens
  misc_feature (2)..(2): n is a, c, g, or t
  misc_feature (22)..(22): n is a, c, g, or t
  misc_feature (36)..(36): n is a, c, g, or t
  misc_feature (53)..(53): n is a, c, g, or t
  misc_feature (183)..(183): n is a, c, g, or t
  misc_feature (288)..(288): n is a, c, g, or t
  misc_feature (298)..(298): n is a, c, g, or t
  misc_feature (311)..(311): n is a, c, g, or t
  misc_feature (340)..(340): n is a, c, g, or t
  misc_feature (357)..(357): n is a, c, g, or t
  misc_feature (399)..(399): n is a, c, g, or t
  misc_feature (427)..(427): n is a, c, g, or t
  misc_feature (434)..(434): n is a, c, g, or t
  misc_feature (450)..(450): n is a, c, g, or t
gncctgaaaccacagctcccanagggcaagagaacntaaccccttccccgagntgaaatcattcccagaaagaggggcaaaaccccatgaaagctgtgggaactgccctgggccatcggcttcccttgtggtatcctcctcttcatcctcaccaagcgggaagtggacaaggaccgtgtgaancagatgaaggctcggcagaacatgcggttgtccaacacgggcgagtatgagagcccagaggttcagggcttcctcccagagtgccccgtcccctgatgttgggtnctggggtgtnctggggtgcagancctgaggagcgtctgcgaccctcctaggnctattgactgttaagtncctcaggtttggtcccgaattccgattcgtgcctctgaggtnccaccagagggcgcatgaagacccaggnctgttgnccaaaccctaccctgnccccac

SEQ ID NO: 519322 - DNA, 161 bp, Homo sapiens
caacgtacacatcatgagacatagtatgatcttacctgatagttatctcacggtgacgctagtcatctttattatgccttaaaaaatactgtactggctggatattttgtatctgtttctcctcctttacgcccattttcctgctgtcgctaggaaaatgg

SEQ ID NO: 519323 - DNA, 300 bp, Homo sapiens
  misc_feature (44)..(44): n is a, c, g, or t
  misc_feature (51)..(51): n is a, c, g, or t
  misc_feature (136)..(136): n is a, c, g, or t
  misc_feature (141)..(141): n is a, c, g, or t
  misc_feature (231)..(231): n is a, c, g, or t
  misc_feature (274)..(274): n is a, c, g, or t
  misc_feature (292)..(292): n is a, c, g, or t
ccaactgatctgacagctttcccatcagtagaagtgggaacatnccttctnaggtatttactattaactacatgtaggcagtgtatagcttctgatcagcgtagtagacattacaaacactggttgtaatggggtnttctntagactttacttgagaggtgagtataaagcatttgttagtcatcatcatgacgatgctgctcaagtgcagatccagaacagtacagcgtngggttcctagagcatttgggtaaactgttgtgggtttcttctntcttgttgccaaaactgnttttccac

SEQ ID NO: 519324 - DNA, 410 bp, Homo sapiens
gacctcaaggtcaaccagaagagagagagcagagccctctcaggtcttttctgggcatggatatggcactgtgcatggtcccggccttctagattgccaggaataattcagagctttacaagacctgttttggacacctcattccccacttttcttttgaagatttttgattagcccattgtttgttcagtttttcttcactacctcaggcagcagaaatgtcaaacaattgcctttaagtattttcttcagataccctgaggaaaaaggcattttgcaaggggtgaagtctgagtcaggtcaaatgaagacagttctctaggaatggcgttttgtcagaactccagccttattctgccccctccagcagcatccagactcctggtgattgtggctgttggtttcaaggt

SEQ ID NO: 519325 - DNA, 209 bp, Homo sapiens
tgttttcccttttttaattccggccggggatttgtgttttttaaaaagcaaaattttgcttttttttgttgtataattttaaaggatatttttgtgtgcccaattccaagtgccttaaaacattgtttagctttcctaagtatatttaaatgcatttttgtttaaaattgggaaaagttccctcaataaaatctttgggaattccccca

SEQ ID NO: 519326 - DNA, 618 bp, Homo sapiens
ggccgggcgcggtggctcacgcctgtaatcccagctctcagggaggctaagaggcgggaggatagcttgagcccaggagttcgagacctgcctgggcaatatagcgagaccccgcttctccagaaaaaggaaaaaaaaaacaacaaaagacaaaaaaaaaattaggggtaatttcccttcaaagaaattacccaacccccaatttttaaaaaaaaaaaaaaaaaacaaaaacaaaaacactttgtgttgggggcctcgtggccctggaaaagggttttcaaacaagacccattcgtgtgttggagcgcggccgggggcgccccattgataggggtaaagcgatcaaccaccttggtgcgccaaaaagcggtggtgtcccaaaagaggagaagaccctcggggccactgacacacacagtgggtcggggcgatttccccctccccatatataaaaaagaaacgcgccgcggggggacaaccagacagccgcgcttctgggaaacaaacttccccaagatgaggcagttcccgagaggacgaaccgacgggggaatcaataacaccggggggtgtccaaagagacgctccgcgataccaaaatttaccccgggcgggtgt

SEQ ID NO: 519327 - DNA, 622 bp, Homo sapiens
  misc_feature (1)..(1): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (79)..(79): n is a, c, g, or t
  misc_feature (108)..(109): n is a, c, g, or t
  misc_feature (113)..(113): n is a, c, g, or t
nttttctttttttctagcgaagcgccgcctttgtgtttggtacccgggatatcggccattatgggcnggngngcgttcnttcctttttcgatgcggcttgtgcgggtnnagcncgcccacaaaatgcagattttcgtggagacaacccttaccggggaagaaaccattacccctttggggggttgaacacccttggggatcccaataaaaaaaatgataaggcgcacaaccccccgtttaagggggggggtttttttttttttttaaaaaaaaatttttatttttttgtgaaaaaaacttaaaaaaaaagggcccttttttttgggccccaaacattaaaaagggggggttttctttttttttttgggaaaaaaaacggggggggggggcaaaaaaaaagaagaaattttttccctcccccccccaaaaaaaagacccccccaaaaaaaaaagaggggcccgcccccccccccccacaaaaaatataggggggggggaaaaaaaaaaaaaaaattttttcccccttaagagggcccctcctataaaagaaagtgggggggtgttttttttaaaaactctttctaaaaaaaaaatttttggggggagattgtttttttttttt

SEQ ID NO: 519328 - DNA, 309 bp, Homo sapiens
ggttcatgaggaaaacaaatttttttggaatttggaatggggtaaatgaaattcaaaatgaagtggcatcaagaattcagtgggggccgggcgtagtagctcacgccggtcatcctagcactttggagaggccaaggcgggtggatcacctgaggtcaggagttccagaccagcctggccaacgtggtgaaaccccgtctctcctagaaatacaaaaattagccaggcgtggtgacgtgcgcctgtaatcccagctactcaggtggctgaggcaggagaatcgcttgaacctgggaggcggaggtttca

SEQ ID NO: 519329 - DNA, 1112 bp, Homo sapiens
  misc_feature (234)..(234): n is a, c, g, or t
  misc_feature (537)..(537): n is a, c, g, or t
  misc_feature (542)..(542): n is a, c, g, or t
gccgggtctgagaggagcagtggctgtctcctctctccgtcgctatggcgtagtgctcgacccactgactatcggtgttactccgagagaagggggagtacatctggcaaaaatgtctactttgcctgcatgttattcaaggccatccctattcgagccagatattgtgaaactttgcttcgactacgcaacttgcgcgaagaaaaccaacagacgagcccgtattgctggtcnaggtggacatttagcgaggctccatcgagtactagatgactgatgctcttgggtggttactggtcagacgtctgctgtgtctcgagacttgcccgaagcatggttctgatgggctgcgtgtgtgcacctcatccagctgctggtccatgcgcgtgcttattggagataccactgtgttcgtggtacgcgaccgatattgctttgcgatcgcaaaacacataatactctgggcagcccgtttcggcaattcagataaagcaagtggagatctagcatatggctctacaagataactgattaacnggccnactactggttgcattggcaccttgggcttgcctcttcaagggcgcacttatccgcaagactacgtaggctcagttgtctaacaatggctcactccggttattggacggcaaagttacccttcgaaaactttcgctttttgcgatacgttggcaatgcatacacaggcttcgacagcggtactagagtaaatgatcctagatgcgtacatggctagtcttgtggctcctcttttacaggacaagcgtttagacacggcccttggcacaattgcattaatcacgactataacgggttcttattgacccttccatcgagcccgaatagtgaaggaagtccttaggggccataaaaggggcaccacctcatcgaaggataaaccggttctggcccaggttaattccgcaggctggccaaggggagcccccagttggcatttccatccttatacaattgacgggaatacactcgggtaaattcactccaaaaaggccctttccaggaaaaccattcccccttgggaaaatttacctccctggcttttaacttgttaaaggcaagggctagaaaca

SEQ ID NO: 519330 - DNA, 309 bp, Homo sapiens
atctataggtgtagtttgtgcaagtatctatgcaggcttagatcatggacacttggtcagtggttggtactgtggacgcacctgggaagggggtatcacagttaatttctcaaatggcagaatttctgggttactgccatctgtttcaaagtacagatagagactaaactgtcacagccaatttcaatccatgacagaacataaattcctagtgcttaaaacagaattttctcatatttttgagcaggacttctgtttaaccagtggggtttatggctcattcttaatatgtagaaatagtttatgctg

SEQ ID NO: 519331 - DNA, 1250 bp, Homo sapiens
gatttgtgccctggttcgccgagatgtcgttccctaaagtataagccgtcgagccttgcgcactctgcctgtagaccactcgaagctcagccgaatacgatatatctcgcggataacccaggtgggcgcaagtccgagcggttggaccataagagcccagggtgaaacgatgagtagctgtcttcaggtacaaacgaattcccaagccgaccgaagggactcagtcgaatcagtccatggccgtggcgtgtcgctctggggcctattgcacaggatacaaattaccatgtcgtatccgtcacatttctcagtacccacttccttaaataaactgcactcatgggggatgcatcatggtcgtgagaaattgtgtgggccccatcgattctttacaatgtatatgtagtagtgtactccataaacattaatgcaggaggatacgtgacctaggcaaaaaagcatttagttcccagggcaaggcaaaaatttggaatcctgaacaaattattcaatctgctcagtaattaggggatcgtggggcagaataggcattggaaccttaggttattggttagtatcaccgtggcgcccaagactggtcagaggagtgcgactcgtaaatgtaagaggcgaatgagagaaacagacaaagatggaccaagatcgaaaagaaaagataaaaaatgcacatgtggtgtcgtggggcgacgcaacaggggtagatccacatgggcgagaggaacaatgatatattggaagagactaaataagtagcaaaggaagggtgggccgccaaatagggaccaacacacgtcaaagaggtgcgacacgaagcagtgacaaacactggtcaacgaaaataatcggggggaaagatgacacacaaagaagaaataccagcaggggagaaatcagagcaaacaagtaacaagcaggtgtgagaaaatcagcaacgaaccacaaaaataaaaaagaaaaccagacaaagagaagggaaaacaagacggacgagaaacctatttggaagaagaacaaaaacatcacagagagaagggaagacaaacgggaaagaactaacaaagaaagcggacggaccacgtcacatcagagagggaaggggagacccacaagaggaggagacgccagaacaaacaaagaaaagtaaaagaccagcagaggcgagcggtggtacagacagccgggcgcccagcgagagcgacaggagatgacaagcacaacaccagaaacac

SEQ ID NO: 519332 - DNA, 1364 bp, Homo sapiens
tcgtcgttgggtgcatgagcgtgtctgctgcgtgttgtcattgcgcgcggtgtcgcgctggtgttggtcgtctgtgtagtgctggtgtgctgacggtacgtatgcggacggtgtcgctgcggcgtgacggtgctatgcggacgcggtcggagtcggtgtcggctggaggtgaggctgactcggcctgctgcgctgcttggggtgtggtctggcgggcgtttataatttaaacacccagggagggccttttcgcgttttgttatgaagtggtgtagccgcgccgttcctagaggaatttgctgtcggccccctcggggtgatggtaaagcgcgctgccaacttgtcgccgcacaccggtccgtcgtgtgttttggtggaagaccccctctcccccgcgttatgtgtagggagcgcatctccccgggggggggtcccccgcgagtttgcccacggaccgctttcccggcggaggacttctcttatggggctctttggggggctccgcccggggtgtttcccgctgagttttgatccgactggttttgcacacacacacgggtaacacaccgccttatatgaggcccacctttatgggccctcaaatgtttatagcggtgacacaccgtatttatgggacccacactgtgtttggtgaccacacaagagaggcacacgcgtctcgggtaaacccgcgtttctcgcgaaatttttcccccgcgggagtatatagtcggtgtcgaagactcccacacgccctgttgtccgcggtgtcgcgctgtctgtgtcgccccacaaaacacattctcgtgtgtctctcggctctcacagagacacactgcttggggccacgagaatatgtgtctttggggggaggcctctcacaccaacgtcacaggagagcgcccgttggcaaaagcccgggacacaggcgcggtgcgcacacctcaagagccctaccacagccccctctctgggagagcacaccgccacacctctctctgtgtgtgtgtgagaatgtgaagcgtctttctgtcttccctctcacagccctcgcacaagggtccgcacattttgtccacttcgcagaaaaagagcacacccttctaacttttttttctttgttatattttgagatataaacacactcgaaagcctcggagagctgtttataaatttatacttggggaaaccctccagaacatggtcttatattggtgtcgtggaacctcttacatgctttccaataaccaccgatttagtgaataccaactgttttgtataacattgttttccagattttccatttccgaccaaaccagccctgtaattatagctattagactccaattttttaactatttcca

SEQ ID NO: 519333 - DNA, 889 bp, Homo sapiens
  misc_feature (889)..(889): n is a, c, g, or t
tgatggctagttgtctttttattagctatcacgttcatttaacatgacgaaaatattccagctccaatcgtcacttcactctaaaatcagtgaagtagatcaaccaactagcgtcatgctaatgcattgcttgtcacgctgtatgcctgattttatacacaatgaacttgttcctattagttgcgcacgattcatggacggatgttcttcgacacagaaccgtattgattctgtgtcaatcccatacaagcattgcgcgccaacatattaaaaagagagccccccttacactttggttccggggtaaatgtcatcgccacgctcaagcctttgctggatagcactgtcgagctccttagcctggtttttataacatacaagacattagcgccgtggggtaaagcaacctcagcgcaactgtgtgtgcaaaagttaccttatcattgctacagggcgactttattttacttgtctgttgctgatgttcgcaccgacacactcagtggagtgaagactgtaggatgtgtgtgtgaagaccgcttcagtcctaaatcgctcttcggacgacgcgagaaaagacatgctaacgtgactctccagtcagtccgaacaaacccatgaaacttgggttctttgcaccgctttccaccacaagttctagtactccaactttaaactacagggtgaggagagtccccccgtctcttcttgtagagtacactcatatccttatacttcacatttaagttaggacctctccttcaggatgtcgcccaggtcgtctctgggtttttcttctttattttattgtcaattacatgggataccccggcgcagcaccctgaccaacacctcactccccactctacgcctgaccccggtctcaagn

SEQ ID NO: 519334 - DNA, 740 bp, Homo sapiens
aaccttatagattatgtgtgtccgatgtttcaaagatcacggatctggatttgcataactgggtacaatagaagctggtgatatccaaactggggaccgagtactggaaggcctcctaatgaaatttgtaccgtgaaaggaatcactctgcatgatgaacctgtcgactggccggcgttagtacaatcatgttagtcttacttggttgggatggatatcatcaaaatcaatgttggctgcatatttggtggccccaaagtacccattaaagcttgcactcgttttcagagcccgaatcctcatctttaatattgaaattcctatcactaacaggatttcctgtgctgttacactaccaaactgtcagtgaacccgccgttattaaacgattgattagtgtcttaaacaaaagcacgggtgaagtcacaaagaaaaagcctaagttttgactaaaggccagaaatgcatgtggtagagctacagacacaaagaccaatagcctctttgagctaatataaaagacttcaaaagaagctggggagggtccatgctacgttacgggtggttctacaaatagctgctggtgttgtcactggagataaacagaatgatggggtcagaatttctaccaggtttcttggatacagtggaatagcttaactttgttccaagaatgccgttttacgctcacaggaccacgtgccactgcacaggttctcagcatcagggagaacacttag

SEQ ID NO: 519335 - DNA, 387 bp, Homo sapiens
ccttatatgacctcaaactgaccatactaaacagtgtagaaggtttttttaaggctttaaatgtcagggtttcccatcccctgatgcctgacttgtacagtcagtgtggagtaaacggtttcctccacccagggttgactcagggggatgatttgggtcccattttggttttaaaaccccaaacaagggttttttcagctccaggatttggagcctctatttggttagggttgtaacctttgtgggcctcccgttaccccatttgtccagtgaggtcagcccccatccccctaacagggtggccacagggattattgagggttaagaccttaaaactgggtttagcccccgataaaagctcaaaaaatgttgttcctttccccatca

SEQ ID NO: 519336 - DNA, 1729 bp, Homo sapiens
tgacgatagagagaccgcgcacggcggacgacgctgagggtcagaacaatgatggcagcgagagggaagaagctaggtggagaccgcagtatgtgcgagcgggggcaccctggtggagtgctcgacgtagactggatcgtatgtgcgtcggaagccgcagcaagtccgagcgccgatcggtgagggacgatctcacgagagaaacgtcgaggtgtagataagaagagagactggcaagcgaagctgacacgacggcgagcgtcgtgccgagaggaggcagccgaacgaggaggggagttggcgcacctgaattggtgcatcgatagacgtagaggcggaggagcttaaatcacaatacatagagcgtatgtttctctgtagtgctaccagacgtaaatggtatgagatatgccatcgccatgactctcgatgtcccagagtgaatgagatcctcaatagatctaaaatgttcgatgctatcgctcccatgaatacgtgtgtccgtcgctcgctgagtgatgcccgactattctaacaggcttttgcgtgtactcatgatctgatggtgcgggtttgagcggagaagcacttactgcctgacagaagtttggcgtacatctatatgtgagcactctccattatgcagcgccgttgttagaagcctattggacgaactatatatacggcctgatagcggtgccactaggtcgagacgcctggacgctgatgaggaagaccaacattgggcgcgcccacatagaaccgcgggggagccgtcggttgtggatcgccccgagaggggcgccgcgttaaggagaagggtgccacgtgtaacacgttgacgagggaaacacccccctggagagtgcccaacgggaagacctcggcgatggggggggggcaccacggtctagccgcgacgtagcacaggtgtcctgagacgatgtaggccctgtcgcttctattttcaggggggactcacaagaggcacccacggcgcccacgtggaaagagacacctcggctgagaaggaccacaactcgtaggagcgctagcttaatacaagtcggcgtatcgagagaacacggggagttaacgccatgtttcggcgttcgtgaccccagcctggagaaggggtagactacgcgggcgtccacatatatgagggaaggtacccgcttgtggggcttggtggaagaaggcgtggtccacggagacgtttatatagaggaaacacgcacactgatgggagcgacctgcgcacacgctgtttctcggctatgactctgtcgcagaaattgacatggacacactgcgctgagtgcacggcctcacctcacatatacgacaacaggcgagatgagaccacgagccgcgcacactggcgcgggcctccgtgatttgctcggaccacaggaggatgaggttgcctatggccacacggcgtaactctcacacatgcaccagagactcacccacgaggtcttctccctcttgtccgtgatagccacgaggtcgccacggaacacctgtggagcgtctttgttcacgaaagggatacacggttggggcggcacgccgcccacgtgccctcttctgttcccacgctcacgttttgcccaaagagcacctgaccactgtaattcttgcttctagttgtaaaggtttccctattagtttgcttccgatgattaaatctaagtccatttgtgaaagaaaaaaaagaaaa

SEQ ID NO: 519337 - DNA, 129 bp, Homo sapiens
gcggccgcctactactactactactgctcgaattcaagcttctaacgatgtacggggacatggttgtggttaatctggtttatttttgttccacaagttaaataaatcataaaacttgaaaaaaaaaaa

SEQ ID NO: 519338 - DNA, 129 bp, Homo sapiens
cttgcaaaccacatcgccgtcttgccaaccatccgttgccaaccacatcccgacttgccaaccactcacctcttgccaacaaatcaccgtcttgcaaaccacatcaccgtcttgaccaccacatcaccg

SEQ ID NO: 519339 - DNA, 260 bp, Homo sapiens
  misc_feature (133)..(133): n is a, c, g, or t
  misc_feature (211)..(211): n is a, c, g, or t
tatccctaataggaggtaagcccttaggctacatcatgggggagagaaaatttcccaagaggaaactgaggtgccattatgaaggaggagtggatactagctagctttactctgccctcaaatgtctccctanccaagtatcacatggctgaaattttaccattaggtattcattcctttggttgagatgattcctatttgtgattctctnaaaatatgcaaatcgaactagaagaataaattgttgctatcttaatgtt

SEQ ID NO: 519340 - DNA, 88 bp, Homo sapiens
ccgcctactactactactgctcgaattcaagcttctaacgatgtacggggacatgtaggttgtctaatcatcaaatgcatttaaaccc

SEQ ID NO: 519341 - DNA, 103 bp, Homo sapiens
gcaaacttatgggagacttccagtctgggggtactgggaccccgaatcccagagctggaaacatcttatcactgtcgtagtcctgaatgatctgcacaacgag

SEQ ID NO: 519342 - DNA, 441 bp, Homo sapiens
tttttttagttctttaatgtaataaaaaaaagtatatatgagtcaggggtagggagtgggggtgacaggaaaagagggcaagcaaccaagcctctgtctctcagtttcattaaatgttcagatggagtggcataagccatggtgaattggtaagccttgtagggaggacctgagccgtaggaacatggccaggcactgacagcatcactcgtcggcctgttgaaggagcagaaggtggatttcttggaatgagggacggttcttcgaatctcttctccagcagttgagcatcagcttatacacggattcaggacaaatggctggttgagggaagtaagtctgcctcccttggtctcggaagaactctccagtattctcaataacctgttcatctagcagctggggaaaagggctgttctggacaaaggtgaaagtctccca

SEQ ID NO: 519343 - DNA, 498 bp, Homo sapiens
gggcgtggtggtgcatgcctgtaatcccagccactcgggaggctgaggcaggagaatcgcttgaaactgggaggcggaggttgcagtgagctgagatggcgccactgcaacaagagtgaaactccatctcaaaaaaaaaaaaaaaaaaaaaaaaaaaaattttttggggggttgggcttgaaaaatttttaaaaccaattcctgttgggggcggcgggggcgccccatatgggtgaaagtgtgaacaatggggcacaaagcgtgggtcccccaaaggggaaacaccccggggccaaaggactataggtgggtgggagttctcttcacccaatatttagaaaagacaccgccggggggagacacaccgagggcgttctcttagcaacaaatctcctagaagtgggagtcttcgagaggggcgtcaatctacaggggagtctttcttcacaaggggagagtcccaaaggggagaggcttcagattttaaatttaagcgcg

SEQ ID NO: 519344 - DNA, 807 bp, Homo sapiens
  misc_feature (807)..(807): n is a, c, g, or t
tccggcactaactcaagttctttacttcccagaagtgatggctaaggggagggaggagggtgagaagaggaagactgaaagagccatatagaatgaggaggtgagaagggggggacagtaaaccactgttctatgaagtctcacgaggcaagtgctcaaggtaaaaaaatagtcctggatattcgtccacggctgccggaagcatctcggtttccttatgcttttaagtccttttaaggaatgtctgcgccgtttcccttgtatttaatatttatgtacattccacagattcctatgccctggtctggttggggatgggccccatttttttcatgttccatatttatcatcgcaccttacttgttatcatttccttttatgattttagccctgttcttcgtccttctgcatctttacatttttatacctatttttccttttcctccaatttcatacttttccctcgttacgtctttgctttcgccccctatttcttatacactaatcttatcctgtttctctttcgttctcttttacccccgccttacgatataatgtttgtttttctacacggcggtcgtgccctcgcttgtatgaatgtttgtattaatgttgttaatgatatattttcttatttttctgttttttgtccttctgttgattagttttgcttatgttttcttttttatgattttcttagactatcctgcccggtattatatacatatggctgagggggttttcttctttttatctctctattgcatccgttgctcttaatttactctattttcttatatgcttctn

SEQ ID NO: 519345 - DNA, 163 bp, Homo sapiens
cgcgcggacaggtaatggcgatgcagcaggagaatcgtgccctgcgcggcatcgtgacgcttggcagcccgcattgcggctgccgctggcaccttcggcgctggaacgaacgcccgtcagatgcgttgggccagcccatggctgacgtaacctgtgccgaggt

SEQ ID NO: 519346 - DNA, 146 bp, Homo sapiens
gtaccctcattagctgtgacccgagatattcttgtgacctgcatccaccctcatgatgcgacaatgggcatctggctgccgaacgcgaatacatctgaggcctgaactggctgcctgacgaggccaacaaacccatcatcgatgtg

SEQ ID NO: 519347 - DNA, 827 bp, Homo sapiens
ggcttgaggcagtaccggaggagaaagatggggctaccttactagctgctcggggagccgggcagcaccggctgggggccggaggattcatccagatggaaagccgagaagtttccactggaccactatcatggccgtgcagttggacgggggcgtgtcctgggggcggactcagaacaaaccactggtcctacatcgccaatcgagtgatgacagctgacacctattcaggaccgcatttctgctgtcgctcaggctcagtgctgatacccaggcagtagctgatgctgtcacctaccagctgcggttcccacagcatttgaactgaatgagcctcaatgttccaacacagcagccagcctcttaaaggagatgtgtaccgataccggaagacctgatgggggaatcatcatcgcaggtggaccctcaagaaggagggcaggtgtacctcagtgcctatggggggtatgatgaaaggcagtcctttgccatgtgaggctcggggagctctacatctatgggctatgtgggatgctaccttaacggaagggcatgcccacggaagagtgtctgcaattcatgccaatgctctcgctgtggccatggagcgggatggcccaggcgaggaggagatcggcttggcagccattggagagcagggtaaaccggcaggaattgtggagacagatcccaattcgcgtgcattacaccgctgatctgggatcagttgaaaagaatgccgtcgtgacattaacacgtcccgggacaaacaacaaagcccaacccgtcagcacaacaaactggggcggcccagaaaacaggggcaa

SEQ ID NO: 519348 - DNA, 481 bp, Homo sapiens
tgagtgtgtgtaaaacgtgtagcaaatattagtcaatttaccaactttgtattgttacttgatttctaattttattctccttgtggttggagaacatacttagtatgtcacaatccgtttaaatttattggagacttgtgttactggcttaacatatggtctagccatcgaagaatgttctaaataaaagaatattgtatatgcactcttagaaaaatgtgtattctgttgttaatgggtggaatattctacaaatatctgttatgtctagttggttaatactgttgtttaattttcttgttgctctcctgtctagttgtctattcatcattgaaagtgggtattgaagactccaactattgtttctaaattctctattattttcttcaattctgcccgctgttacttcatatattttgggggctctcctgttagctgtatacctgttcattattgttatgtctggtctatcttttttggc

SEQ ID NO: 519349 - DNA, 204 bp, Homo sapiens
tcacctgaacagttagccactcgggagatactcccaccccggagaggcgactacagattcggatttaaggcccggtcgaccacatcgacgattgaaacaggaaaaatccttgggacatagcagtgagtgggctgaggcatattagagcctgaatgaagatcgcacatgtgggaatatagaacagcagatacgtcagggagatat

SEQ ID NO: 519350 - DNA, 375 bp, Homo sapiens
cttttggggtctttgctcaagatgaagctgaacgtctccttcccagcgagtggctggcagaaactcattgaagagcacgatgaacgcaaacttcgcactttctatgagaagcggatggacacagaagtcgctgctgacgctctgggtgaagaatggtgggcgatgtgatccgaatcagcgatgggtacgactaacaaggtttcctcatgaagcagggtgactgcgacctatgtacgcgaccgcctgctagtgagtaaggcgcattcctgttacagaccaaggagacctgcagaacgaaagagaagatcagttcgtgcttgcattgagctacaaatctgagcgttctcaactcggatattgtaaaaaaggagagaa

SEQ ID NO: 519351 - DNA, 176 bp, Homo sapiens
cttcggtggagcgtcagttgcttttgctccaccggacgtgcctgctcactttcaacaccaggagccatatggtgcatccagtctctcaacagagcttccagtcgtatggtctccatggctgttcttcacggtgtctctaggttctccgtggaagctcccccacttgagaggagcgt

SEQ ID NO: 519352 - DNA, 858 bp, Homo sapiens
ggccgtcgcttgtgctgcatgcatgtgtctagtgattcctgcaaaagtcccagcatatattgcgagtactcaacaccaacatcgatcgcggtcggcggaaaataacctttggcatcactgcccattaagggtgtggggcgaagatatgctcatgtggtgtggaggcacgcagactttgaactcaccaagatggcgggaaaactcactgaggatgatggctaggatactgtagtgatccgagcaactctcatgacaagcaagttcgaacgccacgatagcaaagattcccaagatcctgggttctgtgtacacacgatcgagacaggaattgtgacacacgagatgggagagaagtcacagctcagggtacctaactcgaagtggctcgttggtacggaacctgagtcgtccgtgagagtaactaggactcggaacgttgacatgaccgattcggcccccgttagagggctgccgtcatcttcgtgtggcgcccttcggtggtcctgagggccgcgagccagcatcgcgaaggacccagcgtggctcggcctggtgggcggtaccggtggggtgctggtccggaggaaacgtaaatcaaggtcttgtaaggaccttgcttgtggtcaatctcgaatagatctatagtactacgaagaattcactgactggaaactactggaccctcggaggacaatattctggcggaggcctgggcacccccgcgcttggtaacttgggcattcggaggcggtgtggaattgggagaaaccccctggtagctggcatctgttgggggctatggacccgaggacctgatgcaggggatgacaaagaaaacgaaggcgggactggtgtcac

SEQ ID NO: 519353 - DNA, 266 bp, Homo sapiens
tgcctgcacttctcattttagtatctgtaaccatatcatatgccagtcatgccatatgtttacatattatctatggctgttttttgtgccacacatggtacagctacaaaaattaacagtgtagctggactcagtggctcacacctgtaatcccaacactttggaaggccgaggagggtggatcacttgaatccaggagtttaagaccagtctggccaaccatgcatacatttcacctgtgggcatcctctcagcagtctgcacct

SEQ ID NO: 519354 - DNA, 251 bp, Homo sapiens
  misc_feature (9)..(9): n is a, c, g, or t
  misc_feature (17)..(17): n is a, c, g, or t
  misc_feature (96)..(96): n is a, c, g, or t
  misc_feature (135)..(135): n is a, c, g, or t
  misc_feature (158)..(158): n is a, c, g, or t
  misc_feature (219)..(219): n is a, c, g, or t
aaagctgtncctcaaancatcccagtgaacactggaagaggctttctagaagggaacaaattgtccctctgaggccgccgtgggtgacctgcaganacttcctgcctggaactcatctgtgaactgggacagaancagaggaggctgcctgctgtganacccccttacctcccctagtgccttcttcagaatatctgcactgtcttctgatcctgttantcactgtggttcatcaaataaaactgtttgtg

SEQ ID NO: 519355 - DNA, 868 bp, Homo sapiens
gggagaattcttagatataaattttagtgaaagttctttgggggagaattcttagatataaatttgagtgtttgaagagacagggtcttcctgtgttgcctaggctggtctcaaacttctggcctcaagtgatcctcctgcttctgcctcccagggcgccaggattatagggttgagccactgtgcttggcttagaggtaataaattttaatattctattcagaataagaaaatatagcatataagcatttgtatctttagtaaagttactgccagtttgatttttttttttggcaagttacttagcagaacatgtaattcacagtaacagatgatcctgtgttggtaccatattctttaatattcctgttctcgacaagaatagtagagagaaaactgggtggcctgctcagtgatggctttctcgtagtcttgcgctgaatgttacacggaagattcgacactttactagactacacgcacagtcatcatagtttccaccagtacatttgcacgcacattctagctgtgctagcctaaaaatctgactcatgctgagttccttttaacgcacagtcactttcgagaacttcaaactagaaccagtttgaacctcaagttgaccgtcgtctgaggtcttacacaatctcttcccatttccaacgattctccacagggctgtcggcacaggaccatggacggtaggctattagctgctcacacacccacggccctaaatctccagaaccgactagacacacgcttacaggcccaggcacagccccagtatccaggtgctcaactggggacgtctacttcacagtgcgtcgcttgaaaaccccctcgaactactgtgtacctccatccg

SEQ ID NO: 519356 - DNA, 167 bp, Homo sapiens
agggtgggcaccccggtatagagcatcttggcacagttttacatgtacttataggacaaattcggagctccagggttcaagaagacagctggtcaaattcatctgacacatgtggcataaagcggaaactcatccacttttaacttcttccggcccaggtcaaaaat

SEQ ID NO: 519357 - DNA, 663 bp, Homo sapiens
  misc_feature (59)..(59): n is a, c, g, or t
  misc_feature (159)..(159): n is a, c, g, or t
agcatacacctcatttggcattcatatgactaggttataaaactcattaagcactttcntctctcaggccagaatgtagagcgttcagttcatatacaggtttaacgtgttagccatttaacagtctgattacgcatcatgactgaacttattaattangtgcctactagctgttaggcgccactctagagactgtgcctagggcactcaatagggcacacatgtagagactcatgtatacatgtagcccacattcaatggtcacatggtacactagcatatggtacttatataaatgagcatgtcattccacagcgttagggtatctagattgtacggtcaacagtgacatctcagtaattagggcatgtagctggttatctcacaagcacggaggagccatccatacacagagtgctataagtacacggcagtgtcacagtggggccactaatggatgtaggcattaatgcgttcttgatgtgttgaagattcagaagccgtgtgtagttgcagcatagtggggtagcagatattcagagccagtaggtcttagaaaggcttcagcaagtcagtcataaacaactgggtgtggtggatcacccgtacgatcctagcactttgggaagccaaggtggacgtatagcttaaaactggtagtcc

SEQ ID NO: 519358 - DNA, 100 bp, Homo sapiens
ttgacatgagccattctttctccgccagtatgtgaagggtcatgctgctgatgtgtttgaggcctatactcagcttctaacagaaatggtactgaggctt

SEQ ID NO: 519359 - DNA, 135 bp, Homo sapiens
gtccggcactttcgcgcaagtaccctgaatttcagcccatctgaaagtactccggaggaagcagagttcacaacagcatcataatgcgaggtacagcccttaaccacagcgcctagtgacttgtgggcgctcgtg

SEQ ID NO: 519360 - DNA, 274 bp, Homo sapiens
  misc_feature (253)..(253): n is a, c, g, or t
ttgtaatcccagctacctgggactctgaggtgggaggatcgcttgaacctgggaggcggagattgcggtgagccaggatgaaaccactgcactccagcctgggcgacagagcaagactctgcctcaaaaaagacaactgagaatctggctgggcgcagtggctcatgcctgtaatcccagcaatttcggaggccgagttgggtgcattgttctaggccaggagttcgagactggcctagccaaacgcagtganaacccgtctattaaaaataca

SEQ ID NO: 519361 - DNA, 235 bp, Homo sapiens
tggggcagaacttcagtgaggtccacctgtactacgggacacatccaggctcttctaggacaagtacaatgctagagaagcctaagaatgcgattcacacctttgtgcagtccggatctcacttggctggcaaggtgagaatggcaaatctagtgatggccgagggccctgacacctagtgcagtcgaagctatagagtttatccagtgtaaccctgctcatctactggatagaa

SEQ ID NO: 519362 - DNA, 279 bp, Homo sapiens
ttcattacgccaatatggtggaaggaacagcatatttaagttctttactgttgtaaaactcagatctagagttctgtgggtaagcacctcgaggacagaacatgttggtattggtggagcacctttctattaccacttacaggacagcagattgggaattcatgggctgttggagcaacagaacccctcgttctaccagctgctgtatcaaaggacctggatctagagtcttgatgaacttcccaaatctgattagtcatgattattcgccttaattaa

SEQ ID NO: 519363 - DNA, 970 bp, Homo sapiens
gacaccatgatctctggattgtggatccaaatcctagatggctgaggaggttggatccacaatgcagcagctactgtgcattcaaatcctagatggctgagaagaggcatctcacccttcacatctacaagatctccactgctgggtatgagtaaatgtgtgtgtgagtgcgtgtacacgtacatgtgcacacactgtctacatacaaaccatctagatctatagagatgccaggcttcactttacatgtgattacattctacatgaaaacagttgagggctttcgttatctttcacttgatggagtttcactgtattatgttcatgatgggccccagtgaactccatatcaggtatatacatagaatgtataatatatacaaactgttagacacactacacacacacacacacacacacacacacacacaaagcctagggaaacctgtgatgtgggtaagttcattgtgccatcccatctcctccatctaagtaatttcccggggcaagcattgtttcacacactcccctcagctgcccagccattccctctccagtgtcccataccaccaagccttctttccccatcagtccaaatgtccctgccctatgtcccatctctcagggtcctactctctgataggtgacagttcagtcagtgggtgctaaagagtcgagtgttacccttcccaggtgacatttacattttaataggggctacagataatgccttaatcagaaagagtggctgtagtggtgggaatttcaggcacagaagtgggccagtaagggagattcttttatatcaggagggcattttagagcccccgagtcatacctgtctgtaagcgcagcccttcataagtgcatgagcacaagcaagcacacttacctacattataccctccataattttgagatacctcccttgcattggccctatctttaaaaatgaaaaaaaaaaacccaa

SEQ ID NO: 519364 - DNA, 296 bp, Homo sapiens
cgtttacggagttatgaataaagctgatataaacatctgtgtttcattttgttatgtgtacacatagtttttcaatttccttatgcatagaggccaagggacatgattgctggcattgattgtgtggcaagattatgtctaattttgaaagaacactgccaagctgtctttcaaattgctgtaaaattttacatcccaaccagcaatgactgagggttcctgttgctccccagcgttttgacattaacagtgtcctagattttgaccactctaataggtgtgtagtggtagcaaac

SEQ ID NO: 519365 - DNA, 185 bp, Homo sapiens
tatagaatcgagctcggtccccagttattcgatttcaccgaatctggacaacgccgccgccagcagctgttcaatgaagtggtcggttcgctggccccggccttcagcctgtataccaacgacccgggcaagggcaaccgcatcaccaagctccagcaggattcgctgggcttcgcgcagagcct

SEQ ID NO: 519366 - DNA, 242 bp, Homo sapiens
atagctgactctagaggatacacaactcaggggcgagctgccctccctgtgttcctgcagcctgccatctgagcgatcctgcagcctgccctccgtgcgttcctgcagcctgccctctctgtgttcctgcagcctgccctccgtgcgttcctgcagcctgccctccctgtgttcctgcagcctgccctccgtgcgtttatgcagcctgccctctctgtgttcctgcagcccgcccctgaggt

SEQ ID NO: 519367 - DNA, 848 bp, Homo sapiens
  misc_feature (848)..(848): n is a, c, g, or t
gagtgcgcgcccgggtgctctaccggcgtgtcgctccgccccaggagagccgggctaccatggtggagtaccatcgccatggagaggttggtcaatgctgaggaagcccacaatatttgtcaaagagtgtgtagatggggtgtcaggtggtgaagattataatcagaacaacatcaaccagtggatgtgcatgctgtagtggaacaatccttaaacacctggttaagtttgggaaaagcttataaatatttgtgactgtgcaggtggtgcagaagagcgcatatggttcacagagccagctcctgtgtggggataccacatcggatggaacctggtaccgtgacagatgggagaacggaccatgaatgtatggtcaacgtttggccatgtaatggtcgttaactgagtaaaaatgtgggttaaagcatgaattaagaattgtcaggtatcttgccaaaaagagtaataggtggtcacagtgtgctagatgaaaaggtggaatatggtttaagttattaagaaaattgatattttagcaggattaaagtatggggagataagtcatttctaacagggagcggttcaatacggagaattgttggtcgcacaattaatttggaagtttgggtggcatgagaagcaagttatttaaccacgggttcctaatatttgggcaaggggggggagccctagagtaaaattttcgcgagaagagcgggatatgtacaacggggatgtggagaggagtaattgtgaatccacgtgtaatgagagggatgtccaaagaaaactgttggagaacatagtgagggatcatatatcatgatgctgtagattaatattcgtan

SEQ ID NO: 519368 - DNA, 551 bp, Homo sapiens
  misc_feature (366)..(366): n is a, c, g, or t
aaggcagtgatgtcactgagtgacgactctgctctcaaagaggagggaaaatgtgcttcaccatagggccagtattaaatgatctggggggtgccgagaagatgtagacctaaaatgtcgaagtccatttgagacacagcgaattccagttctcagaaatgtaacctgtggtatcatgggacaggcgtgcgaaacatatgcaggctgatcagcgagacaaatgggaaatcaccaaaaacgtcacatccagcacaaatgattgcgtacatatgtaagtcgtgttcctgtgtcagtatgatgtatgcctttagacaatatagctcagtgtatcctatatcaagctgtcactctaaatttagttaccantaggagcgagagctatgatgcctttacacgaaagaaatatatattagtaaatacagaatgtataatatctcatttttggttatattggaagtgctataccaatcaatttgttcaggttgctggagttacaacaattatgtgtttggacaattttctatgtagtatttgattgctttataggatgt

SEQ ID NO: 519369 - DNA, 187 bp, Homo sapiens
  misc_feature (84)..(84): n is a, c, g, or t
  misc_feature (92)..(92): n is a, c, g, or t
  misc_feature (95)..(95): n is a, c, g, or t
  misc_feature (130)..(130): n is a, c, g, or t
gtttttggcgctcggtccggtcgcgtccgacacccggtgggactcagaaggcagtggagccccggcggcggcggcggcggcgcncgggggcnacncgcgggaacaacgcgagtcggcgcgcgggacgaanaataatcatgggccagactgggaagaaatctgagaagggaccagtttgttggcggaa

SEQ ID NO: 519370 - DNA, 441 bp, Homo sapiens
  misc_feature (3)..(3): n is a, c, g, or t
  misc_feature (14)..(14): n is a, c, g, or t
  misc_feature (40)..(40): n is a, c, g, or t
  misc_feature (74)..(74): n is a, c, g, or t
  misc_feature (230)..(230): n is a, c, g, or t
  misc_feature (364)..(364): n is a, c, g, or t
  misc_feature (374)..(374): n is a, c, g, or t
  misc_feature (394)..(394): n is a, c, g, or t
  misc_feature (412)..(412): n is a, c, g, or t
  misc_feature (420)..(420): n is a, c, g, or t
  misc_feature (435)..(436): n is a, c, g, or t
ctnaactggaaagntccaagcttctggaatttaaagtgantctccctcccttggggaatcaacaggcatgaacnaccaacaccctaagcacatttttgtatttttaagtagacacaggatttcgccatgttggccaggctggggacctcttttatttatttatttggttgttgctgttgttgagacaggatctcactctgtcgcccaggctgaagtgtagtggtacactnacagctcactacagcctcattctcccaggctcaggtgatccttccacctcagcatcctgggtagctgggaccacaggaatgcactgaccacacccggctaatattgtgtagtgagatcggggtctccccatgtntgcccaggcnagtctcgaactcctgggctnaagtaatctgcctacctnagcctccntaagttctggactcnngcatg

SEQ ID NO: 519371 - DNA, 347 bp, Homo sapiens
ggctgattaaggatccgtttactggcattgcacatgtcaggctgtgtcctgacatggttatgtctctctaaaaaatgacctagggctggcgcggtggctcacgactgtaatcccaacactctgggaggcggaggcggcgaatcagctaaggtcaggagttcgagaccggcctggcctacatgatgaaaccctgtctccacaaaaaacacaaaaattacctgggcgtggtggcgtatacctttaattccagctactcgggaggctgaggcgggagaatcgtttgaaccccgggaggcggaggttgcagagagccgacattgctccactgcactccagcctgggcgaac

SEQ ID NO: 519372 - DNA, 148 bp, Homo sapiens
cgtgtagatcatttcccagtgtcacctgctgggccataatcaacaaggtacaagacttaagagagccatgccgggatttcaagtatgcaggcagagagattcaatggtgcgttcttgagtcacgggtgttggttgttaagacactggt

SEQ ID NO: 519373 - DNA, 192 bp, Homo sapiens
tgacggtaccaacatcatatggtagtattgttttcttcctacaaacaaattttaaggtgctcacatactaatcttacctcttttacagataaaactcaggatttaaacttataccattttctccaccaaaaaatgtgaaaggaagaatggcagctacgaagttgcatacacatgagacgccttctttttttt

SEQ ID NO: 519374 - DNA, 341 bp, Homo sapiens
ttcgatatccgcaatagcagcagtgaagagaattagaagtggtaaaattctgaacataggccagatgcagtggctcatgcctgtaatcccagcactttgggaggccaaggcgggtggatcacctgaggttaggagttcaagaccagcctggccaacatggtgaacacctatctctactaaaaatacaaaaatcagctgggtatggtggtacgtgcctgtaatcccagttacttgggaggctgaggcaggagaaccagcttgaacctgggaggtggaagttgcagtgagcccagattgcaccactgcactccagcctgggtaacaaagcaagactctatctc

SEQ ID NO: 519375 - DNA, 1059 bp, Homo sapiens
tctatgagacgagagagagaagcctccgctccttaaggtgaaacttcatgaagttttaaacttcatgcaattggaaattccatataagttttatatctgcaagttacagctggtgtggttggtcttgggaaataaaaatccaggttctctcagaaaaaaaaaaaaacaaaaaaaaaaacaaaaaaaaaaaaaacaccagcagccggcgcctaataatgtgtgggcgggtacaggaacaagaaggaggaaaagaaacggagcaccgcgggagcaagcagcggtgtcctccagacgcccgacaattttgtggtgcaaccaagggtgtgaaactacctcagccgggcaccccacatatagagaggagcagcgtactattactatcgacgacaacacacgacgacggttaacaccacccgaggctaaatataatagaggtcagcggggcgacaaccacaaacacacgaacaacaaacacacaacaaacgcacaacacaacagcacaagtacggaccgaagactagcgagataaaagtcaaccacaaaaataaagagagcaaactacactacacaagcgaacatagcactcaaaacaacaagactacactacaagacggaaacaacaaagaacgacaaacaactaacacgtagagagacgacacagaccaaccacagcaaccacacaccaacacaccaccacgacgacaggcagaagcacacaacgagcgcgaacacaaagaagcgaactacaatgacaatggacaaaaagctgggaggagagacaaaaagagagagaacaaacgaccgcgcgccgcgaaagacagcaagagcgaagagaagacatcgaccgaagaccacacgagaacggacagagacaggagcgaacgctaagatgagaagaaacacagagagacaacgacagagcagtgaatgagaagcgctaagacctgaagcatcaagcgagataaggctagagagagacagggacagggaaagagaggaggcacgagcgcagcaacgaacagagtaagtcagaagcaaacagagggacggagcaaccgg

SEQ ID NO: 519376 - DNA, 292 bp, Homo sapiens
ctgggtagcggagatgctgagtgggctcatgatgaagctgacgaaacagcgagggtcatccatgctggtgtgacagatcacgttgtagatctgagatctggaagtcagacactaaagatagtttccttaagttttctaagtacaagacacacttggacattcctgctagtcatgtatcacagtaagccagagaactgagagaatggtctgtgagagcacacgagcagagcaaagatcagcattgctgagatgcggacattgcttattcggactaagaattcttggatgcttc

SEQ ID NO: 519377 - DNA, 515 bp, Homo sapiens
aaaaacgcaaaggacacccccacccccccccccacccccactttaccgagaacaaaagcaaattttaggactcgccactctctccggtgtcccgcgacacaacaccattccctgccgcactacttctttcccgtccaaagatacaacaacatgccccacatacggggagggcaagaatgacaagcctgcgaccaacatgtctgtctcgcatgtttgcgagtcaccagaacaattgggaaaaaaaaaaaacctatggggagagagaagcaaacagattgcgagactaatttaaagcacaatcacctaccaggaacctcaacatttgaaaaaataacactgcggcatcaacaacagaaagtctgttgcaaagagaagcaataccaaaaacttgcaacaattcatgtatatcacaaattcaacccacgtttaaataaaaatgccaagatttcaaaaacaccaaagaaggatttaatgaaaggttctcatcacccacaaataataaagattttttcccc

SEQ ID NO: 519378 - DNA, 156 bp, Homo sapiens
tttgagctcactatacctcgtataagcatacccgcttcaaaacccacagaagaaacataattcaaaagtgacttgctccgttctgttgatttccagcacagtgttactgtggtcctctttcaggaatcgagaataccttaggttcacagctcccga

SEQ ID NO: 519379 - DNA, 706 bp, Homo sapiens
agccccaagctcctacaaagtggtttctatttttgtctccccgcaaagtttttacttcttgcacagcctctgaggatgtgggccccagcccgaacacatctgtggttttcactagtagagcttttcctagtgtctgcccaggggtgcttccagtggctcttccatttgcccccgagccagctgctgacacggcatgccctgaggtctcgggaccaggttccacgggcggtgcttttggcctgctcccccacggagtggaggctggactggtctcccggccggagtgtgaggctggactggtctccacgcaacggagtggaggctggtctgggctcccgcaacggagtggaggctggtctgggctccccgagtggaggctggtctgggctcccgccggacgtggaggctggtctggggagagagctacacctccccccggccccggtctcccgagaaggagcatcgatagggccccgaggtaaaagccccttagccctctcctgtcctgcacccttatctgggccccttggttcttgggtccctgtctttttcaacaggcagcccccgttggggaattaagttgattctggactggctatgcctaatgatagctgccatctttgaaacccctaaagttcgagttcaaccataaagttggggaggccgtgtccacaccttccttgtagaacggccaaacaaaaaaaaa

SEQ ID NO: 519380 - DNA, 907 bp, Homo sapiens
  misc_feature (347)..(347): n is a, c, g, or t
gcctcggaggctatataaattattcgctacttcctcccggcaagttcttcccggtatgcaccgccgaaaacaaaccttccaccatacaacctttagggtctataactccaagattcccctcttcttaaaaatactctctgctttagatgaccccccccctcgcagagttcaccgtacaccctctcagaattaaactccccttctctaaagactaaaggagtataacctccgcccaaatttcatttggaaataaatcatatttttgaggaaaattggaagttaatttttttcgagaataaagcccttccacatgttttattataagaattaaagccacccttgtttangaaaaatatttaagggtgggtgcccccccgtaagggcccacccgttgttgaataaattatgagtctaatttggaatggttaagaaaaagggttcgcccgccactgaaacggcaatttctctttttaagggccaccttctgacccccgggcctttgggaatgcgccccttatggcgccccctataggttcctgtgttaaagctcccccaaaggtggagatttaaatgggacacccctccctcgatggtgaaaaagtgtgtaatgtgacactaagcaacacacgttttttgtagcacgccgtaccaattatgaagaaatatattttgtgcgaaattgttaaacgacccacctccataaaaaagtgtggattagttatattaaaatgaatgtatgcacccaagttaatggttatgccttattataaaagtcacccttctaattttcttattggcccaaaacgcttttacacctggaaaaattaaaccccataatttgagatttaatttttgtaaaataattttggaaatttttttaaaaaaaggttgtccccttacccaaaaa

SEQ ID NO: 519381 - DNA, 532 bp, Homo sapiens
caacgatggtcctcagcttctcgagtagctgggattacaggtgcacaccaccacacggggctaaattatgtttggtatttttagtagagacagagtttcactatgtgggccagaatggtcttgaacttctgacttcatgatccgcacgcctgggcctcccaaggtgctgggattacaggtgtgagtcaccacgcctggctgatcagtttttcatatgctggtgggcctcatgtatgttttttcagaagtgtctgttcatgtacttggcccattttggaatagagtggttgggttttggctggttaattggtttaagttcattatggattttagatataaggtcttggtcagatgcatagttggcaaatattttctcccattcggtaagtggtctgattattctgtcaatagtttttggttggttggttttggttttactggttggtttttccggtggagaagccctttagtttaattaggtccggcttatcaatttttatttttgtggcaattgtttttggagtcttcttaa

SEQ ID NO: 519382 - DNA, 1543 bp, Homo sapiens
  misc_feature (652)..(652): n is a, c, g, or t
  misc_feature (722)..(722): n is a, c, g, or t
  misc_feature (1113)..(1113): n is a, c, g, or t
ccctcctccgcgttggtgtgccgccccattattgaggacctcccgggggtcgtgtattctacttcctctccggagttctattacctctttggtcccccgcggggcctcggcagtacaccaagtgttgtccgccccgccgggcgaccccacgctgttatgttgcgccctcttatgtccgcctccattttttaggggcgacccacccgttttatggcgacgcgaacggtgtggcggtccccacaacaagacccccggcgcgctgtggttaccccccggcttcctcgcgggaaatttctccctcccccgggggtaatttcctgtccggaaatccctccccatcggcggtttctcactgccctccatcaggcgtgtttctcgatatgggagtgggggggaacacccaccgccccccttcatcttcccccgatggtggtgaccctccctgggtaatgttagcccggccttttctcacagggggacctcccgcggcggtactttatgttggggaaccccccagcccttggggtggaatagggcctccgctcccattccggagatgtttgtgcccgaaccccggagttgtgagctctccaaagggccgcttttagttctcccttggatggacctttggcgcggtccccacacttttctntgcgcccaaacccccccgcgttatggaatttcacatgtccctcttccgcgttattttcgcggaaaagcgnccctctttttcgcgggggccgctctggggagaggccccgccttctctctgggccgcacacaaaatgatagagtgggggccccccctcgagaaggcacctcttttttttcgcgagaaagggcgcgcactttcctccccccggcagacctctcatattgggggccacataaaacgctctttatatggaaaaatttatggaaaaaagtgctcttttgccgctcgggttatagagattcacacaaacgcgcgacaggggggaagtttgaaagagaaaggcggcagagccccacacagagagattttgttgataacttgagctctctagagagcctcgggtttataaattgtgtggagattttgttgtgacacgcttttttcccctctctataaanggagcacacttgtgccaccgaagtttgtgggcctatgagaccctccgggagaactcgtcccgcgagttctctggagagtacactattttcgcggcatctctattctcttgagaagcccgagaatttaacacccaatatgacacccactcttgcgcccactataatctcttctgcccctgtgattatacctggagtggtctcgcctggttggcgccggaatgcctgtctcaagtatccttgtgatattgatttgtctgatagcccataaggtctgccaacccatctgggagcttaggtccgatgcaccagtaccactgccaaggccacgcccactgatccccagagtgtgatggatttcttatttaggaaaattgattttttcccgtttataaggatcttggatgtccaaagaatatttgtttaaccttga

SEQ ID NO: 519383 - DNA, 463 bp, Homo sapiens
  misc_feature (450)..(450): n is a, c, g, or t
aaaattgcaccactgcactacagcctggatgatagagcaagactccaaaaacaaaaacaaaactgtaaactttatttctgaacataagcccatgaagttcaagacacttttgtaaagcgataacaccagccatttgggccatccctaaagaactgagagtcctgggaatttaaccacatcaatgaagtcttttttacattattaactgaagaaaaatgggtgctctatgaagatttttcaagattgggaaacaaaaagaagtcagaaggagacaaatcaggactgtaaggtggatgcctaatgatttccagttgaaactcacagaattgcccttgtttgatgagagacaagagcacgggcattgtgatggagaaggactctgtggtgaagctttcccaggtgttttcctgctaaaacatttgactaagctcgtaccgaaaagctttattnagaaacacttgga

SEQ ID NO: 519384 - DNA, 465 bp, Homo sapiens
  misc_feature (64)..(64): n is a, c, g, or t
ggggctttccatttgaaaaaggaagcgtccacattataaagttggaagaaacgttgaaatcacntgtacacagcttactagcgacgcgcggccctccctcctcccgccccccctccctatgacaccagcccccccccaatctcaaccgccctcttccgcagaccacctcttcccccccccccctacctcctcccccacctccccttatctccccgaccatctcccccccgccgcacccccccctcccctcctttcgcccctccatcttctctcattcccactccctctctccccccccccccctcccaccccccccccccgcccctttcccaccacctcccgcacccccccaccctcctcgcccccatccccacccccccctcccccctctcccccctccgcctaccatcctccccccctcccctaaccacccaccttctctcctctacacctccctcgggcccc

SEQ ID NO: 519385 - DNA, 462 bp, Homo sapiens
  misc_feature (367)..(367): n is a, c, g, or t
aatggagtgaatggaatggaatggaacggaaaggagtggaatggaacggaatggaatggaatggaatgcaatggaatcaacgcgactgcagtgtgaatggaatgtaatggaatgcaatggaatggaatcttccggaatggaatggaatggaatggaatggaatcaaccctgagtgcaatggaatggagtggaatggaatggaacggaatggaacaacccgaatggaatggaatgtaatggagagtaagggagttgaatagaatcattccgaatgtaatggaatggaatggaacggaatggaattgaatggaatggaatggaaagcaatggaatggactcaacccgagtgaaatggaatggagagganaggaatggaatcgaatggaaactacccgaatgcaatggaatgtaatggagtgtaagggaattgaatagaatcataacaccacacaattccgggta

SEQ ID NO: 519386 - DNA, 901 bp, Homo sapiens
agcggggtgagtgcggggaggcggcggcggtcggcccggcccagcccagcccgcagctgcggcggcgctcagagttggttcctgaccgccttctgccgctggcctgggtttgtcaccagtgtcctgtgtggtcttgcacctggctctgtgccagacctcgcccccccgcttctcccgttcatggccctggtgcggggctgcggaggcctggcggggggggccttcccgccttggttgcccaggcaccgtccagggtgacgggtgctgcgggccagcgaggctgacaggggccaaagacgctcggggagccggggccaagcaccaagcggacgccgtaaccacgggtgcactccagggttggggccgcgaagaaaggtacaggaaccgctcaggtggatggaaggaaggacgcagcggggaggtcccagaatgggcagctggaagggaaggttgcagtcccatatatcaggaagccagttgcacatgacaggggagggagcacccctatggggaattagagccattgcaatagacagagagagcgtaccacggagagaggggcgacggaaccgcgccggtggaccaccagtgaggtacggccccaatatagaggaggcccaagggaagaaagacgatcaatggccacaggcacccgggcacagtaagaagaacgggcaatgggagtgatgcataccaagaccagaagaacccaaatatgcgcacgcacgagcggcaaccacgggcaaccaaaatatcagaggcgccgagttacgaaaccgaaaatgggagtcacccattagggaggcacaaacagcagccaacagcggaggaagaggcacgtatgggacaaagcaacgagcccatcacagggcacgcacaaaggcgcatagaacaaccaagt

SEQ ID NO: 519387 - DNA, 1192 bp, Homo sapiens
  misc_feature (823)..(823): n is a, c, g, or t
  misc_feature (862)..(862): n is a, c, g, or t
tggaaagggagtctcgctttgtcgcccaggtgggggtgcaggggcgcaatctcggtttacggcaagctccgcctccggggtttcacgccattctcctggccttcagcctcagtgaagttagctggggaactacgggcgcccgccattacgcccgcgttaactttttggggtattttaagataaaaagtggggtttcaccggtgttatagccaggagtggtctcgaatctccgtgaaccttgggtgaactcgcgccgcgccttcggccttccacaagagtggggcgtgggaaattatacgagcggcgtgaagcctcatcgaggcgccccgcggggcgcgcggtgagagggaaggcaaagccaaggcggcggggccaggcgaagcgcggagaagtgccagaccaaccgagagggcttctccttcctcctatacacccttccttcgcccgtggtgtgggcgcctcaacccttcgcggggtgctcgccacaaaagaacaagagaaatagagggtgaaaaaaagaggggcggcccgcgggagaagccgaagtgtgcgcctgaaggtggcgccgtggagggggcccccgtgaaaacaccccaagaggaacgagaacagagggcaatgtgcgcgacgcgaagtggtggggataatccacgcgaacgaaaaggggtgaccacctcgtgcgcggagggggacaccacaaaataaccccacgagggaggaacaactccgcaggagtggcacaaggggtgtcgccacacttgaacaagtcgtggcgaacacaaacagcgggaagtctctggcgaaagaccacaaatgtgacaanaggtctaaccacacggttgtgagcaaaccacaaccagtngcgggcaggtcgcagagtatgatagcagtggggggggcgcacacacagaggaggcaacaccccaacagaagtcttcgcgagccaacatgaggaggaccaacccccgtatgcaacaagaacagaggggcccgacctgccattaaaaaaacagtggcatcatccaaagtgatgcagcaacagggggaagaaaacccaacattccgcggcggtctacacaccacaacagcgctccagtgtgccaaacccccccccaggagagcaccacaatcacgagcaaaccaaggaggccccaaagaggcccacaacaacacggcggggcacgggggcaca

SEQ ID NO: 519388 - DNA, 447 bp, Homo sapiens
  misc_feature (186)..(186): n is a, c, g, or t
  misc_feature (334)..(334): n is a, c, g, or t
taaaaaaaaaagggatttaaaacggggtccccgtgggattcataattaggcctcccccggaggagggggcccagttttgttatttaagcccaggggcaagttctgtttcattttggcgttcccaaggcccaaaagaaaaaaaaaatcaaaggcctttcatcccccggggggtttcttaaatcccgnaagggcttaggaaacacgttgggcaggtgagcagggcctcctgacccctcctttgtctcttggagaaaggggctggggtcccatggaaacgggtcaatgcggcctgctggtggactccgatgcctgccttttgcgggaaggggggtancccttgaaacacccattggtctgccgtttggagggccctccattcaggatgtccctgatgggctgcacgatgagggtgatggccaccaaattatctgcacctctagggatgat

SEQ ID NO: 519389 - DNA, 111 bp, Homo sapiens
tcgagtcggtaccataagtagcaggtgaaactatccagttactcctctagtcctatcacctcgcttttatgatgtgtaaggtataggatcctgcccgtctaggagcgtaat

SEQ ID NO: 519390 - DNA, 459 bp, Homo sapiens
gacagacgtgtagcaatggagattcgacaatgagcaagaaaaaaatgggacagtggcggtggctcacacctgtaatcccagcactttgggaggccgaggcaggtggatcacctgaggtgaggagttaagagaccagcctgaccaacatggtgaaaccccgtctctactaaaaatacgaaactagccgggcatggtagtgcacacctataatcccagctatctgggaggctgaggcaggagaatcatttgaacccaggaggcagaggttgcagtgagccaagatcgtgcactccagcatgggcgacaacagtgaaactccatctcaaaaaaagaaaaaagaaaaaatggggaccaagtacaacagcctacacctgtaatcccagcactttgggaagctgagggaggaggggctggaagcctaggagaccctcggcaacatggcaacacggtctctcaggt

SEQ ID NO: 519391 - DNA, 1718 bp, Homo sapiens
  misc_feature (176)..(176): n is a, c, g, or t
  misc_feature (373)..(373): n is a, c, g, or t
  misc_feature (1718)..(1718): n is a, c, g, or t
ggcgggaggggaaacttgcgcggacgaaggggaatgcggagccggcgccggctgcgcagaggagccgcgtctcgcactgcacgtgcaacctcgtgcatggcgatgcccgagcgaggctgacctgcgatcactgaccgcgtcgggaatcaactggagaactcggtcgctgacgaggntgacttgggcgcggacgacttgattccttgtgcggacgtctgccaggattgctaagcgcttgttggtggtgccagacctagtgcacaaggcgactaggacgcaatcggacgtgactgtcatagtcacacaccaatacggatgacattcttctcgggggcgtttcacatccaccaaacttccgatgtggctgaatcgncgagactagtacgtaccttctcgcaatgcgtgtgccttgtcctgtacctataggaatcatggagaacttggcaaaaccaagtgtacgtcgttgcatagagcgcaatcctacaaccttacagggggttgacccctccacgaaccgtacgcgacggtaatatttagctagagcggtgctactaacccaacacgagtagtagatagccctttaacgagtgcggtgggccaccttcttaatactagctagatgaaaacgacaaccccaggggcgcacattgtgggtccttctaaatccggagaaatctaatttgcaacggtttcagataacaccacgcacgtttataaggacgttctttagcaaaacctcccaaaaattgccgagactccgaatggttgcgtattcatacaaggaaatggaaccaaatcggtcatggacgtaagtccaaacaattcaccgaccataggtgggaacgccaggttaagagctcggctaaccagaatttatgctttcccaaggcgtggagaacaaattccttggccttggacttttcctaatttcaaggttcagaatccataattcttagcaggagccaaagcgttaattggccagttctccgttgtgacaaggccgagcaaaggtaagaggacggggacctgtcgaggcgccatttttctggtgagttcaccttggggtggaaagccgtattctggtattcgcgagtcggggcttaagttccgctaactttttaagagccgggcgtattaggggggaagagatatacagaaagtgggctgaactattgtccgttatctaacgagactttccaggggagtttgggcaatatcacacattggttatttttgacctttccactaggaaaaggacgggacacaggatataggggccaaattaggaaccacctcgatttatcgtatgtggggaagcctctcgaagatcgaccacagatcgcgatatttacacagggggataataatccacagtgggtgtacccccagcggggcaggttgtgggagaatattacaaggcaattaaggagatatcacttgtcgtgccctatttaagagcgtatagtagatacagggcaggaccagggggtgcagagtatggtgttattaggaacacaagagggattcccgcccgtcgttctcgggagaacacatatgggtgatttataaacgagcgggcaacaggacgaattatttcagtggtatacagagcagaggaatattgagcagatagcaatagtgttgatagagagatacttcaggtgttacaatacgagaggcattagatagtgttatgagagactacataccgaggatan

SEQ ID NO: 519392 - DNA, 378 bp, Homo sapiens
  misc_feature (6)..(6): n is a, c, g, or t
  misc_feature (201)..(201): n is a, c, g, or t
  misc_feature (244)..(248): n is a, c, g, or t
  misc_feature (250)..(250): n is a, c, g, or t
  misc_feature (295)..(295): n is a, c, g, or t
  misc_feature (301)..(301): n is a, c, g, or t
  misc_feature (312)..(312): n is a, c, g, or t
  misc_feature (318)..(318): n is a, c, g, or t
  misc_feature (337)..(337): n is a, c, g, or t
  misc_feature (339)..(339): n is a, c, g, or t
  misc_feature (365)..(365): n is a, c, g, or t
atgtanataagttctgtcattgtagaaagcggtctgacgatttctcaaagaacataaaacggaattaccattcaacccatcagtcctattattgggtatatacacaaagcaatataaatcctttcaccattatttttctattatactttcaggcatttgggtcatacttacaaacacatttattcttcctagataattaanagaaattctactatgagtagttctaatacttatagtttcagannnnncntttatatattgatcaatatataaattacaaattaatgcttctgtnaggcgncaggcacaatncccgcngctttttgtttcttccagntnatctagttgtcttaatgtcacttgcngggtacttctgcc

SEQ ID NO: 519393 - DNA, 370 bp, Homo sapiens
ggattttcaaataggaaaatcaaaaggcccaaagagacagctcactggtgaccatgctttgggattttcatagtttgcgtaattcctatgggctgggccacccaggagcttagagaacacgagattcctcccccagcggggtgtggttttcggaatgtgaccggccagttttcgggcggtgtgcctgtggctacggcctgctatgaggatgcgtggtggtggggccagtgagggcccagttggctagtttgtctgggcccacaccctgcagttgtgtcccagcaggcggggcccagccaggcccagatcttctcgcgtaggactttttaaagtatatatatatatatggatatatatatatatgtgtaaa

SEQ ID NO: 519394 - DNA, 229 bp, Homo sapiens
gggggggggggcccccctttttttttaaaacccccccgaaaggtgggtgtattaagttttttttggggggggtggccccccccttcgggtttttcccttttttcccccccccccccttttttcccccccccgtcgtggttttttccggggggggggggggggcccccttttttggggggggttgggccccccttttgggttttttttaataatggcttcccccctccca

SEQ ID NO: 519395 - DNA, 134 bp, Homo sapiens
  misc_feature (126)..(126): n is a, c, g, or t
taaagaccaatcttgtcaggacgaagcttgtcaggactgtaagccttgtaagataagaatattaacttcagggtgagcgaaaaatcagaatagtgttggtataaatggggtctcctcctccggggngtccaaaa

SEQ ID NO: 519396 - DNA, 402 bp, Homo sapiens
ggttgttgttttccttgtctcgattggactgttgccggacatgctgcccattgatgacttctggtagtcagtggcctggtgcccacccatgaagcttcctgggcggtgactgagggtctggcgcctttctggaccacacgggacgcacccactgcttcagcccaggccttcccttcctctcgagtccgcttagtgtccgcactgtctgcagagtccattgacaactgccgctgcctcctagggtcccaacttgttccactattggcctgccggtccctttcacaactttcttcctacctcttcatacatcaactgaactttcagttttctcagaaatagtccaccttcctttcattggagggcctaacaaacatgcaggagggagtaccaccagtaggcaag

SEQ ID NO: 519397 - DNA, 195 bp, Homo sapiens
ccaaaaagcccccccctaaaaggggggggggggcgggaaaatttaaaaattgggccccccggggcccgggaccctttaaccccccggttttccccccaagggccccccaaaaaaaaattgggggggggggggttcctttttgggggggttttaaatttttttaaattaaaaaaaaaatttttccgggaaccccca

SEQ ID NO: 519398 - DNA, 234 bp, Homo sapiens
cgattgcgttccacgtatattgctggaggcaagtgttgatttctactttgcgatactaccctgtgtatctccgtcattgttcgtccacatattatgtcgtattgcagttattcctgagttagtcagcattcatctactattctcaagcacgttaaaatgagagaaccaatctaattcatctttgaactctagtgcctaggagaatggtagattataaatagatacttggtgaac

SEQ ID NO: 519399 - DNA, 650 bp, Homo sapiens
ggcaaacagccagaacgcctgaacgcaggcacatacttcctattctacatgcctagtaggctcccttcccctactcatcgcactaactgtacactcacaacacgcctgagggctcacgtgaagacatgtctactactcactctcacggcccaagaactatcaaactcgctgtagccaacaacttagatcatgactagcttacacaatagcttttatagtagacagatgacctctttacggactccacttatgactccctaaagcccatgtcgaagccgcccatcgctgggtcaatagtactgtgccgcagtactcttaaaactaggcggctatggtataatagcgcctcacagctcattgctcaagcgccctggacaaaagcacgatagcctaccccttccttgtactatccctatgaggcagtaacttataacaagctccatctgcctacgacaaacagacctaaaatcgctcatgcatactcttcagatcagccacatagccctcgtagtaacagccattctcatccaaagcccctgaagcttcaccggcgcagtcattctcataaatcggccagggcttacatcctcattactatctgctagcaaactcaactacgaacgcactcacagtcgcaatcataattctcc

SEQ ID NO: 519400 - DNA, 574 bp, Homo sapiens
aacatgtcgaggctggatgaatggtgtgatctcggctcactgcagcctcaaactcttgggctcaagtgatactcccgcctcagcctcccaagttcccaggtagctgggaccacaggttgcatgccaccacacccagctaacttttatcttctgtagagatggagtctcaccagttgaccaggcaggtctcaaattcctggactgaaacaatcctcccgcctcggcctcccaaagtgctgggattacaggcatgagccaccgtgtctggcccagggtctcttaagagattgcaatcatttgaaaactttgagttaacttgtacgcagcaatagataacttacacatgtggtcgtagcctcatcactggggttagaggatccacatgagaaagagctcattcacacagctgttggcaaaaggcctcagctcctggcaacatggaagctgcctttccctggaacaagtgatcagagaaagagagagagcacactgatcggcactgtatctatataacctagtcttggaagcgatacatcaacacttctctcatattctatggcgcactgtattagcc

SEQ ID NO: 519401 - DNA, 392 bp, Homo sapiens
  misc_feature (359)..(359): n is a, c, g, or t
  misc_feature (388)..(388): n is a, c, g, or t
ttaaattgtgatgtattcatatatcatgagattgttaaaaaaaaaggattacaggcatgagcaccgcacccagcctctatttcctttttaaaattgaatgcctttaacagcacccaagtcacctcttgaatgttttattgcttagaaatttcatccgccagataccctaaatcatctctctgaagttcaaatttccacaaacctccagggcaggggcaacatgccaccaatctttttgctaaaacaagttataggcaaacaacttcctcctctccatttgagaccacctcagccgggatttcattgtccttatcattatcaggcattttgggtcaaaggccataacaacaagtcttctnacaaagtttggaaactttcccacattttncctt

SEQ ID NO: 519402 - DNA, 1967 bp, Homo sapiens
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 519403 - DNA, 400 bp, Homo sapiens
gatggtcctcagctcactgggctcttgcaagtgagctgagagaacaaagtagaaaccataacctttggccaggcatggtggctcacgcctgtggtcccagcacttttggaagctgaggaccatcgttgcaacgatggtcctcagctcgaggcccccgatggtcctcagctacttttcagaaacccagacccccaccaaatggattcacacagacgtcagataagggggaacaccagggactaaactctgacctccattctctgctctcagtttcttcctgaggggcctggccagaccttaatgttcctttctgcggaccccaagtttttagacaaagctttgcttccttaaccaatcacaaatcagggagtctttgaatccaccataacctgtaagcccg

SEQ ID NO: 519404 - DNA, 1028 bp, Homo sapiens
  misc_feature (1000)..(1000): n is a, c, g, or t
ggccgggtgctgcctgattccggatctcattgccactgcgccgccctggaacgatcgcccgacgtgctagttcccgagttccattattggttccaagtcactagaatatggtaactcatagatacggctcatgctgattttagtacaatcttcgtaagagggaacgaacgatgacctcgccctagaaggtaagagacttacatgctatgtccgagggtacgagtcgctggattcggcattggtcctgtgccaatcgacgtagtccttagatgaacggactatgcgctaggaatgagccgtatgccccatagtgctggatggtcatacgtaaggacctagaattgaaagtggacggagagtgattcgtgagtcatctcaaccatgggcctaaggccgtgttttcccttagaagcacctagaagtactcgtcgtctggcagaacgacgtatacagtggtaaccctgcacaagctcccagaagctcgtgatccatatattcgagtgtactgtggtgcaaacgtcatgcaaaggaacgaaatgcaaaagcgcgctcctctagatgtagcgtaccatggcagctgaaacgttgcatggcattccttctgaactattcgatcacttgcgctaagtcgatatggctagaacagtcaccagtgccccgtagaacctgctaaaaggtctgcggtatatttggatctctccatacaagtcccaaggatgcgaattatttcgtttagaccccttaacgttgtgggtccggtggcaaaagcaataaacgggtgaggtcatcactaccgcgaaacacacaacgcggtggtctcaactacttggaaacgcgccggggattgaccagaattacgtggcggaatttcacagtagcgcccggaatgttcccaggtggaaacccataacagtgggggaggggaacaaccgggtcttagggcggaaggcgtatccatcgcccaacttctaattggccctgggtcaaatgagaaggtagngccggtcccatttgcagggctgaaaaac

SEQ ID NO: 519405 - DNA, 1297 bp, Homo sapiens
tataagggggggcccttttttcacaacggggcccacaacccagtgtctccaggttaaccccgtggggtgcctctccccccctctctcccgcgggaagacaccaaaacctcttcatactctctctcaaagtgtggggggacaaaaagaggggaaggggggggccacaacacccctcttttttcaaaaaaaaaacaaaaataaaaacaaacaaaaaaaaaaaaaaaaaaataaacaaaaacatataaaataaaactatcaaaaatcaatattaacataaaaatacaatcaaataaatactacaataacacagatcaatataatatacactcaaaaatcagccctcccccaaaaaaagaaatagaaataagaatccagtaaggcaactactttatacaatatcagcacactatcaaacaaaacagaaataaatcctagctttctactcatttcctactcatcggtctgtgtggctacacttcttatccttgtcaattagtatataaaagaaacatcttttattaatacacaaacaaataatgaacacatatattaatgctattctattttcgttcatacaacaaaataaataaaattatttaaaaaaccacaaactaataaacaaaataacaactaaataaaaaaataaaccactaacaagaaaataaaaaatataaaatgatagaaacaataggggtcacgagaagtaaaaacctacttctaggatcagatagcgggtatctacgtattagtaaaaaagagagtagcgaacaatgcatctgcaagactaggacagagaaagaagtataatgtgataagtgtgaagagtaaaacgagaaaaaggactggagacggaaacaacaacgtacaaggacagaaagggaagcagaagaggatacagtagcgagcgtgtcatggagagagctaggaaacagaggcagacaagaggagagagaaaaaacaggaaaacaagagaaagtgcgaagaacgccacgaacagacgaccacacgaaggaaccgcaggagcgaagcaaaagcggaagacggagcagagagccaagagaagaggggaaagcgcacggaagcgcacgacctgacaagaaacagcacacaaaacagaaaggcaacatcacgggcgagagaagccagcaacgctcagccagacaagagcgagagcgaagagaagcaagacgagatcgagcaagtacgggacggcaggagaaacgccgaatagaagcagaaaaaagaagatagagcaacaagagcagagagaaaaagaaaagaatgaaacacgaagaga

SEQ ID NO: 519406 - DNA, 463 bp, Homo sapiens
ttccagtggggacggaatgacgccgtcaactggttagaccacgagtagtggttataagcggagtagtaaggctataaagcaagtggctttctaattattctgtaagatatatatgtgtgatgtgctttctgtccgagaattacctcactataaaaaagtataaaaaaaaaaaaaactacttctaaaggtcatatgacttactctggaataaagtatggctatgttggccactgatactttgcagcagaaatggagcaaatcaaggtgataaatgaggctggtaaaatatgaccacacacgatgtgaggctagtaaaacatagcctcacatgatgctacatttggcggctaaaaattccctacattgggggaatcagataaatattcaatttttttgaatttctaggtgggtccattacaagcatgctttctggcaaagaggaattcccagatggaggtatatg

SEQ ID NO: 519407 - DNA, 149 bp, Homo sapiens
atgcgtggccggcacgtgacagctggctgctcgtggtgtacaggtccccgaagtcatcctgtctgggtggcaagtatctggcggtcacgccctgcccgctttggctccaggccacactgagtggctcctgggagaagaagccctgaacc

SEQ ID NO: 519408 - DNA, 121 bp, Homo sapiens
cgtgacctcactcagatggccgacgagatgaggcggaacctggagctgaaagagaagggcagacacgtagagctgggcgccatcgagaacaagctggagagcacaggcaattcacctacga

SEQ ID NO: 519409 - DNA, 1974 bp, Homo sapiens
gggcaccatcgtaccgtatcgtgatacattctgcttaacgaggcatgctgccgaggggccagaagcactacatcatcgaccagtgtgtaccgagccaatggaccaacaccggtgaggactctacgaggacctacgcttgcgagtgagatacctcgtggccaggactgtatgcttatgtagattgacgtgtgaggtattcgcacgacctatgagactcaatgcagagactaaggacgaatgcaagactggagtcaatcagtcgcagacagacgtggactgcgcctctcaagaggctgactcggaccgtagcgcgctactgaggccgctcagcctgcagagagacacctctgaagacagtccgataacgtcggttgactacatccagtctagagtcattggatcactctgctagcgaccaagtcaacaagtagccgaaccaccactcaacgtgacttctcgtaacgtgatttcgacatgcgtattatgtaccacacaaagcgcattgacacgaaggagggagcatatgtcactacagacaactctaccagatagttggttgctcgcaacctgggagcgcctcttcgagaatggcgtacgaccttgggcgacgtccgtcccatgtgccacttgatccgtagatgactcgagcgctgagtaccgcgacagtgagcagtgcaccgtgcaggtatgcctagcgggctagtgagtgcacctagcgcctagaattgggcttgcgaagcataacccgccggcccagcccagccaaatcacatcacgacacgaaacagcagtagtcgcactaacctacaccacaagcaaacaccagcgtacgacactgcaccagccaacaacaaaaccacaaccaccacccgcatcacgcctaacacccacgagcaggctccacacatcccaacacagcaccaacgaccggcggacgcgtcaacaccaaccctatccggacacacaccactccaggcccacagcataaccaccaaccagcacccccacggcaccaagcaacacccgcccaggtaccagctcggagccagcgagaccaacacaccacacgcgtacgacaccagacaggacaaccggacaaacgaacgactacaccatctgacacaccaagccagaacaacacccacaatacacagagaaacaggcgaatcacaacccagagaaactcacacccccgaaccacaaacgcacgagcgacaacgcgacaacacaaccggcaataaacgccaacagacacaccacacacgcgaaccagcagcagcaaaacaccgacagagaccaagcaaaacccacgacagacgaacatgacagaggccgcacacacatgagcgcaacaacaaacacacacccagccgagacatggcgaatagacaaaagacgagcgcaacatccacaacacacacagaggcaccacaccacacacaaaaaaaacgcaggaaaagcacgcaaacatccaacacaagcacggccgcacacaacaaccagaccaacaggacacacaatcacaatctccctcaccacacactgtctaaatcacactcatcacccagacgacaaccccaaacaaaaacaacagtaacacaaacaacatatacaactaaaccaataacacacagactccatacagacagcgactatacaaccactcaacatatcaatcacttacaaagtagctacaacatagtccccctataattcgtacacaaacatcacaaatcaatacatactataacaacaccaaacaaacttcaagcacaccactaacataaccaccacccctctcaaccataccacaactaatacatacaccacataataacacacacacccactaaatcaaccaccataccaacacaccatcaaacacaacaaagcatccaactaacacacacatacaaataagacaacaccactatcccctcaactccatcacctacgtacacacaactcccttac

SEQ ID NO: 519410 - DNA, 153 bp, Homo sapiens
gtccttgtctctgcgctcctccttcctctggggctgggtgtcttctcccatagctatgtcctttgaggcagcttgcgggctacccacatggctttgcctttcttcccatgtcacccttgctcacggtcgccactgctccgtggtccgcagttg

SEQ ID NO: 519411 - DNA, 422 bp, Homo sapiens
  misc_feature (235)..(235): n is a, c, g, or t
cactcgtgagctggcacagaaaaagcagccgcatgccaagcgcagggctgtgtggcttcgtggcagcagaggctgcgtctgcctgcagtgaggaggggctccggctgtgccctcaggagcaaagtgctggtgagcccgtgcggtgctgatggctgcagaaagccaaacagtcacgctgaccggacagttccgccggggcagcctggggacgagatcatgatgacgacagtcccangtgatcctcaacgtcaggtcacaggcacttcatgaattctttcaggctggacttgtgttttcctagtgaaagccgtcttggcgttgttccacatacaagtaattattggacttttcttcaaaacatgtcatgaatatgaggcaggatttgagtattgaggcaaaataaatctatttaaattctcaaa

SEQ ID NO: 519412 - DNA, 254 bp, Homo sapiens
gagagataggggttcaccatgttggtaagctggtcttgaatcctgaccttagatagataccaactgactcggctaccagtgttgggattacaggtgtgagccattgcactccgcgcaatctatttttatgtattgtagagacgggttatcgccatgttacccagactggtcttgaactcctgacctacaagcaatctggtacgtattagcctcccaaagtgctgggattacagctgtgagccattgcactccgg

SEQ ID NO: 519413 - DNA, 353 bp, Homo sapiens
tgaaatcatgtggagctgtgaatgaaatcagccatgaaagagtgtaaactgtccagaagatactgctatgaatgagagtcagccctctgcgccctgggtaaagactgccatctcgagctgagacccagactttgttggggacatctatatgggaacatcatagagatcctgcagaaagaggatgtgaaaccatatcaagttaatggagtcaacccagcctatccagaatcccgctttccaaatatacttaagagtttcacatcctcctcctcttcatcttctgactctgcatcttcctccacagctactaagtgctgtccactaatatgcactggccctgaaccacacttcaa

SEQ ID NO: 519414 - DNA, 230 bp, Homo sapiens
ccaccagggctgcgaactcgtccgaggcgttgatggcctggatgtgttgcagggcgcggacgatgggcttgccgatgctttccaggtattcgtacagcgaattgccgatggcctgcgggtgggggaggacggaggcgggcatggcggtcatttcaatcgccatcaccgtgtcgtcggccttacgcaaacgcttgagcaccggactttgtcgctgggtgacaggcccaggc

SEQ ID NO: 519415 - DNA, 151 bp, Homo sapiens
gttctgaggctttggcagcttcgcgaattccacgtgctacctccatcgtgtgatgagggctagactatcagatacctcttgatagatgcagatataaaggtccattacacccccaggtcagcaattggctattgcaacttctaaaactagg

SEQ ID NO: 519416 - DNA, 411 bp, Homo sapiens
tgtcttctctcactgcaaggtggcggcaggagagggggaggtgctcgttcctgtacgtcatgcagcgccatcctcggcgctgcagtgacacacgctgttgccgtcggcatgactgatcatatgaccctccgtggcaccctgaagggccacaacgtctgggtaacccagatcgctactacccgggaggtccgggacacgatcctctgcgactctagagataagaccatcatcatgtggctgaccagcgatgagacccactatggaattgcacagcgtgctctgcgggggcacttccactttgttagcgatgtgagtatctcctcagatggccagtttgccctctcaagctactgggatggaaccctgcgcctctgggatctcacaacgggcaccaccacgggcgttgcgggc

SEQ ID NO: 519417 - DNA, 302 bp, Homo sapiens
  misc_feature (160)..(160): n is a, c, g, or t
  misc_feature (173)..(173): n is a, c, g, or t
  misc_feature (178)..(178): n is a, c, g, or t
  misc_feature (180)..(180): n is a, c, g, or t
  misc_feature (184)..(184): n is a, c, g, or t
  misc_feature (199)..(199): n is a, c, g, or t
  misc_feature (202)..(202): n is a, c, g, or t
  misc_feature (212)..(212): n is a, c, g, or t
  misc_feature (251)..(251): n is a, c, g, or t
  misc_feature (254)..(254): n is a, c, g, or t
  misc_feature (269)..(269): n is a, c, g, or t
ttccaaagtcaacaaaacagccagggggggggaactgttatgatcacctccacatctcagaccaaagggtttgtcttccccagcatttttttactcctgcccttttttcaaaaggttatgtggggaggtgaagggggtccatgtggaccaggggcccagntccccgggacccnggttncngganaagcccatttggaanaanagtcccttcntccccccaaatattgggcagccctgtccttaccccgggnccncccctcccttccagntatgtgtacaataatgaccaatttgtttggtta

SEQ ID NO: 519418 - DNA, 1021 bp, Homo sapiens
  misc_feature (485)..(485): n is a, c, g, or t
  misc_feature (521)..(521): n is a, c, g, or t
  misc_feature (536)..(536): n is a, c, g, or t
  misc_feature (598)..(598): n is a, c, g, or t
  misc_feature (673)..(673): n is a, c, g, or t
  misc_feature (694)..(694): n is a, c, g, or t
  misc_feature (706)..(706): n is a, c, g, or t
  misc_feature (741)..(741): n is a, c, g, or t
  misc_feature (758)..(758): n is a, c, g, or t
  misc_feature (762)..(762): n is a, c, g, or t
  misc_feature (769)..(770): n is a, c, g, or t
  misc_feature (805)..(806): n is a, c, g, or t
tataatgcctggaacctggttgggcagtaggggagggaggtaaaaggaaaagtgtgagatttctcccttttagtttttatcctattgtggcaaatatgaattctccaaccttatttgaaataaattttccactcttggaaaggtaaatttagccccaagttgttttagtctccaggaggctgccagcccccccttttatttaattttgagttttgggggccagcctaaagggaattcctttttttttttttttaaccccccaggggggtagtggggagtgagactataggccataaagaagtgggactgcttgtggaccaaaataaatgggaaaatcggtggtttgaaaagaagctttggggaagtgatgagtcatttggcaccaggtaataggggaaaatggtgtgacctccagcaaacacatgaatggttatttcctggagccggaagcactgtgggggtcggtggtaattcccaggtgtttnctggtgtccatagtttataccctttctaaacacggnccttttggaaagttnggaatatatccacattctatggaaaccttgaaactaaaaatttagactcttatcgtcatctnaagttcttcaggctactcttaacctcccaaaaagcagtatctaagtcacatacatgatgtctggggcattttctngagccatggagaactctgaanggaagaatcgcngcttttctcaagcaaatcggtttctggatgtcatngggttctccttgcctgntccngatgctnnggaccccttttatggatcagagggctctagaatannggatggtctgggatgatggataaatagggacagggacagttaaatggggagcctttcttacaaccttgatgggatttttccccccaagtttccttctccagtgaaagtggcacactaaggctggtgggattcatgaggtgggcagaccaagtgtgttgtatagaggaagtaaatttaaagcttcccttgagagaataagtgggaatgggaagaat

SEQ ID NO: 519419 - DNA, 93 bp, Homo sapiens
atcattccccgggggggttttttgccgatttttgaatgtggttttaaaaagtgaaaaatgagcctatgcgtttttataaaaaatggggcctga

SEQ ID NO: 519420 - DNA, 405 bp, Homo sapiens
tcactgctagcgacggctggctggactatgccagctccttcgacagactcatccctcttctcccgcgaagactttagtatacgttagtccagtggatttcggaggtcagtgggcatctcgtcccattacagccgcaggtgtcccatattacctccagactgtttgtgagtgagatctcggagagttgtggcagtcttgaaatggaatcgattctccattctgggccatagcttcggtggcttcgtgagcggaatgttttcctgtaccttccccgagatggtggataaacttatcttgctggacacgccgccctttctcctggaatcagatgaaatggagaacttgctgacctacaagcggagagccatagagcacgtgctgcaggtagaggcctcccaggagccc

SEQ ID NO: 519421 - DNA, 215 bp, Homo sapiens
atgatattctgatcaatggactttccagattggcgacactggttatttctacttacagccggggtgagaaaaatgagcaattctgagctggcataactctggtcaataattctaacagtgggccataatcctgtggtttggccaatctacctggaaaaccaactggatgacctccttagttgggaaaagggggggaagggaaaaaaggcctggcc

SEQ ID NO: 519422 - DNA, 244 bp, Homo sapiens
  misc_feature (164)..(164): n is a, c, g, or t
gcagcaacgccccttggtggacaggatggttcggcaaagcagcctgagttatttttgttgacggaatcggtacacgctggctccatatcgtgaaatttttattaatttttttctttttccctgtggtgtcttcgtgttatctttttcctttcttcagactgccncccaaggagatgtctcttcccggtcttcttctgtcaatttagagattccctccccctctctctccagtttctccttccct

SEQ ID NO: 519423 - DNA, 1466 bp, Homo sapiens
tcttgaaaaaaaaaagggccaagaaaaaaggggagaaaccgggccatgagggggccacaaaaatataagagaaaaaaatctccctctatctgcatgtggggccacaccccaaacaagagtggagcggctctcagatgacaatgatgacattttttatttatttttatatatattttattatattgtgtgggcccctggtggagaggagataacacaacggacaaaaagaacacaccccctctctaccaccccaacacacacacagggcggcacccaaaggaggtgcgcgcccaacacacgggaggaacaacaccaagagggaaaggagactatcacacaacaggcgagacaactactgactatgagaggcgaaaggacaacagcgtaactctaggagaaaacaaaaacaaattctcttatttatattaacacaacacaaacaaacaaaaaaacaaaaacaaaaacagaggggagaaagaaacaaagaaaatccaaacacaaaaaagagagaaacacaaacaaaaaacacaacaacacaacaacaaaaatatataaatgataacaaaaagaaagagagcaccacaaactaacaaaagagacaacgaataaatactataaaaaaaaacaaaaaacaaaaagcagcagagacaaatacaacaacaaaaataataaaaaaatgagaaacaacacaaactgacaaacaacagagaaacacttacataagaaaaaagcaagaacaaaaaaaaacaataccgatatgagagataacaaacaaccatattctgcgcaaaacaaccaccaaacacaatcgaaaaacaataaaacaaaaacaaacacagaaaaaacaaaaacaaaactcacaacaaacaaacgaacaaaaaactaactcacagtaagataataaaaaaccaacaaacgacaaatacaaaacgacgacggaaactaaaaaaaaaacaaacagaaccaacaaaggaacgcacaagacaaaaacaaaaacaacaagcaaatacactaacacacacagagcgacgacaaacaaacaacacaaaacaccacacaacacgaacaagacaccaaacagacaaacacaaaaaacaaaagcacaaaacaacacaacaacacgacaaaaaccaagacaaacaaaagaaaacgcagcaaaagaaccagaaaaacaagacacaagaaaaaaacagagagacaagcagaagccagacagcaaagaacacaacaagcccaaacggaagagaaaaaagcgaaacaaagagcagcaaagaaacaaacgaaacaagaaaagaagaaaacagaagatcaacaaacgaaagaagaggcaaacaaaggccgtaaccgacaccaccaacaacaagaagaaaaagaatagcagcaaaaaaggacaaaaaagacccaacaaaacacacacagcacaaagcaaaaaaaacaaagaacaagaagcagagcaagacaatccg

SEQ ID NO: 519424 - DNA, 640 bp, Homo sapiens
  misc_feature (640)..(640): n is a, c, g, or t
ccgcgagatgctacgggacgtcatcatgtgttcacgccttcgacagctgagagacaaaaagaagccgtgctctactactgatcagatatgtaattaaagaaccaattataaagcggaagacgagtctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgttctttggtaatcgtattgattagagtaggtaactgtcttggcttgaattttgtccctttaaaactgctgtacctgtatgataaagatgcagtacctttctcttaaaaaaaaatgctattggaaagctgtgagaactgaagagaaaatttggctgtgtcagtgtgcggttatgtcatgattactagaagccctgaagttgcctn

SEQ ID NO: 519425 - DNA, 221 bp, Homo sapiens
gcacaccagtatactttcattatgttgtatatatctatattatgtatatatattatattatgtatagattctgtgtgatatattatatattatatacatattatgtatatatatattgatatatatgtgtatatatattatgaatatgtatgtatattatgtatatatgtatatatatttatattcttccatctatattcacttaagtgggtagtcacaga

SEQ ID NO: 519426 - DNA, 169 bp, Homo sapiens
atacgcagggcaactctttttttctttttcttttttctgtctgtgtgtgtgtgtgtgtgtgtgtgtgtgtgtgatcacaaatagattgcgcctgtttcttgtaaggtattatttcgtgggaattatacagggttgtgtggggcttatgcattaacccatatggttctaa

SEQ ID NO: 519427 - DNA, 1420 bp, Homo sapiens
  misc_feature (41)..(41): n is a, c, g, or t
  misc_feature (114)..(114): n is a, c, g, or t
  misc_feature (180)..(180): n is a, c, g, or t
  misc_feature (307)..(307): n is a, c, g, or t
  misc_feature (326)..(326): n is a, c, g, or t
  misc_feature (448)..(448): n is a, c, g, or t
  misc_feature (558)..(558): n is a, c, g, or t
  misc_feature (598)..(598): n is a, c, g, or t
  misc_feature (624)..(624): n is a, c, g, or t
  misc_feature (747)..(747): n is a, c, g, or t
  misc_feature (901)..(901): n is a, c, g, or t
  misc_feature (1012)..(1012): n is a, c, g, or t
  misc_feature (1382)..(1382): n is a, c, g, or t
aggtggcaggtgcagattatataagattaatatatattatnatagtggacggcgacgggttgagcttaagactggccgaacagaactactcctatcaatagtttatcatatctnatttacagcgatgtcatttctcaccgtgtcatctggttgtgattatagcattatcgacaacgtaantcagtgtgtaacacgtattgagtgagctcccagcacatagatattatcttcacagacgacttggtatcagctgtctctggtactatgcatttgtggaacatctagatctatgattgcagcgaaattngtataagaatgtgtctacnactcttcagagagcactgtgatgagtacaccgcgctgacgtggaggacttgcagagctatttgcctagtacgtgatcttatgataatagcagggaccgcaccaatgaagttgtcgggcaagngaactgtcgatcgacattgtgtgtgtgtatcgtgagaagtgagaagtcgttgatgctggtggtcgatttgtgagcactgcgttaatgtagagttcgaaacgtaggatgcnttacaccgcgcaagagaggatgtcgcgtcactgattccanagatatatttatcactcgccgacgtnacataaatagtctctaatgaagcgtcattgcgggacgagatagatctgtacgacgcatgagcccgacattacagctagtccatttcgatcgtatgctcctgcagtgaggagtggtatttctgntatgaatcatgacgtatacatatctcgatatattagcacgatcttgacggcgtatgtataatcgtacgctatagttcacatttgcacggtatgattagacagagaatacctgcggttatctgagattcatatgtgtacgtgtgtcacgcagggncaattcgttgctatttacaataatagcacacgagtcgggcttattggacgaagcacgcaaggacgcagcgcacaggacgtaatatggacgaatagagtcggatgaagtcanttctccgcgcccgcacgcgtatcacgcgccgccgtcgattgcttgattttcgtgctcgcggccatatttcattatcgccgtgttaacaatattatattgctgtatcgcccgccccccgcatcttctcctgctattcgtaccatcacatttatgacactgtctatcggttcatgtctctcgtatcgtttgcgccctgtccctctcacctcgtatcgggctccgccgagtattgatatgaatcttatcgacacgctactagataataggcgcgagatattcagccgcgagatcttgttgtgtgtgagattgaagtgtggtgagtgcgcggctatagagggtggagaggctacgtatgatgattaggcatatntgcgctctgatcatgcgtgagctgatagtgtatatgtt

SEQ ID NO: 519428 - DNA, 394 bp, Homo sapiens
gcgaggtgatgctcgcggtggaaatgaggaatgagcaggcctgggccatctgggtggggagagtgggaaggaagatcagtgaagagatatacaacctgattgaaaagcccagaccccatgtttcttttctgcccttgccataggcaagttcaagaaagagaaccattccgtgaaagagcacttcttctaccagcaggtctagcacagacccgatgtgtatcctgtagcctcaagctgtccagaaagctgccatcagccctccctgatgtggggtgccggctgtccgggctgagccaccaatgcacaagacacaccctggcccaaagtgcatcactaagagcctctcacattcttctgcttcaaacaggccccggggtaccgcctggggcattcg

SEQ ID NO: 519429 - DNA, 437 bp, Homo sapiens
  misc_feature (60)..(60): n is a, c, g, or t
  misc_feature (182)..(182): n is a, c, g, or t
ggccgttccaacaaccacagggtgggaatgtaattttgccaaaatgactgacccggtaantccacccccgggtgtccatggtccatgaaagacaaggagggacctgggagggtgtccacaggttggaggagacctaaggagatatgaggaatgaatgcccatgtgggatccccggattggancccggaacagaaaaataacattgggaagagaattggtgacattcaaatggggtcttgagtttacttgagagtcttgtaccagtgatgattccctggttttgataactgtgcaatgcatggcatgtgggttgttgacattgggggaatctggataaagagtatacaggagtttcctgtatcacttttgtaacttttctgtaagcctaaaattattaatatttcaaaataaaatgtttaaaaggcaaaaaaaaaaaa

SEQ ID NO: 519430 - DNA, 306 bp, Homo sapiens
agagtgacaactctgtgagaggctctactgcactgagatgcactcttccgagtggggcacctaagtccagtgtacaatctggtgtgcagtctatggaacttttacctgcaccttctcctggcagcatggttcaagttgaggtgtctggccagctcattctcaccaacctctccctgacctcctcgggcacctaccgctgtgtggccaccaaccagatgggccgtgcatcctgtgagctgaccctctcggtgaccgaaccctcgcaaggccgagtggccggagctctgattggggtgctcctgggcg

SEQ ID NO: 519431 - DNA, 247 bp, Homo sapiens
gtggcgtgcacttgtaatcctagctactcagaaggctgaatcagaaaattgcttgaacccagaggtggaggttacagtaagccgagattgcaccactgcactccagcctgggtgacagagcgagactctttctcaaaaaataaaaaataaaaaacatattttgaccacacgagacaccattcttcctctatgtctttatgcaagagaaatgatccatatgttcatgtcaggatttatatatgatttt

SEQ ID NO: 519432 - DNA, 163 bp, Homo sapiens
cttattccccccggcttccctggggtaatttgtaccctctttggtcagcttatccacattcctccaaccgcgatgccaaaagattgaagaacgtttctccctacttcccggccctctatctagcccatcttaccacgatttgggcccccggtcccattgggtg

SEQ ID NO: 519433 - DNA, 108 bp, Homo sapiens
tgaacattcgttccagactgtctgtaactttacagatggtgcattggttcagcagacggcttagtctggggctcatctaaactagttccagtgggacacgaatgttca

SEQ ID NO: 519434 - DNA, 126 bp, Homo sapiens
gagtgtcttcaagacttaatgttaagggtacagacaccacgccaccctagtcagtgacatgtactccagcgtttccaggaagacctgggccgaaattgaccacagcgctgcaaaatgaagacctgg

SEQ ID NO: 519435 - DNA, 1695 bp, Homo sapiens
  misc_feature (763)..(763): n is a, c, g, or t
agcgggttttagcagaggcagatagtgaggtgctggcacagatgcccacggcatgccgctggactaagcgctaagctgggcttgaggatgatagcagcacgcagggggtgtctagagccagaccaaagggtgcctggtgctgcctgacctgtggaggcagctgcgtgcttgctgacgtggacagcacacaaggcctcagtcagaccctgacaggcatccgcacctgagggcagcaaggcccatagcacaagccccaatgaggccacagagatgtgacctagagcctgactatctgaaccgcgctgccacagtggcagtgcggagcaacgatagtaaggaacgagagatgacgtgcaggacggactgagggacctggtgacactggcccaacatgatggatgggtggactggataaaaaagacctcctagaaaaagggttatccctatcatacaagtgatattccatattacacagatgatagacctgacccaatcaacactgagcatcagacacaccttattgacagtgaaagagtgcgccattggaaagggagacagagactctacaaaagtgtgcaaccccgacgagacaaggaaaagggcccagataccgtcggacgacgccggacgcagagaaccagaagcgatggatgacatccaaacggacgccaccccaagacgggggagaaaaaccaggcagcagggagaagaaacacaggcagacgagaccgactacaccccatccatacacaacaggcgaaancaaacacgaaaaaagagacgaaggcagacaagatatacttcagacaaacacaggacaatatcccacacacaagcacggtgaagcaccaacacacccttcaacgaacacgttatcgcaaacacttataaaggcaacaaccatatgggatttaccagggaccattatgggacgctacaagcagaccgacactgtgcactattgtaccaccattaggtgacaatttactggaaagtccatacagtacattcaaagcgcgcagcgtgcaagcacgcaaccacagcccgttacccatcgagcggcaagagaacatatagaggggcaaaaactattaccatacacagagaagccaatgcggccaatgcacgtggcgcgcatatcacgaagagataggccacaccagaccgctatagccggcacagcccggagacacgggaagacaacaagacagacccacagacagacagacaacaaacgacaaaagaaaccgactggcaacacgcacagcaccaacaagcagagggacacaggacgcacaggccccaacacaccacggaacttagactccgcacacacaccaatagagaatagaaaaccagacaccacagcaaggacgagaagacacacaacatgcagagacacaacgacggaccataaccgagtacagagccatacccgacacacttcgagaaccccctacacaggagcgtcacggagggacgccacacaatgcccaccctaagagcatccacagcagagaggcacaacaagagcaagagaaagcagacagcaggagaccacagagaagagaacaaaggacagacaccaagagcacacacacagccgacggcgagacagcgacgcacgacaacgcagccataggcgagccactatgaagcagacagacgcgacgccggagagacgccaccaacgcg

SEQ ID NO: 519436 - DNA, 339 bp, Homo sapiens
cgtccgcccacgcgtccgggtggagttatcaagatccacattccactcatgggttttctacaagacttgttctccctttttctttttttaaaaaaaatcctccctgcgtctttgtaaaaaatgcagattaacggagacctcactgtttgaccgatgtaataaaagggagcattgtgtcgctgctacatccccaaaaataagtctactggacttgaatggaaccagaatcaccgggacatttttggtacactactcttgttctttgaatgagtgcttcagaatcagaaatgtaagctgttctgtatcaaaactattcaagcaataaagatatattaaaga

SEQ ID NO: 519437 - DNA, 116 bp, Homo sapiens
  misc_feature (15)..(15): n is a, c, g, or t
tctagaggatcccgngtaggagaaagaaaggtgtgtcccatttgcttttaaaacccagccctgtccaaggggcagctcttccaatgcttccatgtgagtgattacagaccaggaag

SEQ ID NO: 519438 - DNA, 303 bp, Homo sapiens
gagacagcgggagacagacccgaaggcatttcacagatctttgagtctgcccctcccatcacaggccatcacaggcccacaggcctataagggcacagtgatttcaagggaggtacccaatgcacactccacaggcttgctgccctgggccaccttggaactctgctcccaaattctggtgcagtgtttcttggccactctaactggagttcaaatggcctgaggtgttaagtaagccttggcagtgtccatgtggtgctaattctgcaggcttgcagaaagcaagagctgtggaggcttgtc

SEQ ID NO: 519439 - DNA, 682 bp, Homo sapiens
  misc_feature (17)..(17): n is a, c, g, or t
tttcaggattcactctncttctgttagtcaccatcctggtaaatagagggttcgttcccaggaaggcgaataccccatcccggagacatcgcccgagttcgagagctcgacctcctcacctcttctggagctgtacatcatcttcgccctcatggctccccttacacctcccaatattacctcaccctacgcacacgcacccttcgctcacccccctgttaccatcccccctcttcctctttcccaactcccctcttccccccccacctctccccctcccctatctgcccctctccgatcctgctcccttgcttatcccgcccccttcacccctcttcccctatccctgcctcctccccattccacacccctctcgctctatcacccacccctcctctcctcctctcctcccacagctctctcccacgtccctcttctacacttcctcttcccctccacctcctcctccatccactccctctcttccccttctccttcctcctcttctacactctctttcctcctctcctcgcctcccccttcccttctataccccctctcattccttccctcctccccccctgccatccccgactcactcctctctcctccttcccccctccccccctcctctactactctaccacccagcccctttcctctctcttctccctcccccccg

SEQ ID NO: 519440 - DNA, 258 bp, Homo sapiens
  misc_feature (43)..(43): n is a, c, g, or t
  misc_feature (53)..(53): n is a, c, g, or t
  misc_feature (76)..(76): n is a, c, g, or t
  misc_feature (109)..(109): n is a, c, g, or t
  misc_feature (182)..(182): n is a, c, g, or t
  misc_feature (214)..(214): n is a, c, g, or t
caagaggctctcctgctgcctgtacaagcccaggatgtacaantacacgtcangccgtttcaagacccgtgcgganaggaggtgaagaaagcagagcacgtagcaaggnttgctgaagagaaggcgcgggaggcagagagcaaagctcggtacattagaagtacgcctaggtggagacctcncgcgggactccagggtgatgttgcgacaggtncagaacagagccatcactctgcgcagagatgccgatgtcaagaa

SEQ ID NO: 519441 - DNA, 102 bp, Homo sapiens
acgtgatggggggccacaaacgatgtcaactatgctgcacccttgctcccatcactgctaccagcacggtaggatcagcacagaaacgctcacaatgtcacg

SEQ ID NO: 519442 - DNA, 281 bp, Homo sapiens
agacagctcacaggacatgcagtcacagtagcgggagcaatcacaaaactgtaatttacttaccaaatctactatcctcatccgtacgcctcgcctgcctagaacttagacgaaagacaagcaataattatatacaggcattttgcaggtgtctcttatgggttctttctagtttgaaacggatatttgtcgcaaaaaaagagcacaaccgttttaaataaactccccctggaaaaaaacccacaacactggcatctgagtaggaaataaacaatacatat

SEQ ID NO: 519443 - DNA, 352 bp, Homo sapiens
tcgttcttgagtataccccgtgctccaccgcacccttagctggggatcacctcacgaagtgtcatctctctctgatcacgcattccctctcagtcatctcagactgtcatatcgtttgacgctggggccgataggcctgtgaggaaaggtgttctgcctgtcattagctctggcgctcgtcggcacctgctgaaacgcccccacctgacagccccctcctcaaagactgtcttaattactcttggcccgttctagagacttcaggggaaaagctgctttcaaggccacccacatgtctgtgctccccatccagctctatctgccttgtgttcatttagttatttcgtgccgt

SEQ ID NO: 519444 - DNA, 94 bp, Homo sapiens
gcgatcgacgcagagcgacggatggcagtaagtgaaagcaagaaacagcgacgaaacggactcagaggacgggtgagaaagcagcacctcgctc

SEQ ID NO: 519445 - DNA, 253 bp, Homo sapiens
ggggtttttggggggttttcccccccaccccttccacctttttttgggtttttggttttggagggcccccccggccttttttccctggccggtccccgggggccggttcccgcttttctggatgggttttggggcccctcccccccccccccccccccttttcatccggtttgtaccctttggggccctttttggggggcccggccccggccctgggaaggttttttggtcccttaaggccgggggttttcca

SEQ ID NO: 519446 - DNA, 113 bp, Homo sapiens
tcgtaggtggaattccaggacacggaatgtacctacttctccacaccgctgctgcttgggaaaaagggcatcgagaagaactggggcatcggcaaagtctcctcttttgagga

SEQ ID NO: 519447 - DNA, 174 bp, Homo sapiens
gagcaaacgccacagatggtagcacaacccacagcaggagagagttagacaggaatcctactgtaatctattatgtgactatgatgtatagatgaacacctttaatataatgatgacaggatgttcccatatgcatggctgtatcaatttaaacaatctagatacaatgggcat

SEQ ID NO: 519448 - DNA, 153 bp, Homo sapiens
tgcttgcgtatcccacggtctatgacaccgttgttccctagtgaccacatgtggaaacaggctgctgtctgttgatgggtgcatagaccaacaatagtgtccgtacataccatggcagtattactcagtctggaaaaaggaaggacattctga

SEQ ID NO: 519449 - DNA, 217 bp, Homo sapiens
cgtgatggtgggcatgatcgagagaattgcacaaaagagcgataggccgcatcatccccaccatcatagccgaccatcaccctcgcgttaagccgctagcgttctacctacgccgtaatctactccacctcgaatcacactactccccatatctgacaacgtagagatgaaatgacagttgtgaacatacaaaacccgaccccattcctccccacac

SEQ ID NO: 519450 - DNA, 670 bp, Homo sapiens
tgatggagaacacagaggactggcggccgcggccgtggtacaggccagatcgcggttccgttccgcatcctatcccagctcacaggcaccgagttcatgcaagacccggatgaggagcacctgaagaaatcaagccaggtgccacaggacgagaagccccagccccagcctcatctacacgcccagtgagccctgtgcctggccctagcggaccccagcacctaccagcgcgacgccagcgcctgggctgtggagccctgcgtatgcctgagcagcatatgccaccggacaagaacgaggacaagcagatgctgatcccgggcatcaagtagcagacctagacgcattgccacactgcatagctgcaaggagccatgaaagcatcacatttggtgcagggcagcgtgccgtgtcagggggaatgcaccagggtaagggggtgtatgtcatatacagacgggcgaagcgacctcaacctgatgtttttcaacccagatgtcaaccatatggatcaataccgaggggcgctgcattaccaatggatatgtccgcaatgatgaccaacagcaggataacctatcacggtgtcgaaggataatgaagatgaagacccaagtgttggtagaagggtccttaggtaaaagggaataggataaatatgagaacaact

SEQ ID NO: 519451 - DNA, 106 bp, Homo sapiens
tcattgcaggataaactgccactaacaaaaaggaatgatctgatttagaacaaggatattcgttgtggcaaattaacatttgccttcttccttcctttataaattt

SEQ ID NO: 519452 - DNA, 105 bp, Homo sapiens
atcgatcaggactggtgacctgggagatcggctagcgggactggttccagctccttcatgagaactccaaagcagaaatggctcagacagcagtgtagccgggcc

SEQ ID NO: 519453 - DNA, 362 bp, Homo sapiens
  misc_feature (203)..(203): n is a, c, g, or t
aaggatctcactcgtgatcactgccagctccagatgctggatacaggtgtaacactgtgccggcgaagtcagtttaacatttaagttacttcccattggaggtgttgctccctttcaagcacttccaaggaaagcacttgccataaagtctgttaagcagattggcgggttggaatttagtgggggcatcagatgctgctganttgtattctcacattctttctcctgttgtgaggggaagagagtgtggaagaggggtggtggagtgttggcactttgaaccattacagtttcaccctaggcagtaactccctgagctgttttattctccaaagtgggaatatctggttagggatagctgt

SEQ ID NO: 519454 - DNA, 630 bp, Homo sapiens
  misc_feature (3)..(3): n is a, c, g, or t
  misc_feature (10)..(10): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (22)..(22): n is a, c, g, or t
  misc_feature (28)..(28): n is a, c, g, or t
  misc_feature (30)..(30): n is a, c, g, or t
  misc_feature (63)..(64): n is a, c, g, or t
  misc_feature (69)..(69): n is a, c, g, or t
  misc_feature (72)..(72): n is a, c, g, or t
  misc_feature (77)..(77): n is a, c, g, or t
  misc_feature (120)..(120): n is a, c, g, or t
  misc_feature (125)..(126): n is a, c, g, or t
  misc_feature (134)..(135): n is a, c, g, or t
  misc_feature (140)..(140): n is a, c, g, or t
  misc_feature (148)..(148): n is a, c, g, or t
  misc_feature (155)..(155): n is a, c, g, or t
  misc_feature (172)..(174): n is a, c, g, or t
  misc_feature (181)..(181): n is a, c, g, or t
  misc_feature (188)..(188): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (210)..(211): n is a, c, g, or t
  misc_feature (223)..(223): n is a, c, g, or t
  misc_feature (226)..(226): n is a, c, g, or t
  misc_feature (232)..(233): n is a, c, g, or t
  misc_feature (236)..(236): n is a, c, g, or t
  misc_feature (238)..(239): n is a, c, g, or t
  misc_feature (241)..(242): n is a, c, g, or t
  misc_feature (244)..(244): n is a, c, g, or t
  misc_feature (247)..(248): n is a, c, g, or t
  misc_feature (260)..(260): n is a, c, g, or t
  misc_feature (267)..(267): n is a, c, g, or t
  misc_feature (273)..(273): n is a, c, g, or t
  misc_feature (285)..(285): n is a, c, g, or t
  misc_feature (297)..(297): n is a, c, g, or t
  misc_feature (318)..(319): n is a, c, g, or t
  misc_feature (337)..(337): n is a, c, g, or t
  misc_feature (352)..(352): n is a, c, g, or t
  misc_feature (370)..(371): n is a, c, g, or t
  misc_feature (374)..(374): n is a, c, g, or t
  misc_feature (395)..(395): n is a, c, g, or t
  misc_feature (402)..(402): n is a, c, g, or t
  misc_feature (415)..(416): n is a, c, g, or t
  misc_feature (431)..(432): n is a, c, g, or t
  misc_feature (437)..(437): n is a, c, g, or t
  misc_feature (440)..(440): n is a, c, g, or t
  misc_feature (442)..(442): n is a, c, g, or t
  misc_feature (447)..(447): n is a, c, g, or t
  misc_feature (462)..(462): n is a, c, g, or t
  misc_feature (465)..(465): n is a, c, g, or t
  misc_feature (472)..(472): n is a, c, g, or t
  misc_feature (475)..(475): n is a, c, g, or t
  misc_feature (483)..(483): n is a, c, g, or t
  misc_feature (491)..(491): n is a, c, g, or t
  misc_feature (495)..(495): n is a, c, g, or t
  misc_feature (510)..(510): n is a, c, g, or t
  misc_feature (513)..(513): n is a, c, g, or t
  misc_feature (516)..(516): n is a, c, g, or t
  misc_feature (528)..(528): n is a, c, g, or t
  misc_feature (537)..(537): n is a, c, g, or t
  misc_feature (554)..(554): n is a, c, g, or t
  misc_feature (615)..(615): n is a, c, g, or t
tgnatggtcnaaanangngggnaatttnanaaaaaaaaaatttggttcaaaaaattccacccnnaattnttnaaaantttccgtaaaaaaaaaaaaaaaaaaaaaaaaaaaaaaaaaaanaaaannaaaaaaannaaacnaaaaaggnccccttnaaaaaaaaaaaaaaaannnaaaaaanaaaaaanttttnananaaaaaaaaaaaanncgactgtaaaanctnaaaaannaanannannanaannaaacaaaaaaanaaaaaanaatttnaaaaaaaccacnctggggaaaaanggagccatttttttcaaaaannggcccaaaacacaaaacngcccaaatgtccaanagccccaggggtttgggnngcncagtattaaggggggagaggngaccganagcctgtttgaannaggcttgtgagcccnncccanctnanaactncaaaaagcttccccnccnaaacatnccnccgtttancaaaaaanaccnctttacgctatttanaantcnccttttggccanattttgaanaacaaaaaacaaaaaantccgcagatttgagtgagattaggaaagaaatgctttcttaagtaacttttttttttttcngtgaagaatgaattc

SEQ ID NO: 519455 - DNA, 236 bp, Homo sapiens
taattctcaggcacacccttagaacaaagctacgccaaaatccgtttcactatcatattcatcggcgtaaatcgaactttctttccacaacactttctcggccatatccggaatggcccgacgttactcggactaccccgagtgcatacaccacatgaagcgtcctatcatgtgtaaggctcattcatttctctaacagcagtaatagttaataattttcatgataagtgtgatag

SEQ ID NO: 519456 - DNA, 578 bp, Homo sapiens
  misc_feature (67)..(67): n is a, c, g, or t
  misc_feature (224)..(224): n is a, c, g, or t
ttccctcccaccgggtccttgggcgggcaaaagtcataagccaaacaggcatgtgccaggaacaggntccatttggggcagtcctgacccctataaaagcgggtattgataaacctcccaacccaacctcattcactaggatgagaggcagtctctcacttaaagattctcacagcctaaagcataaatgtccccccccccattggcttcaaatgctttcttgnaaaagctcttctttccataaataaacttactttaaaaacaaagttgacctgcatctattcgaaacaagaattagcttagatctcaaactcaatccctgcaggctgtcattatccagcgggtcgttgagtaaaggcaccatatttgtggctttggacaaatccaattccctcctttaagggaaagagtttaaatcatccaggccccggcacattaccacaccaatgataaattcggcagctttctggctccgtttaaattaagcccagtcttcaagtacttgttagccacccttaaaaggtccaaagcttaattttttgctccttaaacccaaaaaatcttccagccgggggtca

SEQ ID NO: 519457 - DNA, 126 bp, Homo sapiens
acgcgacgggttgcgacctacgtcctgaccctgagcgctgccgccgggtcgccgagctcgcggtcaaccacgcccggctgcgccacatcccggtgcacgagcgccgcatcgcgatcatgctcagcg

SEQ ID NO: 519458 - DNA, 487 bp, Homo sapiens
  misc_feature (102)..(102): n is a, c, g, or t
tcagagggcgtccatctcagtgcagagtcaggcggctgcttcatcgctaccgcggtgtcacgctgatgcagtggcccctctggctgccctgttcttcttcantgctgttgctgcttggtctcgacagccagtttgtaggtgtggagggcttcatcaccggactcctcgacctcctcccggactcctactacttccgtttccaaagggagatctctgtggtcctctgttgtgccctctgctttgtcatcgatctctccatggtgactgatggcgggatgtacgtcttccagctgtttgactactactcgtgccagcggcacccaccctgctctggcaggccttttgggagtgcgtggtggtggcctgggtgtacggggctgaccgcttcatggacgacattgcctgtatgatcgggtaccgaccttgcccctggatgaaatggtgctggtccttcttcaccccgctggtctgcatgggcatcttcatc

SEQ ID NO: 519459 - DNA, 113 bp, Homo sapiens
gtctgccccccagggaatgccggcactatgttgagaggctgctgttacctgaccatcccgccccaggcaaccccatctattttgaggggctgctgttacctaagcagtcaccc

SEQ ID NO: 519460 - DNA, 141 bp, Homo sapiens
ccttttagtgatgggcgattcaggccatgtcatagggcctttcagaacaaaaggttcttatcccagtcagtgggccaaaacattaccttgggatttcttacccgtgctacagcatcttctagcaaaggcagggtaccgagc

SEQ ID NO: 519461 - DNA, 677 bp, Homo sapiens
tggttaccaggggtgctaccctttatgggagggggtcttaggagaaaaaaaagggtaaaaaagggaaaaagcttgaataaaaagagggccaggaccctaggggtgccagagccatagtcacggggccaaaccgccctataccacccaggccgggacaaagggtatggggctcggggggaggaatcctagggccgggggcctcaagactcaagtcggcggggcctgcaagggggctggggagaggggcaggtgtgtcctggctcataaggggaagaggctgtgaggactgtgtgggagagtgaatggccagtggagaggaggatggggcagttcttgtgccccgtggtgtccctgatgcttgcctcccaaatggcacagtccacatgctccccatggccctcaaagggagaaacgctatagtgtgggattgggcccccggaatatagaagatgaacacctgattgagatgggggtcggagcagggggctgctgagtgtgtccatggcttcacacttccctttctccagcctcctcagttccagaatttggaggaagctgtccccaggaatctgtgggccacagccatcccgaagggtgactcccaggagctccacctgttatcggggcagagaggtgccaagctcaaaatttggatccagacttgattaattctatac

SEQ ID NO: 519462 - DNA, 954 bp, Homo sapiens
  misc_feature (264)..(264): n is a, c, g, or t
  misc_feature (809)..(809): n is a, c, g, or t
aaacgatggcatcgccagcatctgaatgcaagagcctggaaaatcttcaggggctgatgtgagccaatgtgaaccaaggaccgatgttggcagagacaccggagacaagcgacacccaggcagcacgcaggctgaatcgtctggctgtgtctgcattcaactagcgtgatgcataatgttgtagaccaatgatcaccgcatgtgcatagcatgttggagaaagaaggtgcggttatagaaaagcgaattgagacaccatttaanaaggaagggatgcctatggagattctgatgacgcgaaagtgttcagcacttgtagtaatagacattgggttgtcaattttgtgggggacagatgtacacaaagatgaatgggaggtggatactgagtagtcgtcacaattgattgagaatcgtagggggtctcgagtgcaccccatactactaagtattgctaggctaggggtatcccggcgactcacttgatatagaggttggacgaagagggactaaaagaggggagacagcatgcactccacatggacggggactcgttgtatactacggatagaatggggctctaagatttccgtcttcaagggactcaaaacaaaactgcaagggatggaacacgcacttattaccaagcgtagataacgtgacacattgccagtgcatgatccctgggtgtgaggcatttcaaaatggcccaggcacttcgggtgtggtacgcttcatctgatcgagcacctgtcgtgacatgcaccttgtctacacgtcactcactgaccacctcacttggactacanaacagggcggaaatttcgcagtgtccaactaggacgttcacaaagaccattccttgagaaccattggtggtctataggacaacaggcatgcactgacatattaacactcacacattgttagactcaaagaggttccttgggtggc

SEQ ID NO: 519463 - DNA, 330 bp, Homo sapiens
  misc_feature (24)..(24): n is a, c, g, or t
  misc_feature (29)..(29): n is a, c, g, or t
  misc_feature (253)..(253): n is a, c, g, or t
  misc_feature (278)..(278): n is a, c, g, or t
  misc_feature (323)..(323): n is a, c, g, or t
gaattcggcacgagctcgtcgctntgtancaggcagtgatcagtgactgacaggcgctgatcagggaactgtgcacgcaatgatcaggtggctgatcaggaactgaccgcctgaccaggcatgcagtgatcacgtggctggtcgttcactgatcacgtgtttatcatacggtgatcacgtgactgagaggcgctgatctcgtgactttgccgtcagtgatcacgtggctgagcaggcactgatatcgtgactnagcatgcactgatcatgtgccgggngccggggaggcattccactctggacaaaggtcatgaggaagggtngtcggca

SEQ ID NO: 519464 - DNA, 161 bp, Homo sapiens
gcgctctagaggatccgaggtaatggtgatccttgggcatccagccacacctctgcctacaggttcctccaggttgacaggttggtgcctctcctccctgcgccagctgttccagctcctcagcttccaccccacccctcccagattcttacccctagaca

SEQ ID NO: 519465 - DNA, 1327 bp, Homo sapiens
  misc_feature (388)..(388): n is a, c, g, or t
  misc_feature (472)..(472): n is a, c, g, or t
  misc_feature (568)..(568): n is a, c, g, or t
  misc_feature (612)..(612): n is a, c, g, or t
  misc_feature (621)..(621): n is a, c, g, or t
  misc_feature (719)..(719): n is a, c, g, or t
  misc_feature (725)..(725): n is a, c, g, or t
  misc_feature (729)..(729): n is a, c, g, or t
  misc_feature (761)..(762): n is a, c, g, or t
  misc_feature (791)..(791): n is a, c, g, or t
  misc_feature (798)..(798): n is a, c, g, or t
  misc_feature (802)..(802): n is a, c, g, or t
  misc_feature (816)..(816): n is a, c, g, or t
  misc_feature (826)..(826): n is a, c, g, or t
  misc_feature (829)..(829): n is a, c, g, or t
  misc_feature (848)..(848): n is a, c, g, or t
  misc_feature (876)..(876): n is a, c, g, or t
  misc_feature (883)..(883): n is a, c, g, or t
  misc_feature (913)..(913): n is a, c, g, or t
  misc_feature (922)..(922): n is a, c, g, or t
  misc_feature (959)..(959): n is a, c, g, or t
  misc_feature (1038)..(1038): n is a, c, g, or t
  misc_feature (1071)..(1071): n is a, c, g, or t
  misc_feature (1085)..(1085): n is a, c, g, or t
  misc_feature (1115)..(1115): n is a, c, g, or t
  misc_feature (1134)..(1134): n is a, c, g, or t
  misc_feature (1149)..(1149): n is a, c, g, or t
  misc_feature (1151)..(1151): n is a, c, g, or t
  misc_feature (1193)..(1193): n is a, c, g, or t
  misc_feature (1249)..(1249): n is a, c, g, or t
  misc_feature (1272)..(1272): n is a, c, g, or t
  misc_feature (1289)..(1289): n is a, c, g, or t
caacacgtgtccgccggtcgttggacgtataaggtaacatgactaccccaacaacgattccctggtgatagatagtgctgtgaactggcatcttgcacagtcgcaacagttctgtggcaaggacatgcttagtaccatgatttggtaatatgctcgtgacttcgaggcaacactgctgaccatgccatgtgtaactatgcgatatgccaattctcggaatggggcgcagaagtggcacagtggagtagacaatggaccatttagaggtgtgagggtatgactcgtattcacctatccaatcgaactcggttcgggatctcaagttgagcgaccatgtgtggagaccttttgcgccaaagtccacttgtccgcctccacaggagcaaanttgatatcctgtgaagcaccctttgtgaaaccaccccaccatgaattccatatcgcaattgacattcgttctcgagctaagccntagatgcaaacacaataatcgtcttgcttcgatgcgttcacttaatcgcggatctccccattagaggaccacccctggtgtatctcctaagcaaanagagcggagcacatgaagacgagtggccaatccgctcccatatncctagaacntaactgtgtcactccgtgattggtgtccgatccgttatcttgcaaccaaaattctgggccagagatgcgcatagaaatccgagtaattgaaggccgantcccgnatgnatatacgcgacccgcccgataccattgcatgnncaaaaaagctgtgtgtttcgccagtagcntctaatngttngtctaccaggttgntctattcccnacncgcggggtcttatacctgntcgtggtcctattacaccaaccaaaggntctccangtgcagttcggcgttgccggtggacctacntcaagaagntcatctgaaggaggaagtttaccactccctcctagangcggtggacttgccaactagcggaaaacctcggttaccttacactaccgaacagttgtaaggaatctccattcgggcgncggaaaaacgagaaacatgtttacaccaaaaancgagccttccgcgnaatcggtcctacgttccggttgacattatngtaaccacgcgggacagancgtggtcccgccccnanagatgttatgtgtgctccaaaacgcaaagattcggccgaaanggtgtacagtaaggacgctcctttacggaagaagttctcgaaatactcctaccagnagcggaaacctcagagtgagctncaatactctcctcgggnggagatgggggccatcccttcgcttttggacatctcgg

SEQ ID NO: 519466 - DNA, 231 bp, Homo sapiens
tgtggccccctgtccccaagacacttccccttgtttcggtggttgcctttcttgccccttgtcctgaagcccagcgacccaccaccggtttgggcgggtttatttcctttaacgccccagggtcacagaagggcatgggttggccgggtgggcttttggggccctctaaggtgggttttcaccccttagggcgccggcagcttccaaaaaaaatttattttcttcacggga

SEQ ID NO: 519467 - DNA, 114 bp, Homo sapiens
ctcggctctagttatgtctgtagcccaaaaccaaggcccgagaccaggtccaagcaatgaatgccaggtcagaggaggaagccctcatctgtggacctggttcttggtgctaca

SEQ ID NO: 519468 - DNA, 1147 bp, Homo sapiens
ggagccattgtggctccggccggttgcgcggtgccctcgtgaccctcagggtaggcgagggttcgagggcacgagttcgaaggccaacctggtccactgtggggttccacaaacaacacaacgaaacaaactaataacaacaaaaattgttgggggcgcggcacatggagccacttagaaaaaagcggttttaaaacaacaatggtggtggggggccggcgggggggaccccacagacaagtcgtgagagggaccagtgtgtcacaacacaggggtgttccccacaagaggaaaaccctgtgtagcacagacaaacaatgggctggggcatctgtccacacacaactataaaaaaacggccccggggggggccacacccgagacgttttcgggagacaaaaccaccaaaaaggagagagcatacagaggaggaccacaaaccgcggggggtagtcaatcaaacaccaggggggtgcacaccaaggagaggaaggccggaagaacacaaaaatattagacgcccccgcgcagtggtggtatcaatacagagaaacaaacaggaagaacgaacagcacagaagacacgagcaagacaacagaaaagtaagaaaataagaggaaagaagagaagaagggagaggaaagaagagagaggagaagaagaagggagagtaaagatggagtagaaggagaacgaaagaaagaggagagaatgggggagagaggaagaaagaagaaagggagaaagggaatagaaggagaaggatagagggaaagaagaaaaagggaatgggagaatagagaaagaggaagaagaagaaaagggaaacggagaaaaggaggggaaaaggagagaaaaagggagagaagaaagagagaggagaaagggaaaacaaagggagagacagggaagcaagcaggaggcgaggagaggaggaaagggcaagaggagagagaggtagaggaaggaggggaggacggacggaagggagaaggaaggcgagaagaaaggaaggaagcagaggagagaggacggcgaagaggagcgagagagaaggaggagtcgagggaaggaagagaggaggcacgaaagaggagggtagagagagggaggagggggacagcgaggaaggagaagggagaagag

SEQ ID NO: 519469 - DNA, 213 bp, Homo sapiens
gggtaaaggggcctttttaaggacccgggtttcccccccccaaaaaatttggggtttttttttccggggaggggccaatttttttcccccccctttttgggggccgggggggccccttccttttttttgaaagcctttttaaaaaaagggttcccccccatttcccttgggtttttttgcccggggggttaacgggcccttttttccctttta

SEQ ID NO: 519470 - DNA, 184 bp, Homo sapiens
gcacatactacaatgtctgaacctgcggttcctctcgtatgagacaggattaccatggcacaacacatcatcagatagggtaaaactaacctgtatcacagaaggatcataacccagctcacgttccctattagatgggtgaacaaaccaacgcttggtgaattctgctatcacaatgatagga

SEQ ID NO: 519471 - DNA, 339 bp, Homo sapiens
gcagctgctctgtcacctagctcgctgggctaggttccgtatgggtcaacgtaagtcctgcaatgccacctatgtccctttagcttcttgtgcacactggtgggtgcgcgtcccccggtggggcctatgagcctctgggacccggaagacgtctctgttcctgtaggcggcgagcaccggggtgcccctgccttgatccagcccatgactaagggcagagctgacccatgcctgttgggcactcacctcctccaggaacagcctgcgccgcctccagcctctgcacccgcttcctgcatggccttctcatctctcctccaggagaacgtcgtaaaatcg

SEQ ID NO: 519472 - DNA, 380 bp, Homo sapiens
gaactctgcgcgggtactagaacgtctgagcgtgagagttgagaatccctgctgtgtactagaacgtctgagcgtgagagttgagagtccctgctgtgtactagaacgtctgagcgtgagagttgacagtccctgctgtgtactagaacgtctgagcgtgagagttgagagtccctgctgtgtactagaacgtctgagcgtgagagttgagaggtccctgctgtgtactagaacgactgagcgtgagagttgagagtccctgctgtgtactagaacgtctgagcgtgagaattgagagtccctgctgtgtactaaaacgtctgagcgtgagcgatgagagtccctgcagtgtactagaacgactgcgcgagagagttgag

SEQ ID NO: 519473 - DNA, 251 bp, Homo sapiens
gtgtgctctgttgtcaggaagacaggcttgagatgagctggcgctgacatccacaccttatcatagggatggattagggtaagttatgtcatgtactctgagcctcactttcctcatggtaaaatggatataaaatacctgccagtggagggttgttgtaagtagacctggaacatgtaaagcacatagcacttaccatattttcctgtgtctttcacagatttatcatagaatccccgactcagacccat

SEQ ID NO: 519474 - DNA, 166 bp, Homo sapiens
ctctatactctagctgataaaccatccaaaaataattataaattaagcaataacaatttacactaggatcaaaaacaaatactaaacaataaatttaacaaaagaaatacaaaacttatcttatgaaaaaatatgggccaagcagtcgatcgcaaccggtagagga

SEQ ID NO: 519475 - DNA, 382 bp, Homo sapiens
tttagagacagctctgaacacagaatgatttcataatcagggacatttttgagacaggagacttcatggttccaggctttgagtgaggtggagaactcctaaaggacccacccaggagatgacactgcctgaacagataactgcccctgtcgcctcccactccactctacagcgacaccccttccacagcagtcagctgttttccaggtacaagagacacctcaccaccctggccagtttacagaccagctttcgagcccagaaatttccctgtaggaaatttgtaaggaccactggctcatggggaggaaataaatcaataaaaggaaaaaaaaatgaataatactgtttttttaaagagagaatgcaatcatccttttct

SEQ ID NO: 519476 - DNA, 445 bp, Homo sapiens
gaccaaagtcactgggtaatatgaatttttcaagctccattataatcttatgggaccactgttgtatatgtaatctgtcgttgaccaaagttttactgtgtagcacatgacttgcttagaaggaaggatcaactatgtaaataatgaaggaggaggccgggtgcattggctcacgcctgtaatcctagcactttgagaggctgaggcgggcggatcgcttgaggccaggagtttgagaccagctgggccaacatagtgaaaccctgtctctactaaaaatacaaaaaatttagccaggtgtggtggcacatgtctgtaatctcagctactcaggaggctgaggttcacttgaacccaggaggcgggggctgcagtgagctgagattgcaccactgcactccatcctgggtgacagagcgagactgtctcaaaagtcgacgcggcc

SEQ ID NO: 519477 - DNA, 614 bp, Homo sapiens
gtggagctgcggctgcgggaggcactgttccttagctccgccgcggccgtcctccgcggctcgatggactccgcttccttccctcccctcccctgcgctccgtgcctgtggtgtctacggacgctggtggtgagctgtgacgtggaatgtgtgacgaagtgatggacgtacggtgaacactgcgtgtggtgacgggtgcggaagtggtcccgtgtgcagaggtgttgatgtgcgatggggcttgcactctatgtatcctccacagcactgctagcctgcaccgttgcataccatagtgtacgtgagttgcctggctggtgcccaagaaagtgctgctgctcgtgggtgccttgccctgatcttggcccaccactggccagcattattggcaaagtggcatgaacattgccctgggtgtcctagcctggataaacatgtgacggatagcactgggggctgggtatgcggatgatgaatggccaatgtgccggctttgcaccctggcacgattgatccacaacagatggttccgtggtgtccctggttcgtgccctggtctggacccctccgcgaatcttgcggccatgcgcctctccactccccatcatacccac

SEQ ID NO: 519478 - DNA, 186 bp, Homo sapiens
ccaaggagtctgtcagcagagataattttaagagaatcagtttcctgattctcaccttccattctactctctcctaaagttgatctacttgagactccctttagctgttaggtgatagcattgtggttttaatttatgtctctaatgactaatgatgttgagcatctcttcatgtgtgtatagcca

SEQ ID NO: 519479 - DNA, 646 bp, Homo sapiens
  misc_feature (42)..(42): n is a, c, g, or t
  misc_feature (114)..(114): n is a, c, g, or t
  misc_feature (130)..(130): n is a, c, g, or t
  misc_feature (135)..(135): n is a, c, g, or t
  misc_feature (151)..(151): n is a, c, g, or t
  misc_feature (163)..(164): n is a, c, g, or t
  misc_feature (168)..(168): n is a, c, g, or t
  misc_feature (170)..(175): n is a, c, g, or t
  misc_feature (187)..(187): n is a, c, g, or t
  misc_feature (189)..(189): n is a, c, g, or t
  misc_feature (193)..(193): n is a, c, g, or t
  misc_feature (275)..(275): n is a, c, g, or t
  misc_feature (280)..(280): n is a, c, g, or t
  misc_feature (404)..(405): n is a, c, g, or t
  misc_feature (471)..(471): n is a, c, g, or t
  misc_feature (482)..(482): n is a, c, g, or t
aagctagaatttgccccgaaagctgtgctgaacagaaaccgnccagagaagaattaatggaggacacagggccctatggtcctactgtgggtggtgacttgtcctgctaccatnttgacagagcccctgnacccncatctaattggctttnttgcttattctnncccnannnnnnccacacagccananaaanactggctgctccttgatggccaggcagacccaccagcagccgagggggtagtgaagaggaaggccgcatctgttgtgtggtngccanaagcactcaggcatctgagtttactggtgcactgctgggaggagagttatgagatgaacattggctgtcaatctctgtgggcaggcggtttggcctctagtgggaatggctgggatttgggcgnntgcctttaggagggatacctgcatgtctagttccagtctgcactggaaagaattcaaatatgcacntggctcccttnactattttgccctatcctttgtgctcattcttactgaaatctgtcttgtcagctcaggaatgggattcccccaggaaggaaagcacttttcatgttctgggaagcccagactgttcagctttggagcagggacgtacatgtgcctcgtgaatttgcttgtaacc

SEQ ID NO: 519480 - DNA, 1182 bp, Homo sapiens
  misc_feature (2)..(3): n is a, c, g, or t
  misc_feature (15)..(15): n is a, c, g, or t
  misc_feature (17)..(17): n is a, c, g, or t
  misc_feature (245)..(245): n is a, c, g, or t
  misc_feature (349)..(349): n is a, c, g, or t
  misc_feature (482)..(482): n is a, c, g, or t
  misc_feature (592)..(592): n is a, c, g, or t
  misc_feature (627)..(627): n is a, c, g, or t
  misc_feature (633)..(633): n is a, c, g, or t
  misc_feature (657)..(657): n is a, c, g, or t
  misc_feature (719)..(719): n is a, c, g, or t
  misc_feature (754)..(754): n is a, c, g, or t
  misc_feature (758)..(758): n is a, c, g, or t
  misc_feature (775)..(775): n is a, c, g, or t
  misc_feature (815)..(815): n is a, c, g, or t
  misc_feature (864)..(864): n is a, c, g, or t
  misc_feature (911)..(911): n is a, c, g, or t
  misc_feature (920)..(920): n is a, c, g, or t
  misc_feature (924)..(924): n is a, c, g, or t
  misc_feature (929)..(929): n is a, c, g, or t
  misc_feature (1021)..(1021): n is a, c, g, or t
  misc_feature (1060)..(1060): n is a, c, g, or t
  misc_feature (1066)..(1066): n is a, c, g, or t
  misc_feature (1071)..(1071): n is a, c, g, or t
  misc_feature (1094)..(1094): n is a, c, g, or t
  misc_feature (1155)..(1155): n is a, c, g, or t
tnngacggccccgcnangcggcagagatagttgacggtatatctgtgagtgcgtggagatacaaagaggtagatggaattatgatagcaagatgtcaagaaagaatggtagagacggacaagacgcgaaccaccagactggagcgcaggcgacagatggcgtatatgtcatggcggcaaacacgcgacacatacaaccagcacatcacggcaagacacacaactacacacagaacaaaccacatntctccccctcgccccctccacgcgccgccgtctcccgccgcccaccacacaaccacacgcccgccgtccgcgaaccctgaacatgccacccgcagccgaagtcncgacatggaaacagcagtagcagatcacacaatctcctaacaagcaattaaacatccgctattccagtccgaatagtatagcacactaccgccacagcagaggtagaaccatggagctagcagatatgcgagntaagagtgctcaacgccgcataaacgcattataccagagatgtacggtacacacaaccctctacccgacacgcgcacgcacaaggcgcacgcgcgcgctcgccgctgcgngtggcgacttcaagcgtcgcgtagcgcgcaacgtnatgtcnctacgtatgctacgccttcccctncgcgctagcacacgcatctctgtcgcctcacaacgtctacgtgcgctcctacccctccgccntccccacgccaccgcaccaacctcactcgcgcgtntacnctatgtcccatcagaanaccaccatgacagtctatgcgatgtgtgtcacattacgtntcagattgcacttaagaatgatgacacacgacacgaggagcacacgtgnacgagccaggacgcacgatgtaaacagtagaatgcatgacactcgcntcgcacgantctntccanactatatcgacgcgcgtatcagactacacacgctacgtccgacccactgtgatcgcgatttagcgtacagtataattactacagaggcgacntcgaagagactcgcgcgtgtagagcatctagtgtgaatntgtggnattcngtagtacgcgtctactacgagtntagacgtgatacaccagatgttctttgtatatgttccttgtctgctgcactcgttcgacanctctacatccatcgtggcatcgcacgc

SEQ ID NO: 519481 - DNA, 230 bp, Homo sapiens
tacccatgtcgacacgtcaggtactcactgttgtccaccaaagcttgtagtgccgctgttgtaatctatggctcattgcagccttgaacttctgggctcaagtgtatcctcccgacctcaacctccttgagtaggctgggaatacagcgcgtgcacccatcatggcctccattttttatgcagatacgggtcattgctaatattagcccagtactggcctcaacgttatt

SEQ ID NO: 519482 - DNA, 253 bp, Homo sapiens
ggggttttgtccaaaaagtttttttaaggaaaatggaggtgaaaggccttgggaaaagtcctgcccgtaaaaatgggggaaaaggcttttaggtcagggaaaggctttgaaaccatttggattttttccagccccgtttaaaacttttgccaccactggaagctctaaaaacggaaagaagggctttaccggaaaaaactatggaaaagccttccaatgggttttttttcaaaaaaaaacggggccaatatta

SEQ ID NO: 519483 - DNA, 153 bp, Homo sapiens
ggaaaagaaggcagaacggtaatcagcctcggacctcagtgtggctgatggagagaatgtatttggtgtcttgccatatcttatgcatccttacactgacactatttgtaccatgtacactgactctttcttggcaaggcaaaccatcttgcc

SEQ ID NO: 519484 - DNA, 386 bp, Homo sapiens
cacccccaacagccacctcccttcactacccgcagctcccaaccccaaaacctatcctagatccagaacaagatcaaagctgtacagggaggttggacagaaagccgggcgcagtggcttacacctgtaaccccagcactttgggaggctgaggcaggcggatgacgaggtcaggagatcaagaccatcctggctaacacggtgaaaccccgtctctactaaaaatacaaaaaattagccaggcgtggtggtgggcacctgtagtcccagctactggggaggctgaggcaggagaatggcaggaacccgggaggtggagcttgcagtgagaggagatccagccactgcactccagcctgggtgacagtgtgagacttcatctcaaa

SEQ ID NO: 519485 - DNA, 302 bp, Homo sapiens
tcagtgagatcaggcgattggttcatcctgtgtacagacgtgtgaacgcctgtctctactacaaatacaataagaatttgctgggtgtgagtgggacgcgctgtagtcccagctactcaggaggctgaggcaggagagttgcttaaacctgggaggcggagcctgcagtgagccgagatcgcacctctgcactccagcctgggtgacagagcaaggctccatcccaaaaaaacaccaatatatatatatctatgggtcttggagcaagactgccttgttccaaggtctcagtacatcacttc

SEQ ID NO: 519486 - DNA, 163 bp, Homo sapiens
gtgactttaaaaatatcttttcctattcatataccgctcagaaggattgttttacttcgaaatattttgttgtatttcgtacaatagcataacaattaaaatgcatttatgaggccaggcgcagtggttcatgcctttattcccacacttttggagggccagg

SEQ ID NO: 519487 - DNA, 1064 bp, Homo sapiens
  misc_feature (1064)..(1064): n is a, c, g, or t
ttggcttccttcctcgctacttcctaaaaagcaacaaaaaagtcttgtgaatgctgcaagattgttgcatgtgtatactgagataatctgaggcatggagagcagattcagggtgtgtgtgtgtgtgtgtgtgtgtgtgtatgtgcgtgtgcgtgcacatgtgtgcctgcgtgtaggtataggacttaaagttcctttgggcatagggaagtcacgaaggattgcttgacatcaggagactatgggggggattgtaagcagacgtctgggctttaccccacccagagaatagcccccttcgatacacatccagctggattttcaaaagcttcaaagtcttggtctgcgagtcactcttcagtttgggagctgggtctgtggctattgatcagaaggtactttcaaaagagggctttccaggctcagctcccaaacagctgttaggaccccaccccttggccttatattgtacgacgtgactcaccagacgtcggggagagagagcagcaagaccgagccacgtgctcaacatggaggaggttagcaggggcagaggacatagcacaggaagtggtaggggaaggtacacgcaaggtactgctccccaaccgctgccatcggaaagacataacagagaaagtagtaccctaaggaaaggacattaacggccgacgcaatagaccacaccaagcggcaacgcgaacagtgaggcccccgtggtacgacgctggcacctgtccagggaggagaggacagagtgcgcgagaaatcggccacatgactgagccaagcactagacaagctgggagcgacacacacaaggatcggaaagaggacaccggagacgaccaaaaagcacagagagtcaaaggggcgctagaggacacaacgaggtgtgacatgaaaacactcaacacaagtcaagagcaagaccaggcggaactagagaggaagcaaccaggagagcgcagaaaacgacgcaagaaaagagcaaagacaacgacacaaaaagacagcagcaaatggaagaacgagcataagagagtcgctagctacgaaaatgn

SEQ ID NO: 519488 - DNA, 947 bp, Homo sapiens
  misc_feature (947)..(947): n is a, c, g, or t
ggacgggagtggggccgcgcggaggaggcaagatggggcagtgggttcgtcgcggggtagtgtgggcccggggcgggggtccggggcgccggtgccgggttgtgtggggggccgcagtcccgggttagtggaccccttcagggcaggtggctttgtggcacgagttggtgctttccccggagggcgggaaaggttggtggttgcaccagggtgagtattgcttggcgcaaggggtatgcaggtcttggccggtagtctgcaatcggggtggtcgacgtgccagttagcggtgggtgttgccccccacaggtatattcgggtgggtcacacacggggggcctctcttttcttttggaccaacacaagagtattacaggagggggtcaccccgagcgcttattataaggcgtgttgtcgcccttgctgtgccacagtggtatgtgactttggatggcccaaacccgcccactgggtgtgggctttgtaccaacaacgggaagtcattgaacgctaacggaaacccggcgaaggaaacgagtagacgggtcacaacgacgggccccaattggaagagtggcggacacatgtcacatgccggaccaagagcaagatgtgtcaggattatttcccaaaaaatatatataccccaagaaggaaggttgcccaccattgcgaaaaagggggtattcgcccttgaccaaagataaatgtgcgcagaccaacgaatggagggagagaacacagtttccgcatgcacagaggactatcgtgaagcacacagcggggtggactgcagaagtttaaatacacccgatattgtggaggcattggagtgacccattaaaagtttgagttggaatgcccaacacatgcattgcaagagttgcctcggggggttgaacaaaactaacgcggaatatgatgcgtgccgtaaaaggaagtcaaan

SEQ ID NO: 519489 - DNA, 357 bp, Homo sapiens
ttcatacctactcttggtcacaaagaatgtgaatgtgatggtatttatatttagatctccctaagccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattaggtgggtgtggtggcacctatagcctgtagtcccagctactcaggagactgaggcaggagaatcgcttgagcacaggagtttgagaatacagtgagctacgatcacaccattgcactccagtttgggtgacacagcaagaccctgtctcaaag

SEQ ID NO: 519490 - DNA, 124 bp, Homo sapiens
  misc_feature (60)..(60): n is a, c, g, or t
cttgaatacaccagcggttgtgactgggtgacgttaactactgggtggtacccaaatcgncttccccatgaaagaacagagaatagtttaaattagaatcttagcttgcggcggtgtatgccgg

SEQ ID NO: 519491 - DNA, 883 bp, Homo sapiens
ggccagaggcacaaagaagccagctgcgctgtgcagagtcaatggtgatgtgggcatggggctgccggggcctatgcagggaccagctgaatgtgctgcgcatgggtgtgtgctggtgcacagacaggactgcgtgcatgtgacgcttgaatcgattggctgatgctcctgtgtgcgcccttacgatgcatgctgtgtgatggcagtgtggatggccttgaagtgcttgagaacatgccaccgtgaggcatggatgctaatgggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtatcctgctgaatgagattgagaaggaggagaaggagaagctctggtactactctcagctgcagggcctgtccaagcgcctggacgagctgccgcacgtggagacgttctcgatgctgatgggcctgatccggcagccgcttgagttcgaggccaggacgatccgatcgcctgatggacgagcgcatcgggaacctcggacgacactggtgcgaggggacaagattcgggacctcggactgtgagcagatgtgcaagagctgatggagggcagaaccgaggagaaaggaggcca

SEQ ID NO: 519492 - DNA, 777 bp, Homo sapiens
  misc_feature (7)..(7): n is a, c, g, or t
  misc_feature (115)..(115): n is a, c, g, or t
  misc_feature (117)..(117): n is a, c, g, or t
  misc_feature (214)..(214): n is a, c, g, or t
  misc_feature (221)..(221): n is a, c, g, or t
  misc_feature (227)..(227): n is a, c, g, or t
  misc_feature (243)..(243): n is a, c, g, or t
  misc_feature (245)..(245): n is a, c, g, or t
  misc_feature (262)..(262): n is a, c, g, or t
  misc_feature (335)..(335): n is a, c, g, or t
  misc_feature (346)..(346): n is a, c, g, or t
  misc_feature (361)..(361): n is a, c, g, or t
  misc_feature (380)..(380): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (462)..(462): n is a, c, g, or t
  misc_feature (467)..(467): n is a, c, g, or t
  misc_feature (488)..(489): n is a, c, g, or t
  misc_feature (493)..(493): n is a, c, g, or t
  misc_feature (513)..(513): n is a, c, g, or t
  misc_feature (521)..(521): n is a, c, g, or t
  misc_feature (578)..(578): n is a, c, g, or t
  misc_feature (587)..(587): n is a, c, g, or t
  misc_feature (589)..(590): n is a, c, g, or t
  misc_feature (593)..(594): n is a, c, g, or t
  misc_feature (600)..(600): n is a, c, g, or t
  misc_feature (611)..(611): n is a, c, g, or t
  misc_feature (619)..(619): n is a, c, g, or t
  misc_feature (622)..(622): n is a, c, g, or t
  misc_feature (625)..(625): n is a, c, g, or t
  misc_feature (629)..(629): n is a, c, g, or t
  misc_feature (664)..(664): n is a, c, g, or t
  misc_feature (678)..(678): n is a, c, g, or t
  misc_feature (717)..(717): n is a, c, g, or t
  misc_feature (752)..(752): n is a, c, g, or t
gcctgtncgccgctatgcctccgcgcgcgccgcctgcgcccgggccccggccgccgccccgggccgccgccgccaccgacaccgccgcgggcgcggggggcgcggggggcgcggngngcgcggggggcgcggggggcgccggcgggcccgggttccggccgctcgcgccgcgtccctggcgctggctgctgctgctggcgctgcctgccgcctnccccgcncccccnccgcgccccgtccccncncccccctgggcggtgcnagtgctgggcggcccggccgaggcggaccgcgtggcggcggcgcacgggtacctcaacttgggccagattggnaacctggaagnttactaccatttttntcacagcaaaacctttaanagatcaaccttgngtngcngaggccctcacaccttcctcagagtgggcccccaggtgaaatggctccagcaaccggaagtgnaacgncgggtgaagagacaggtgcgnngtgncccgcggccctttacttcancggccccntttggtccacatgtggacctgcattgtggcgacaagaaccgtcgctgccggtcgganatgaatgtncnngcnncgtggntagaggggctncccagggncancgntcgnggtggtccccctccttgatgatggcatagagaganatcaccctgacctnggccccaaattattgattcctacgccagctacgacgtgnacggcaatgattatgacccatctccacgatataangccagcaatgaaaataacacggaat

SEQ ID NO: 519493 - DNA, 771 bp, Homo sapiens
aagaaacatatcaaggtgcttttggcacaggtgcccacgaaatacggatgcagtgctgagatagttatatgagacttgtaccatttcaacaaatgtctggaaattgggttccatgattggcaaggctgccacagttgttaagaataatcgcctctatgtttcttcctcgactaaaatccatgatcgtcattgtatatccgagaccattacgttcactataattaggcaaggacaatatgattagcagatgaaataagaatagtattagagagaatgtgatcctattttgaacccctctccaggtatcttcacactcttgtctaactctccaggcctctctcttgaccctgagttagttcagcctgtgtggtggttaactagccgttagaaggtacgagctaagaagagtgtaacagtatcaagccctcccagttgcttaattatatcccactaggtaagtacaaaaatagctctgaatgacgcaaagatgacggattactaatgcatgtgcattgtcaggagccgacagaaagaaccttacctagggttccctctaataatcagtccttaatcctctttctatcttcaagatcccatcatcatgcgtattttcggcactatccagcgtaagcaaagattcctggaggctgtacttgtatcttcagactcacagagtgaattcagctcttctgaatccagacccagccagtctctttcattcagacctgttgctaacaaatctatatatgccacaggatataaggcaaagag

SEQ ID NO: 519494 - DNA, 138 bp, Homo sapiens
cggagacaaaggtgagtgacaacgggagtccacatacaaacatcatttaaaaatagaatgttctccatagcgctcatgagatgtcaaaggatcatcagttaagaccgtagaaatcgtcgacgtggccgcggtcgacgc

SEQ ID NO: 519495 - DNA, 1167 bp, Homo sapiens
acgcgtccggattgaggggtgactgagcgttgcgagccttagctttctcccgaactgccagcgctgaggacacgatgtcgcaggatctcccgactcactgctttgaggccgccacctgcctgtggcgtgctctgctgtgctgtccgcggacaagaacacgagccagcacccgaacgtgacgactttagcgcccatctccaacgtaaccgtcggcgccggtgacgtccctcccgctggtcaccactccggcaccagaaacctgtgaaggtcgaaacagctgcgtgtcctagtgttaatgttcagcgtcggttcaatcatcacctgctttcaggcatcagcaatgtcacacagcatgcagcagctcatcggtcccacatcaactccaaccagcttagtgcattgtccacagtggggcaccacgaccagacttctggttccgattccacggccactccagtgccaacaggcaattctacagctcacacccacagttcagacctcccttctacaagttccaagcacagttacctacatcaggtacaacaacatcacaccactgtgactccaacctcacacgctgtgcgcacagtctaccttctgatgcagccagtttcattggaggcaatcgacctggatcttagggtgtgccaggctggcacacaggcccgctggcatcacagtccggcccaactctacacgaactgacaagagccacgacctccggacacacagaccccagtggcactcccacacggcaccggctgcacccccacgacgtcactcactgcagcacacacaccacctgacagcggcccacaatggatagacggtaatgccgcggaacctaaaacttacctgagatgcaacatcgcaagtacgggagcgacacacggcgagcacacagccacatacccgcggctaccacagcgacgtccgcccccccgcgcgcagccgcgcgggccgcacagcaacccaagcaccaccgcgagcacgcaccactcgccggacccccacccccgcgcgcaccaccgaccgacgacaccacaacgcgaagcagccacagccgccgagcggcaccaccacagcgagagcccgacgccgcacagccaccgcacaccgcgccaccgcagcgcggcagcgccgacacccacccgaccacagcccacc

SEQ ID NO: 519496 - DNA, 260 bp, Homo sapiens
cacggttgtatattacacaggcttaagcataggcagctcccccggtaatgaacacatatacacagtctttctctacaactctggtcacaggctcttttttgaaccattccatgtatatatatgtgggtcacgctgctggacagcaagaaattggcacaacattgtaaatcaactctaataaaaaaaataatcaattccaggagttccctgcgtagcctagccaggacgcgtaacagccacagtttttgggtaccgagact

SEQ ID NO: 519497 - DNA, 294 bp, Homo sapiens
tcgcatatgggacagagcataggcacttagtgccccagcttatgtcgtccacttggctgatctctgtggcactatgagatagtgtgttagtgaccatcccgggaacactcctgttggtcagcacgacaacttggactcagtacactggtacttcctatcttcattggaagaaacaaagagcacctgattagggctacagcatattccactcaaatctgcatttagccagcaatccatatgaaggcacattctgtcctcagtcccagagagttacctacataatgaaccctctta

SEQ ID NO: 519498 - DNA, 313 bp, Homo sapiens
  misc_feature (7)..(7): n is a, c, g, or t
  misc_feature (11)..(11): n is a, c, g, or t
ctctagngagngtatgagaccttgcagtgagtttatcagcatattcaaaatttttttcctggaatttggagggatgggaggagggtgtggggcttacttgttgtagctctttttttttttaacaaccttaaaaaaaaaggcggttgttttaactcaaggttggtctgttttgtggaaaagaaaaaccagaactgttctgacccccctgttttaaaaatccattggaaaacaacgggggtataataaaaagtggttccccccaatgcttggggtagtaattgtggaagaaaaaaatccacctgaggaaaaaagc

SEQ ID NO: 519499 - DNA, 110 bp, Homo sapiens
gaacccggcgtccgtccagagtggaataaaacagttgcatgccaggattacccaccagatggatcataacagaagcgaatgtgctcagggcatatcccgctcacacaaag

SEQ ID NO: 519500 - DNA, 845 bp, Homo sapiens
  misc_feature (617)..(617): n is a, c, g, or t
aatttaatcagtgagcgggacacatgctcttgataacccaaaaaattgaagcatgaaatctgggagtcatacccatcacccaaatgtggcataacaatgttcttcttccccgcaaagcagtgtccttccccaaagaaattctggggatggcattttcttcatccactcctgttgcattatttcctttacctatggtctctgagtctattagcatccttggaggggggaatgtatcttatgtatgtgatatctcccaggctcacgagcatcacgtcaataaaggttgttgaatgaaacaataaatggatgcaagactaaatgaacaagagaaaagccacggggaagatagacaatgtgtatgtcgatcattcaggatcatcttgtcttctgttttttcccctccagcgtttatggaggtatactgtgacaagtaacaaaattatatatattcaaggtgtccaacaagatgtttggatatacatatacatggtgaaatgattaccagaatcaaactaattggcatgtccatgtacctcacataattacctttttgatgtgtgctggagaatacttaagattgtggtttcttagacaaattttaaagtatacaatacatnatgattaactatagtcatcatactttacaagtaagtctcagaacttacttcattctgaggcttgttattctgaacaaaataattttatttaattcccgacccatttagatggtacccattttttttaaggctctgggaaatttttttttatcccggggtaacagggaaaaaaaaaaggggcaatttaggggtcagaaagataacggttaaccgaaggggggaagggga

SEQ ID NO: 519501 - DNA, 1335 bp, Homo sapiens
ggtggaaaggccctgggcagaccctggcagaaggggcacggtggcagtggtgtgagttccccactagcagtggccaggtgatgctatggtgcttgcacctactgctcttcttgcttgctgaccccacatgggtgggcacatgctgccatgggtgctggatgcttggccctgggaacttgttcttggccaatggtgatgggccctgttcttgtgattgccttgtggtgcccccacgctggttgaccatgtggaatggttgtggtgaccctgtgatgtcatggctgtgcttgcccctgaaggacattgccctgtgtgtggtgctttcacacagcatgggggctcctgagccctgatggaacgatggatgtgactgtctcccaaggccatccattttcccatgccacatgatgccagcttgtgagggacagatgtcatgcttgccatgatggtgctgtgcccatggagggcttgacgtgatgtggccttcttcaggaatacagtgtttcctggccagtcagcgatgcagtaacaactgcatgcctgcccatgtggtgaccttcatgacaccaggcttgttgagttaccacaaacactgtgggcttgtgacatggcaggtgggcacatgcatgagcttccagataaggctcttgaagcccccttgctcaggccattgcttgggcaacttgttccaccctggtggatggaaccctgttggggtttgttgccgcattgtccttctgggcgcatggcttcccccccttcaactatggtgcctggtggcttggcacctttggggccgaccctccttggctccttcttctccttggttgagcccacccctggtcctcggtggcttgttggcttgctgcttgttccccttctggtatcttggctcaggcccgggcctgcagggctgaggccctttcttcggttggcccacacttcgggaccagagacaacccagtggtgtgggacgcaaagcgcccgagcgggctcaaagtcccctgaatggtcctggggctatgagccacccgacagcggcaggagctcagaggaggagagcctcctggagagaaacgcggctggccgagccagattgccagagtgcacgcccgagacatttcctccacagaagcttggtgtcgagaggaggcgcatggccccccgagatatatcaaagacagacgagatgagagagtgtcaacctcacagcatgcgtccacaggcgagagcacacaagacaagcaactcatggagcagcaacgtgtcaactcagacaagtcacacagaccccgagaaagaagtacacaccagcatttgtgtcgtcggactcag

SEQ ID NO: 519502 - DNA, 660 bp, Homo sapiens
  misc_feature (186)..(186): n is a, c, g, or t
  misc_feature (205)..(205): n is a, c, g, or t
tatagaaggataatacagagccaagatcaaattaaaagacaataaatggaacagaagggaggcagtgtttagctttgtataaacttttaggtttgctctgtaatctgctaaaccatatacattcttttgtgatatgttattatgtatgtggcacttgaggcactgtatgtaaagtaaggaatgctntactagttctccttgggtntatctttgtttaaactagctttaaagtattaaacaataattgaaatgaaaagcttacctattttaaaaagccaaatttaaataaatatagaactttaaaatggttatcacggtgtttcatgaaagaatttaagtttcaagtaaatttagtgaatggttacttacttttcttattttggaatacatagtaatgtaagtaaatttttaaaaattcttaagggagccacaatggacaagctaaccttaaccggcaaattttaagagaggcataattaaggtcaataaccaatatttttaaagtatatatggctcatgtgacctggaaaaactttatatggaaaatggctgtgcaagttttgagatggtaaattgggtaaaaccgatattatatatatattaggttaggaacatttatatatcacttccaagtgattaaagtccatgcattgtgccttt

SEQ ID NO: 519503 - DNA, 475 bp, Homo sapiens
ccccaaggtttgtacccaaacggagggtgcgcccggccgcggtttcacctgggaggagttcagggtggccggaatttcacaaaaagggggcccggaccatcggcttttttttggatcccagggggcggaacaattccccggggtccctgcaggcccacgtgcagcggctgaaggagtacccctccaaactcctcctcttccccagggagcccccggccccccaggagggggacagttttgctggagaacttaaactggccccccaggtggcgggccggtcatgcccctccgggacgtttttaagaagggggaagctcgggtcctccctgggggagggaagaatttcaaagccttcgcttgtctccgtttggcccgtgccaacccccggctcttcggcattcgggcaaaaagggccaagggagcccccgaaccgggttttgaaaagaaaaaataaagcccccctgggggcttggga

SEQ ID NO: 519504 - DNA, 246 bp, Homo sapiens
tggtaccacctcccttagttgtacccgggaccacctgtgtaagcacattatacttgtaagaaatatgagtctcagccaggcgcagtggctcacacctgtaatcccagaactctggaaggcagaggcaggcagatcacctcgaggtcaggagtccgaaatgagcctggccaacatagtgaaaccccacctctattaaaaatacaaaaattagctgggtgtggtggcaggcacctgtaatctcagcta

SEQ ID NO: 519505 - DNA, 124 bp, Homo sapiens
tgacttacacgaccttacacactgttacgaccctacacacacccactaacacacacccctacgacacgaaacaccctacgggggactcctctacgacgtcgaccctcgcacggcatgcaacgct

SEQ ID NO: 519506 - DNA, 1184 bp, Homo sapiens
gggcatatcctcgttcgcgtggcattcgtgagaagcgcggggcatgagcgaaacaactcatacatgacaggcaagcttgcatccagaagcatatagcaggacaagcctgtaagcgaagtagtaaattcacggcatctggattcctaatccttcaccgaaatggcaggatgtgagtgcctgtataaaatatgctagtgtcgtagccttcagacttctggttgctggctatgtggtatcttgatcctagcattagcaatatgggtacgagttagcaagtgactctcaagcaatgtaggtgctgacagatgtaggctctagctcctacgttgctgtggacatattgatgtgctgtagggtgccatcatcatgattctgggacttcctggcatgctgcggtgctataaccagaaagtcgctgcatgcttctgtcgttgtcataggcttgcttctgatcctgctcctgcaggtggcgacaggtatcctagagagactgtttcaaagatctaagtctgatcgccattgtgcaatgatgatctctattgaaaacgacaaaggcttaggagcgcaacaggggacaagtgaaaagacaattccagggaagccataatcgtgttccacagaagagttaaattgcctgcggataggacacactggaggctgctggactgggcgaaataatttcaccacttattccctgacttatgtgcctggcagatcacgccgcgtaccagtgcaagccataaatgggcaccagtttccaagaacccggattgtttattaacaacctctctgtgcaacactggcacacgcatggaacacatgtatcgggcgcatacgaaaacgcgaagcagccacagacacagatccaaaccggcacaaatcggagaacaagcagaggacaccccagacatgcagcggcaaaactacgcgtacccaaccactcaagaacagggagagagaagaagtgaaacacggagggcacgccagagaggtaagatgcagaaaaagccgcgcccaggagacgcagcggactaccatgagcatccgacgcacagctaagatggactcgtaaacacacgaacagaagacagcaacaccacggagacacacccagcggcaaggcgacggacagcacgaccaagcggaaccgaagacaaacagcaacgaaccaaccgagcaagcag

SEQ ID NO: 519507 - DNA, 122 bp, Homo sapiens
gagagagagaactgaggcagaggtcagtaaacctgccctgggccacagagcagcagatagaagggcctagacctggataccagaagctagggctactacggtccagcatacataccactagg

SEQ ID NO: 519508 - DNA, 163 bp, Homo sapiens
  misc_feature (118)..(118): n is a, c, g, or t
aactattacagtgtatagttaatctctaaatatatgtacacagtcgaatgtacacgctttgaataaattaagtaccaatttgcatattctgggtaaccttaaatgcttatttacacanaattaccatttatttcactaaataatcttgttttttgttccccgt

SEQ ID NO: 519509 - DNA, 419 bp, Homo sapiens
ccttagcgtcactgaggaccaagtgcacactcatgcccaattaagcagactcagagcccttcggggaagctttagcagttattgatctctgcctattttaactcaagttcctcttttcatgttgaggcaaaacctcacagtcttttctgagcttagccacagtttctaaataactcattcctgacacctgagcctgttcagtgccaccagaatacgaggctccccaaaataagaatctggcctgaaattttgccaagtgaagcaccgaaaggctttcattgtttcttagtttagtaactttagctcttttcctggggacttctgttctcttgtcaacaccaaagatctcatctttgttctttgcagaccaacttcatggagttggcccacgtgtcatagcccatgacagccctgtatca

SEQ ID NO: 519510 - DNA, 1105 bp, Homo sapiens
  misc_feature (231)..(231): n is a, c, g, or t
gcagcaaccagccggactctccgtatctgctgcgttcccacggacaagataggtttgcggctgtaccatggcacccccagagtccctcctgctcccgcttctccaggaccccgcagatgcaaaacaggatcgacagtgacccatcagttgagaggactgcaggcgcgtagcagctaaccactgctggagagaccacgagccgtgcacctgggagccgtgcggtatccaccntgtcgttcctggagaaccgttcgtgggtgatcatggatctgcagtcagaatacctggccatgcgttccaggcgtcgactgggagaagtccggtcgcacgctgctccgtagatagcgctccctccgagaagcccaatcacgtgggactacttggactgacttgattactttcaccctgtaccctctccctggtagaacgttttgaggaagagctgctggagactcctagcgtccaggacctacttccaggacgggatgtggtccgagctggagcggtggtgccctggagatcctggagcggcgcctgcgtgtgggcgtgcacgatggtctgggcttcgtgctgaggccgccaggtcgttgtagctggtgcctgaggatgggtgtgcgcttgacgcgctcagcgtaggttcagcaggagagtggtctcctcttccaagaccagatccgggagccaagctctggtcccgagaagccgcctccgcctcccagagatggtcggccacctgcatttgcggtcatcttccagctggagtacgtgttgcagcagtcctgcaggagttggaccggtaatgcagcttcggtcacctactctgtgcaaaactggcatgcatgcacatggtccgtgggctgtttggaaccccttgttgggacgctgattctggaatggttgaacccatgacgactgcagggtgagaattccaggcctaacccatcgcacagacagggctagaaagggaaccctcagcaagatgacatctggaagaggttgagccggggagtcccggaaacacccgcatcacataccacgggtaaaaaagacctggtgatccacataggcctgacaagggcaaaaggaagagagccccaggaacacc

SEQ ID NO: 519511 - DNA, 893 bp, Homo sapiens
gggtgggtcccaacagtggcatggagagagacaagggcagaaagagaagagagaggaagaagaaaagagcgaagcgggccggttcctccgggccacatgaaccgccatggtcgcaggaaggccccctaaccaggggccgtccgcccctccttcgagccgttccgttccgtttccggccttcagggtccgccgtaccaggtgaagcaaagggaaggtggccagcgcaaaccagggggacacaacccggaccgggggttcacgtgccgaagcgccggatgtcctccccccagatgcgctccgaacgcttggggccgcccgttcccgcccggggcccctggagaaccccccgcggcacgccacaggggacaaaagggggtcttccctaaacgcacgcgtctacagcggctacaaacaacgatgcctcgaggcacgccggaggccccacgcgacgtgtcgcctccttccgcgaagccaccccgcgccagagaagttggtgtcgtcggcgcacggcctcgcacccgcgcaatcgagaatcaccggccgcagagtcaaagtctccccgagcagcctagtgcttgtgcgaggcgtttgcactcttcacgacaggaagaagtacttgcggtgagtgcccaccacgcaccccggaaggatagcattgtcgacccccggatacaaggacaatttgagtattacgggcaccggccacaacgttctgccaagaagctgggggttccccagtgtgtcccgcgaaagacgaagagaacattcttcgagcctcgggaggcaagcagtcgagcacttggtgtccgtcgggcggaatggtgaatagtactccccccaatggggtttttaaaattccaaaaaaccaataaaaagggcgccccaacaaaaca

SEQ ID NO: 519512 - DNA, 177 bp, Homo sapiens
  misc_feature (4)..(4): n is a, c, g, or t
  misc_feature (82)..(82): n is a, c, g, or t
  misc_feature (141)..(141): n is a, c, g, or t
cctngcgaccctttagcaataaaacgcattctcactaagctatactaaccccagggttggtcaatttcgtgccagccaccgncgtcacacgatttaaccaaatcaataaaagccggcgtaaagagtgttttagatcacccnctccccgtcgacgcggcccgaattttattgtattat

SEQ ID NO: 519513 - DNA, 624 bp, Homo sapiens
gctttctattattttattttattttttgatatggaggtctcactctgtcgcccatgctggcatgcagtgagccgagagatcgcaccattgcactccagcctgggcaaaaaggagcaaaacttcacctcaaaaaaaaaaaaaaaaaattcaaaatttttccgtggcctttatcaccttccattagcccacaaggagcagtgggtaaggggttgggggagggcacaaagtgtgcaaaattagacttgttgaagagttaatagcttcaactatttaatgtgaatggtatgttgtgatggaagcagatgactaataggggtcatggataatcaagtcattacaaagcagggccctttaaggccagaagctaacaaaaaacctaggtgaccaaaaagaattgagttttccctgaacattttactcgggaaacccatagaatcctttgctgtgctctctgaggctacggctgctagaaagctttagaaaagcttttggccatgggcactgggtgagcttgtaaggggctaatagcttttccatagtcaccgaagattttttttaaaaccttaccagatttttagaatttccttttagaactcgattctggtggtctggagtagctgcgag

SEQ ID NO: 519514 - DNA, 139 bp, Homo sapiens
  misc_feature (109)..(109): n is a, c, g, or t
ctcaccacctcatgcgagatgctctcacactgcagatacaccagtgtctctgtcacaaacgtatatgctggtgtcaggaatggctacctggccaggctgtgtgtggatnggattcatggcagcctctctgctagctttt

SEQ ID NO: 519515 - DNA, 480 bp, Homo sapiens
  misc_feature (14)..(14): n is a, c, g, or t
  misc_feature (24)..(24): n is a, c, g, or t
  misc_feature (65)..(65): n is a, c, g, or t
  misc_feature (74)..(74): n is a, c, g, or t
  misc_feature (163)..(163): n is a, c, g, or t
  misc_feature (166)..(166): n is a, c, g, or t
  misc_feature (173)..(173): n is a, c, g, or t
  misc_feature (176)..(176): n is a, c, g, or t
  misc_feature (178)..(178): n is a, c, g, or t
  misc_feature (259)..(259): n is a, c, g, or t
  misc_feature (412)..(412): n is a, c, g, or t
  misc_feature (428)..(428): n is a, c, g, or t
taagggggaaaaangacttttttnaaggtttttatttttaaaaagtcattcccatttttgggttntgggaaaanacatttttaacatggttataattcacggcccttccagttaatgggcttgcccacagttttactgggaagtagagctgagatttgaagtnggntgggccntananaaacatgtttctttccctttgtgggattgagtagaaggtgcaatatttaggtatgaccacagggtggtgccaaaaatcaanacatagctgcccccacctccattggattgaaaaccaaaccaaaaacctaagcctgtaatttgggaatttggatgaggatatagggagatggctcaggagtctagaagacctggcaagtatggtgtggatggggacagaatttacttcatggtntggtgtaacctgaatntgtagacttgatgcctgttgatataattggtttttaataaatttttgatcct

SEQ ID NO: 519516 - DNA, 128 bp, Homo sapiens
  misc_feature (40)..(40): n is a, c, g, or t
ctgggtggtgttctagaggtcccaactcaggggcgagctngccatacaccacgtggggagtgccagtttctctcccagcacaacacctagacttgcttggaagaaacagagctctacagaaacaaatg

SEQ ID NO: 519517 - DNA, 197 bp, Homo sapiens
gactacaatccaagagactggagagagccatatctgacatgctaacgcaaatttataaacacagagtttggctggacctctccaattattaaatgcaagccaagctctgtggtgatacaatttgactctggctttccgagatggtaccatcaatgtccacgacgtggagacacagtacaatcagtataaaacggaag

SEQ ID NO: 519518 - DNA, 1330 bp, Homo sapiens
taagggagaaggtgctttattcggggatctgcgttaccaggctggctggggtgctggattgggaaggggattccaaggagcaagaccaagaaggtcctagggccagcctatgcctccagggacccggccgtatgatagacgcggatgtgggcggatagacgtcctggatggttctcgaaagtgtgtggtgcccgtgggcccccgagtgtccggcagtgtgtgcatttttctcagtttgtccagtggcattgtccaggatcagtcgcttacggcatgtgtgcgggtggcactagcgagttgcagtctctgcacggtgggttctcaggcttctgtgccagtcgtggcccgagtcactggggtggtccgtgtgggtgcattgcgcaaatgtgtctctttattgtggcgaattactgtcctatgtcccgggtgttcacctcggctatgacgtgttgttcacacacacccgcccgtctatcaccatgtgtggcgcaataatgttgtgacaccccagtccatagatagcgtcgctggggatccccacagacaacaaggatctccctgagtcgcaactagaacactttgtatgtgccccaggacttgatcgtgccccacattatagaaaggagttggggggccatctacacccgcatgtgacacatcgtcagatacattcgccttcggcgagccgctgtagagaaaccccagcgggctagacaattagcggtcgatgctgttgtaataatcccaccaacaccatcacattgataactcattcgacaaaaaggggtaggaaacttcctttagcatgagcggttaacaccatgggtcaattttgcaacaataccctgtgtcctccgttgcacatcctacctgtggtaactgatgacacaacatggccccatatgctgcatcccaaggagttatttacacatagcaacttcatctgaggtggcccttttggtgtggcacccgcgacgtcggtatccaaactattattcctttgtgtaccgacccacccggatgtatcttctccttggaacggccccagacgtctttgtctaaataggagctcatatactctcatcgcaggacaacaattggcagctccgggggcacatcttatggaggcaccctatactgagattacagtttagcatcctcatctctgcaagaggacgcactatacttcacccaaacccgtgtattaccccgcggcgcacaccatcaggattgccatctgaatgtatggcactccacatcgatgataattagcaattagttatacaactttccgcaccccacattagtgggatgatatattatctctacg

SEQ ID NO: 519519 - DNA, 946 bp, Homo sapiens
gagtgcagacgcaagtctttgctgtcttcttctccaaagtcacgagaggatgggagaggagcacccttggtatcctccggagatcaagagcttgagacgtgtccaatcaagtgctacaggtctcgattctgttggccatgtgtcctcgttgcacatgtgaataggcagcaagtctcaggctcactttaacactctgctcgtcccgacattcaagcagatatctccatgcctgcagcttgcccgtgaggtaatcattgggactacgagatgctccatgagcatgcactggctaagttgttagtatctttctatgatagagacagggtttcatccatgtggctcagactggtctcgaagtgctgacctcaggatagattctgcttggagatcaaaaatgctgtatatcagtagtaactgatgggagtcacggcatgggggactggacagtgggagacttagatccctggaggtggtattcgtggaataaacataggtgttaagggtgcatattagaatattctctcacaagaaagggaagaaatcgcatcctgactgtacaatgttgctgagcaatagaaggaattaagaggaggactgcggtgaattcacaaggagtaaagggaagttggtatagtatccttggataggcgaagttgcaagtccaaccgagcacagttaggtagattgcatcaaagatgagtcagccgttctcctgcggaaaaggccgtcaagcccgtgctacaaatcagataaggagatacggtcgtaccataaaaaattggaaaagtaaatcgacctcaaaagacacggtaaggaagtaccgtggggaacaaaacgataaaattataaaaccacacaggggacaaagcaaagaacgtgtcatccacagtgagtaggcgcgaagtaacagaaaataaagagcgcacgtccgtggctatcttgtctg

SEQ ID NO: 519520 - DNA, 143 bp, Homo sapiens
attcatctaaagacacaagcctaacagtagcaggtacactcacatttcagaagctgtgtcttctctgccacacctaaattggcatacattacaaacaggttgcaatactgctgtcaatgacgcccatgctctgaaacttccct

SEQ ID NO: 519521 - DNA, 118 bp, Homo sapiens
ctagctgggctgctctcctgctcaggccttacacagctccctcccttgctggtctctttctgtcttccctgctcttgtatcaaaagtgatcatgggttgctgtgtccgatcattaaca

SEQ ID NO: 519522 - DNA, 213 bp, Homo sapiens
gggcagcgcggtgcgtcacgtgtcgtgcgtgtatttgctgcagtgtgggcatgcacctgctgtggtgaatacacgtcgacctggctccatgtttgcgttctttggtggtgagcgcggtgctcatgtgtccgcggtgcttgtctagggaggcatgcaccgcagtggtgaatacacgtcgagcaggaggcatgcatgcgtgctcggtgtactgta

SEQ ID NO: 519523 - DNA, 753 bp, Homo sapiens
gggaagctgaggcaggaggatcacttgaggccagaagtttgagaccaacctgggcaacacagcaagacctcagtgccacaaaaatgaacacattagttgggcatggtggaatgcacctgtggtcccagttgcttgagcggctgaggtaggagaattggttgggcctgggaggttgagcgctgcagtgagccatgtttgggccactgcactccagcctgagtggcagtgaaaaaaaataaaagaaccatagagttgataaagtcggggttccagtccctcagtaccgtgagcctgtgttaaagggcctcaaggaagatctggaggaaactgatgatgagggaacagtgcagccttgcttacacctagatagcgtccttgtcctccctccctttttccttccttcctttccttcttttctttccttcctttcttttcttcctcccttccttccttttcttcctttcttccttccattcttcctcccttcttctcttccttcctttccttcccgccttccttttcttcctttctttctaccttccttccttttttcttttcttccttcctcccttccttttcttccctccctttctttccttctcactccctccctacctctctacctttccttgttccctcaacatttttccccaagccatttggggaaacaagttggaggcgaggaaatcatctcaagcagagtcgagagagttgcatgcggaaactgctggagatagttaaggggcgggaaat

SEQ ID NO: 519524 - DNA, 954 bp, Homo sapiens
gcagattctcttatgactaaattggtgactaaattggtggtgttgattccgcctggactcctggaattggcttggtggttgtctgccagacaattgtggaacacagctgccatcactgctgtaatcccacctaaggacagttaatccacgaaaatctccgaggaaatatgtcagacttgttctgggctcagacagtaaggtcgagcagctagccacctgactgctgctgcagttcatactgcacctggtagtgagctctcgctgttgcggacttggatatcttctgcacgagaaaacaatgttggggtcgggagtatgtgagacgagtctggctgtacttatgtcatggccattacttgtagtgacacaaatgagtgatccactgcaacttggtagaaggtgtggttcttacaataccactaagcagtggcgcacagtttgctgtcatgctggagaactcatgtacatgccatagtacacacttattttttacctgtcactggtgcctggatcagcacaggtaaaacatagcagatgagcctccggatcgtggtggccttcacaggtacattcctatcaggagagaacgatcgagacctggaactcatagcagaaaccgcgggaatgagtaacactcaaactagcagtactgtccaagactggttacttgatctggtacctgcttcaccgcgaacaggtctggacaggatctgacgatatgatgcacgacgtcaagatatgtacacgcgtttgggtgtgcttccctgctacaatgctctttacaggccgggtttggaaagcacgtagaatgcagcgacgcagcgaagttcttaacatggttctagagaactgattcagttgccggaaatcctctcccgtacaaacgtgttcccgtgctacgaccacgttattatccaggccgttaacgaagactggactcatcggagaaccatc

SEQ ID NO: 519525 - DNA, 569 bp, Homo sapiens
atggaaaagttagtggggtgtgacatagaggagagtagaatgcagacggtaacagcagcgttgaggaagcttatggtgaccgatagcagcgaggatggcctcacagtgggggtgtaagagtcggacaagttgatgaatgtgacccagctagcgtggtcgtctgcgtcttgaacattgagaaggaggaggaggatgacatcgggctgcagatgcatttcacgctgatacagtctatgtgctgtgagatagacatgaacatcgtgcgggtgtcgggcatgcagcgcatggcgcagctcatgggagagacggccgagacacagggcaccactgaggtcggagacgtgcattgtctactggtcacgaaccctcacacggacgcctggaagagtcacggcttggtggaggtggccagatactgcgaagaaagatggggcaacaaccagtgggtcccttacatctctcttcaggaacgctgaggcccttgacagcagcagaatctgttgagttgatgccacaaacaaaaaatacaataaatatttgaaccccctcccccctagcacaaacctcct

SEQ ID NO: 519526 - DNA, 796 bp, Homo sapiens
ggatgtcagattgcatctcagtgttaaatctttactgatagatgtacttaagtaaatcatgacacattctacttgtacctatagaagtgaacttgtgcgacgtacacaatggttgtgctattctggataactggcccctaggcagcatttgtctacgctacactaactggcacaaaattcatggctagctgatgctactaaaataacacatattcctttgcacggtaaacattattccctttgcctgaactgcttatcaagacaggcggggcatacacaccacacggcaacctaacaacattcgcgccaccctgcccacgatcataccttcaacttctctacgctacatctttcccctggctcatcacgcgctctccacatcactcgcactacatataaggacacagacagccactacacatgaaccacatattgctatacgactcggacacggcccactacaactttgccttgccttggaacccgtagctcgtcttctgaaccccttagtcatctatataaaaccacaccattttctttgaacttacgcaggatcaagtatttagtctatggcgaacgtggccctcggcacgccgcaccttcacacgagccagaacccctgcgcccagcttaccactgcccctcctctgacccccttgcgcaccgccttggcacaccaccccttaacccgatccctccgctgactcacacactctttgcccctacgactcatttctagcccaacccaaacgtttaaccttccacaagaataccacaaacacctctatgggcgtag

SEQ ID NO: 519527 - DNA, 478 bp, Homo sapiens
cagcctgaccaacatggtgaaaccccgtctctactaaaaatataaaaaaaatcagctgggcatggtggcacatgcctataatcccagctacttgggaggctgaggcaggagaatcacttgaacccaggaggcagaggttgcagtgagccaagatcgtgccattgcattccaagcctgggcatcaagagcgaaactccatctcaaaaaaaaaaaggtgggggaaaaaaaaaagccaggtgtgttggtgtgtgcctatagtcccaactacttgacttcctaaagtgctgggatcacaggtgtgagctactatacctggcctccttccgttttctatcataccccaaatccaattcatcagcaaatcctgtcgctcgctatcccttcaatatgtatccagggtctgaccatttctctctgtccccatcagcaacactttggaacaaattaccaccgtctcgtgtctgcctaaaaagccgaa

SEQ ID NO: 519528 - DNA, 608 bp, Homo sapiens
tatcgaatgccacactattatatgtatatatatatatatatgtatacacatgtacatgtatatacatacacgtattcatgtatatatatatacatatatatagtgtggttaagcagaaacacacatgaaacatgtttgtggataaatacagttaacaaaaatgtgacaaggggctcactggagcctaccttgtattttccttaagagcagtagctcagtatttactaattcattgtttaaaggggctttacagagcgtaactaccatgcataacaggaatcaattgtacctaccagatttttcttgactaaactgttgaaaaaattttgtctctaacaattgggaaataaattgtacctttttctgtgtgaaatgaaacttgctcataaaacaattcaaaatctagttaatgcttcttgagagagacccctttcttgatcagcaggttctctggtgagcctatatagaatcatagcaagaaagcagccaatgaagacagaactcataggcttgaaacactaattgtaatttcttaacattttcagttaatacttatggtgtgcctcggaattctgggtgcaggctgggcatagtggatcgataaacac

SEQ ID NO: 519529 - DNA, 576 bp, Homo sapiens
gatattaaggaatagccatgaaatcatctggagtcctctgattaggtaaatatcaaggagaaaaaaagaactaggggctgtcttatagcttggataggcagagcagtatgctagaaaacaccagatctgggcctggcgtggtggctcacgcctgtaatcccagcattttgggaggccgaggcaggaggatctcttgaggccagaagttagagaccagcatgtgtaacacagtgagatcccacctctacaaaaaatcaaaaaattagccagtcgtgatggtgtacacctgtgatctcagctacacaggaggccaaggtcgggggatcacttgagcctgggagatcaggtttgcagtgagctatgatcgcaccactgcattccagcctggggagcaagcaagaccctatattaaaaaaaaaaaaaaaggaaagaacgcacaagaggtcagtcctgaggggctcctaggcctagcaaatccggagcctctgtttctccagctaagggaaagatactactctaatgtttaacccctggggtggttagggatcaaacgaatggcagatggcgaggccaggg

SEQ ID NO: 519530 - DNA, 740 bp, Homo sapiens
tgtgcccctccaccccccacctgagttttgccccccccctttggggacacgccacgaacactgcttgtgagaaggaagatggaaggtaatttctgtcggtctttcccctatccccagggatggacaaggacccacttagaaagaagggtctcacgtggctgcctggctcctccgtagacccccgttctgtttcaacctcgtgccccacccgtgcaagtcatcaccaacaaattgctcttaagttaccagagaccacatcccccccgggattagggttcaagtagcagctgctaacccttgcgacccagcccttgtgggactccccacaccagaccaagctcaggatgctggtgatgctaggaagatgtccctcccctcactgccccccaccatttctgccccgtggctctaccagcctcacccctccaacccgtgatttctccatcttgcctccccgtgctgcagcgcccagcggcatccccccagcatccagttggagaaaaggggaccccagccgtagagagcgatattggagtcttttgttcattccaatcttggatttttttttttccctaagagattctctttttagggggaatgggaaacggacacctcataaagggttcacaagatcatccatttttctgactttttaaatcattatcattattatttttaattaaaaaaatgcctgtatgcctttttttggtcggattgtaaataaatatacccttgtccta

SEQ ID NO: 519531 - DNA, 138 bp, Homo sapiens
ttcgtcaaaagcgaggacgtataagaagaaatactgaatgtcctccagtactccttgatggaagtttccatattgtggacagaggagagatgtctaggaagaagtcaactcttagttccacgtttatgtagtgttaat

SEQ ID NO: 519532 - DNA, 705 bp, Homo sapiens
ccacgcgtcggaagagaacaccaacatctccctggttcaggactggacctggagagttagcgtggcgaaaacggtgctaggacagtgatcgggatgactttccgtggatgactttggctctgagaatgagggggagctgcgtgctcggtaaactgaaatcacgcccctgacccagcagcccggaaacgaaggaggagaagggggctcccgatgccgggcccaggacatgagacaagcagaccaggagctggacagccgggggtgggccggactgacgagagacacccggaacgaagagagctctgagcaacgacacttgctgggggacagaaagccaccgagctgcacacaagagcccgggaagaccatgcgcaagtaggcctgacaaggcggaagcccgtgcagagccgggacttatcccatatgcagcagtggaacctcatactgcttgagcaagaagggaggcaggggcttagggagagagggcgatagttaaccgggaccaacagcaggatagaaggagatactgaggcacgcgagacggaggcaactccagaggagaaataaagggtgcacaccagtggacgaaagcgcggagccagactgaggacagccatccttaaccgccgaggcccgtacagcgaaggcgccacagagcacctgagagggtcaacacggaaacaggagacgcaggagccaggaaac

SEQ ID NO: 519533 - DNA, 543 bp, Homo sapiens
tggctcagtgatctcccgctttggctctcagtgctggattacaggttgagcaccgcgccgggctgcattgaacatctcttcatgtgcttatttaccatctgcagagcctcttcagtgaaatactcctcgtgtgttttgtcctcgtcctaatttaattgtttggtttttatactgaattttgagttttcctgtattctagataggagtctcttctcccagcttgtgacctctttatcctctcattggacgcctgcgcccatccagagctttacgttttgatgacgtccgatgtgttgagtttttttctttttcttttatagatcctgtttttggtgtcatggctaagaactcttcaccaagccccaggtcctgaaggatttttttgaaatttgaatagtttttccctcattggtttctccctggctgccttgtttctggtcttcagaagcctggttgagtttcttcgggttcatcctgcatggggctcactcatcttcagtctgtaggtttatcattctgacccaatctgtacctttttcagcc

SEQ ID NO: 519534 - DNA, 824 bp, Homo sapiens
aactcgttcttgaagggcggcggcggcggcggcggtagaggcgggtgcctgggtgggggcctgggagatgtgcttggagagcctgatcagcggggccgggggcgtgcggtggtggtggctggagcgagctggcgggctcgtggtggaggcggcggaggcggtggaacggccatgacgcatcctaggcggagatcattcagcgcccattacaggcgacggcggttgcgcaagtacaacccggagcccccgcccccagcagaatatactccaacattgaggccaacgagagtgaggaggtccggcagttccggagactctttgcccagctggcttggagatgacatggaggtcagcgccaaagaactcatgaccattctcaataaggttgttgacaggaaccctgatctgcacgactgatggctttggcattgacacatgtcgccagcatggtgggccgctgatggatagcgacaccacagggcaagctgggcttatgagggaatttcaacgtactttgtgggaccaaccactcaaaagggtggcagcgaccattataacaaaacagagctttcgaacaactgacccggagtcgaggcacccaatattggcgggtaggtgaactccccaggttgcctattagagggccgcggggtgtttccaccctgaaatagagcccatctctattaacagtgatcatccgaacgctacctccagattgaacaggtgggcaacatgggtttggagcaacttacatcaggtggctatggcgaggctggaaagcatggttccgtggcttcagaattttcttgccacagattgcgctg

SEQ ID NO: 519535 - DNA, 477 bp, Homo sapiens
acttctctgaggacagaagaaggttgagcccctcatccctgattggagctaacgaaggcttactttgtacgtcgagaatagaaacgggaagatggaatgtggagccatgaggaggagctcgataactcgggtgaatagcaccagaaaccagatgccaccccatggtgctgcgcactccagtctgtagaaaggtgctctgaacgaggtcatagactctggccaggactgaggagcctccggttccagctctcgcgctctgcctgggaccctcgtgaaaacttactctagtcaggagcaattcctccaggccatgagagggcgctctgcaccctcaggcctcgatgcgtgctgctctacctctcatcagcccacagtctgacacgatgtcttttcttgtccctggtgagtcccggatgtctgccggtctacacaacagccctgagaacgggctggacaaccctggggggaaccacgctt

SEQ ID NO: 519536 - DNA, 602 bp, Homo sapiens
tttgaactttatttgaaaaaaacagaagataattgtttcaaaaaaacacacaggtggcgggggaggcacagccaggtgtgcggcagcagggggtgggcatccgggctaaggctataactgtggcggaagctctcatcggatttggcagtttctgggcccccaagccgtggggcccgggaacctcgaagaggggtgcaacgtgggaagtgggtgaatcctcgtgtgtggacacagtgcgtgtgggctatagactgtgggggcaaagtggggggggcctctccaaagcgggaactccgaagtgtgttgggtgggccaccccctcctcaggaagggggggggggggagggaacaaacccgaagggggggggcgcgagggaaaaacactggaggtaaaggacgaaggaagggaaacaaaacaaacccagacctgctaggtaggcgcgaaggagacactagcgcgactagagcgggggaagggaggagttccatttcccacccaaaacagacacacgaaacactccaccccgccccgcggggcacggggtacgtggtgtacgaggagcagagggagagacgtaaaccccaaaaaaactcagaagacc

SEQ ID NO: 519537 - DNA, 656 bp, Homo sapiens
  misc_feature (622)..(622): n is a, c, g, or t
ggggggcatggtttttcttactggggacaggctggtgctgtaaaaattcacatacctgccatccatacaggcatatgtcgcttgctctaatgccagttcatagtatccatactaacatccggcttgcgcgcacaaagggatgcagagcgcttgacaggtctgtgttagcatgtttcgcaatgccaggggtgtttgcaaaacccctaatgctttccgtcaagccattgtatgtgagcaatcaccctaggcccaattaatccatcagggtccacctgtgataaagatggccatttgcttacttaaagcccacttaatgactgcttaactaaattcgtctggaaaggtaaaacactttcctaacagcctgaaatttgttagtggttcaaggtcaaaaggcctggtctaggcctattcaagtgattaataaacagtctttaaatggaaatctcttttgaaaagctgatggtgcctttaaaaaaaaattatgttggtgggaaagaataacctttccccctgaataataatcgtatcccaaaaaccgggatatagctaccatggaaagggccattgtttattgaatggaaacttttttttctctttaaatgaaacaaaaatggttttnaaaaataaaaagggccggccggaaaaaaccccgc

SEQ ID NO: 519538 - DNA, 1122 bp, Homo sapiens
agcgggatgacctcaccatggtggtggatgacctccgtctgctgctgttgtgaagccgatgtgatggacatcgaagcgtgaggtttcttgcttccgagggtgctgtcatccactcaaagaggcttgcatgtttgtcaggctgatctccgagaatgctgcggcaagcctgggtccaagctgtgcaatgccagctatcgctctctcgatctacctggagagccctgatcagtgtgctatagcgagaggctggacccggaacagtagtccccgatccagcgaggtcagcatacgatctccgccatcgatgacttcgggagcgtggcgtgaagggtgacgagtgtgctggacgcgtgtgtcagcagtgctggtgcggcctaacagctcacgttgctggccgagctgactgcccagtcctggcacccccgacgtaggggcgcaggcaatcccaaccatgggacagatgcatgcatctgccaattgcacgttgtcatacctgcgcctgtaccatcagagtagactctggggtgatctcaccttggcatccaatgggctgtcgagtcccttgtaccagctgcgactcgttggggagcctgaagctgctaacaaggctggactgtttgtgatagccttgtgcataatcaggtcgctgttgcaaggtcccgttatttccttactggacagggcccacagcatgtttgaagcgggctggcaaggcaagccaggtaaatatgccccgacaaagttcatgcaagacatccgcgagggcatgggaaccaaggcaaggggaccctgggaatccaagggatcgacattattagccgtagggaaaagcacgaaagattttacttgcgtggacggggcgccccattggtctacctcatggccacttgctaagtggcccctcatacgaatggcctgtggaggggtgtcatagaacaatgccctggtggtgaccctctacaggtcttctacccacgtgggactcccaagattgggccgaccggcataaggtcccgggccttgaaatcccggtatctgtccctgattaatgtgacctcttcttgtgtcctctcagttggggcaacccctgtgtatgtagcaaaagattccaccgagatatcg

SEQ ID NO: 519539 - DNA, 439 bp, Homo sapiens
atgaggtgtcacaggcttggcctgtagtcccacctactcggaggctgagcaggaggatctgtggatctcataagttcaaggttgcaataagttacaaacatgccactacactccagcctagtgacagagcaacactgtataaaaaaagaaaaaaaatatctggggagaaaagttcaatgaagttccaaaaagtaaaacttgaatttgccatgtacagagactacattgaattcatgtgaatgaagttatgtgtaggcattctattaggtattataagtaacccagagattatttaaagtgaatatacatatgtacatgcaaatatatatgcaatatataaaaagccaaagccattttatataagggacttaagcatcctaggatttgatatccacaaggtcctagaatgacctctacagaacaaaggatgactgatgac

SEQ ID NO: 519540 - DNA, 102 bp, Homo sapiens
gcacgtgattttaaaacattttctaatttcattcctattatttttgagacagggcctcactctgtcgtctaggccggagtgcagtggtgcgatctcagctca

SEQ ID NO: 519541 - DNA, 138 bp, Homo sapiens
  misc_feature (29)..(29): n is a, c, g, or t
  misc_feature (64)..(64): n is a, c, g, or t
  misc_feature (94)..(94): n is a, c, g, or t
tgtgagaaccccaggtaggtaatttcctntctattgtactcatagtttgtttgaaacctcttgncctctatcccttattgttttatactctgtnaatctgattttacctttaataaacttttctgaagtgaaaaaaaa

SEQ ID NO: 519542 - DNA, 470 bp, Homo sapiens
cgtagaacatcatggatcatgtgtccattctagctcagtagaaatctgtcatacttgccttctggttgtaatccttgactacaaatctcaggttggaatttcagccttagccttcaacaagtactttagctctacatttagcacggcatggggcggagtgctgggcccatgtgaccgggctgtccttcttctgctctttcaattgcttataaattgcctgctccgaattctactgaaaagtccagaatcaggatgctagaaataaaatattttaggcaaccctctgaaaatttatcctattcaaggctgttcccatgtttggcaatttaaaaatctaagttaaaaaaaaaattaagcatccctgttatagggacaagaatgcagaaaaatagcctctgctctaatgaagtaagatatgttcgatgtcatcagcatccactccaataggagtatagattttgcttgccagt

SEQ ID NO: 519543 - DNA, 197 bp, Homo sapiens
taacattgcagagctgtttgcgtgtgtaagactatgcgagccctggagaaggctacatcaaggactgtgtctcccccagcgagtacactgcagcctgttccctggctcctggtccaatacgaagctgccttcaggcaggtccaggcctcagaaatcagctctattgacgaattctgccgcaagttccgcctgccctc

SEQ ID NO: 519544 - DNA, 387 bp, Homo sapiens
  misc_feature (325)..(325): n is a, c, g, or t
acagaatctacccttgacacccaaccttctccagccagcagtgtatctcctgcaagatatccagctacatcttcagtgacccttgtagatgtgagtgccttgaggccaaacaccactcctcaacccagcaattccagtatgactacccgaggcttcaactatccctggacctccagtgggacagataccaaaaaatcagtttcacggatacctagtgaaacatacagttcatccccctcaggtgcaggctcaacacttcatgacaatgtctttaccagcacagccagagcattttcagaagtccccacaactgccaatggatctncggaaacttaattcacgtccatatcactggtattgtggtcaataaggccaaaggtgggattt

SEQ ID NO: 519545 - DNA, 257 bp, Homo sapiens
aacatccatgaaccaccaccatgtatcccaattttcttaagtatgtacttacgaaacagcagtgaggtgtttttgttttttgagatggagttttgctctttttcccaggctggagtgcaatggcacgatctcggctcactgtaacctcctcctcctgagttcaagtgattctcctgaacccaggaggcagacgttgcagtgagccaagattgcaccattgccctccagcatgggcaacagagcaacatccgtctcca

SEQ ID NO: 519546 - DNA, 198 bp, Homo sapiens
tacaatatataagatataatagatctagtaaagtatataagccatcctcttatatattaccattcctcttacatatgtacccatacctcttatattttttaaccattcctcttacattatttacccattcctcttacattatttccccgttcctcttatatattttacccattcctcttatattatttacccattcct

SEQ ID NO: 519547 - DNA, 201 bp, Homo sapiens
gaaatttttcttaaaagagggggaaaggaaggttcccttacccccaggcccccccctagcaatatcaaccattacccttccctctacacttatcattttcccaattttaattttactgactatcctagaaatcgcggtccccttaatccaagcctaggttttcacacttttagtaagcctctcccggcccgccaccccata

SEQ ID NO: 519548 - DNA, 136 bp, Homo sapiens
gtataaagatggtaaagcatgtcgctcattctgattagcggcaattgctgattggtttgcagttatggtttgatgttgtttctgattgccgcgggcctgactctggtcttcggcattatggatatcatgaacctgg

SEQ ID NO: 519549 - DNA, 283 bp, Homo sapiens
ttttccccggggaaaaatttttccccctgggcccttttgggggccccctaaaacccggtgtgtcccaaaaaacgggggggggggggggggggtttcccggggtttttttcccccccgggggggggtttttttaccccccctttttttttaaaaaggggggggtttgggggggggccccccccggttaaaagggggaaattttttttggggggtttttttttttttttttggggggccgggggggggcggggtaatttttttcccccccctttgttttttttta

SEQ ID NO: 519550 - DNA, 252 bp, Homo sapiens
gcacactactaccatgccttgttgtacttatttattcagtatagatagggtcttattatgttgcccaggatggtctctaactcctgggatcaatctccgtaaagtactgtagcgtaggattacaggtgtgaacctctgtgctccagactagagctttgtatattgtgatcattgtgttgtcccagattattaccatcagcgcaactaacgacgtggcagacatcatatacctgggaaaagtatccttctagg

SEQ ID NO: 519551 - DNA, 461 bp, Homo sapiens
cttgtacactcttgttgagcacgtaaaatggtgcagttgctataacaacttccagtggtgccccagtaggttaagactagtaatctcgtaagacgtagtaataccacctctggctatatgctccaaagcctgtaaggtaggatctcaaacagatgtgtgtcattctagcattatacttgtcaatacgataatgtacatagttgtacatagcgccattatgtacaatagccgagagcatcgcaagtgtccactaatgcatgtatggatgaacaacagttataatataggtatatgctttgcatcttgtacaaaggaagcaaactgtgacagatgctacaccatagacgcatctcgagcaccctgtgctcagagcactaagacagtcacaggcagacaaatcagtcatgattcaactgatatgaagtgcttgcgatagtcaatcgaacagctacagatagtag

SEQ ID NO: 519552 - DNA, 203 bp, Homo sapiens
aaaggcacatatatccacacatgcacacacagcacacacacaaacgcacagcacacacaaacgcacagcacacacgcacacacagcacacacacgagcacacagcacacaaacgcacagcacacgcacacacatgcactcacagcacacacactagcacacagcacacacacaaagacacagtacacatggaatgcacacaca

SEQ ID NO: 519553 - DNA, 423 bp, Homo sapiens
  misc_feature (164)..(164): n is a, c, g, or t
  misc_feature (180)..(180): n is a, c, g, or t
gggaagggaagaatttggcacaattgaagaaatgaaaaatgaaattatagaaccttgttgctggagattgcagtgagctgagatcgcaccattgcactccagcctgggtgacaagagcaaaactccatctcaaacaaaacaaaacaaaacaaaaacagaaaagnaaagaaaagaaaaagnaaaggtgagtggatcacttgaggtcaggagttcgagaccagcctggccaacttggcaaaacctcatctgtactaaaaatacaaaaattagccgggcatggtggcatgcgcctgtaatcccagctactctggaggctgagctgggagaatcacttgaacccgggaggcagagattgcagtgagtcgagatcatgctactgcactccagcctgggtgacagagtgagaccctgtctcgaaagtga

SEQ ID NO: 519554 - DNA, 412 bp, Homo sapiens
  misc_feature (228)..(228): n is a, c, g, or t
gcggccgcctactactactaaattggcggccggtcgacaaaatgtatgaattcagcaaccataagtgaaattgtacacataatacttagcatagtacacaatatgtcaagtaatcacaaactaactgccattgcacttccttgttaatctgcatttctcctgagttttgtgatgtcaaatatttcagatttgaaaattacacatatctccctagggcagcggctcatngctgtaatgccagcactttgggaggccgaggcgcggtgcatcaccgtgaggttcggcacgtttgagaccagcctgaccaacatggagaaacaccatctctactaaaaatacaaaaacttaccgggacatggtggcacaccgctgtaatcctagctcctcaggagtctgaggtagcagaattgct

SEQ ID NO: 519555 - DNA, 827 bp, Homo sapiens
cacaccagggggacctgctcaagtccaggaggacctcattcgcagaaaggctccttccccaccagaggacacctgggtaggcgggaaacagtgctttcatgtacccccccagccacacctttggcctatgggaaaagcaaggaactcaacctgggtgtgttccgtctggacccggggaggcccctgaaggccaagagggaaactcgtccccagctgtgtctgtcctaggggagggggacatagcccttacaggagctccccgcccctcttggcactctgacacaccaggacacccatctggggccccctttgccacgaagagctgggcaggcctcagggtgtggggaaggaggacaccacctccagaaaggaagcgtgaacccccgggaacaagcgggtcccttccctcctcagacacaagccaccctcagcttgtggctctttggcccccacgccccaccacaacccaccctgttcactttattcgaccacgagccatgagcacgctgatatttattggacactttgcacccacatgcccagcacttcggcttggagttatccccatttggtttctcaccacgccggtatttattgtctgctcctctgtgccccggtgctgtgctctgggcacggggcacctgcatgggctgcctgccctggtggagcttgtggtctgatgggtgaggctgacccacagcccccccccttgcccacagggcccgggcacagagtacacacaccggggcctcataccaaaagtctaaatatttaaaagttatccatccagctaaccactgttaaataaaatatgttctattctccta

SEQ ID NO: 519556 - DNA, 207 bp, Homo sapiens
  misc_feature (30)..(30): n is a, c, g, or t
  misc_feature (93)..(93): n is a, c, g, or t
  misc_feature (124)..(124): n is a, c, g, or t
  misc_feature (166)..(166): n is a, c, g, or t
  misc_feature (198)..(198): n is a, c, g, or t
catctgtcagaaacaaaatggttgttggtngagcacccaatgctgtctgcaagtctttcggtaactttcactctctactttgtgtccaatctnggtatcaaagtgaccatcaacaagctcaagnatatctccctccgtagaatgcccgaataacagtttctgtgcntccacactccctgaggaatagatgtacacctncattccggc

SEQ ID NO: 519557 - DNA, 443 bp, Homo sapiens
gatggcgcccttgccatttttaattgctctcgtgaattcgcggccgcgactgtcacgatggttcgcccaaccttactaccttcggtcggccctgctctctgctgccttcctactcgcgaggaaactgccgccgctctgccacgatctgcccacccaatgcgacgacggtaacccgtgcgactttgactgtagagacgtggcgaccctgatgcttctcagtgccattgtgacgatgaagaaccgcagatccataactgtggagcaacatataggcaccattttcatgtttagcaaagtgcccaacacaattcttttcttccgcttgcatattcgcatggccctactttacatcacactctgcatagcgcctctgatgacgcccaaaccacccctatatacgctcccctgagtatactcgtacttcacacgatcccattgctggg

SEQ ID NO: 519558 - DNA, 215 bp, Homo sapiens
gtccccctatcgtgacgggggcgtcgtcaggatctgaatgagctgaaagggcctgtggaagagttgaatttcataacctataacatcacatctaatgctttataaagattcaattgtggacttgtacagataggcgttagacggtcagaatcctttgtacatctacgtgactgtcagccggcatacgcacaacctttaatcatagtactttccat

SEQ ID NO: 519559 - DNA, 332 bp, Homo sapiens
tctcttcttctatctgggctttcttttgagctcttctttgttattacgtagcttctttagctctttgtcagacatgttgctgtatcagcattcagttgttcactcttattcttccatctgtgaagggggtttgtccagtgaagcttcgaaatagatctctatagcacattcatgtgcgtgcccttgcaagtaaacctggatgctcgtccgaagtacatcttcgtagatttaataataagtccaccatatgatcattaagggtaatcttccgtccatacagtatgttttgacaagtcaaaacctggtcaacacagagatattccttataaaaa

SEQ ID NO: 519560 - DNA, 586 bp, Homo sapiens
tgcagtggctcatgcctgttatcccagcactttgggaggccgaggcaggtggatcacctgaggtcaggagtttgagaccagcctggccaacatggtgaaaccccgtctctactaaaaacacaaaaattagccgggcatggtggcgcatgtctgtaatcccagctatttgggaggctgaggcaggagaattgcttgaacccaggaggtggaggttgcagtgagccgagatcacgccactgtactccaggctggtgacagcgagagtctgtctcaaaaaaaaaaaaaaaaacaaaaaaacaaaaaaaaaagagacaagcacactaggattagcgaatgctatacgagcgttgtcaaagtaccactaagacatcactctacagtttacaacagtactacaacgcttcccttccttggattcgtggctaagtggtgtgccacacaggttcgcctcaacaatttttttacattgagtcctctcctttttggggatttcatacctgtctatcgcctctttttaaagcctctttgtgtggctattgcgctaacctctttcataatttgtgggtctcacttcttttcgcccccc

SEQ ID NO: 519561 - DNA, 139 bp, Homo sapiens
taaaaggtaggccccagctctatgtcagcaccactctcgtgttctccgaaatcagcgctgtgattgctgcctgccttgttggaccgtccgggacctcccgctccctgtcatttcatcgcgactgtgcggctgtggttgg

SEQ ID NO: 519562 - DNA, 446 bp, Homo sapiens
agaagagtgtgcaggtatcactcgatctctttctgtgtcgctgtgacagatgacatcatacgtggatacagtccctgtgcactcacataatggcctgcagatgggcaatatttctccccttttctcctccactttacagagcaatcagaatgcaaatgaaggagagagctgtcagtaaaagctccaccttcaaactgctcaacttgactccccccgaaagagagaaaggaggaaagaaaacaaatcactagaaaacattgtgatttaagacaaggaggaaagcttccttgtaatatatggaacaatgtcccaacaatgacatgtcacacggagctgggcaccatgactgcaatcacattacagaaaactgaagtgggcatcaagcctagaacatgttggaaataaggtcaatttgctccagccaataaaatcaggcagcattttcg

SEQ ID NO: 519563 - DNA, 158 bp, Homo sapiens
ctgggtttgctattacacctcctatttactctcatacccttctcgttagtccttcatatttctctgcctctattcttctatactgcagatttttctcacctatggtacaaagcaatggcgatgtatcttttcatgtaattggctttgggaattctggt

SEQ ID NO: 519564 - DNA, 811 bp, Homo sapiens
gctgcgctgtggactgaagtgaaccggtatggccagaacggcgacttcatgcgcgctctcaagaccgtcaataagatactcacagatcaacgaagagatgacgtaactgaccatgcattgtacaagtggtatgccttatccagaatggcagagtttcaaggaagctttgaatgtcatcaatactcacacctaaagtgtaagccaataactctctctcctttgcaaaggcatatcgcgagtacaggctgaacagaattgagaatgcctctgaagacaagtagaaacgtgccaatcagcagtacagacaaactgaaggagcttttatggacaagtgttataccgtttggaacgcctatgatcgaagtgcttagcagtgtagtagagatctcgtccgaacctcccaagatgattatgatgaggcgaggaaagacaaaccctttcagcagttgttgcgaggctcaaagccaattcgggaaaaagtcggttccagagaacctgggcctccatagaaggcactacatgagctgtgctacaacactgcatgtgcactgataggccaaggccagctgaaccaggccatgaaaatcctacaacagagctgaacggttggaagtctgttaaccttatctgtaaatataacgtgcatataactttgtagagtatcttctaacattgcagtccgacttctgtgacaattattaccatggacagttattcgatgctacactcaagaatgggaacatggcgcaacgaaacatgcttgcaaccgcatccagaagactagatcatatccctcaaagcccccaaacag

SEQ ID NO: 519565 - DNA, 198 bp, Homo sapiens
cccgtatcctaatacgaactgcacctcatggttctagtcggatttgttaaccactgcgccacgatgggaactccctctctcactgttaaaaatcccctattattaattacaatgatgactgctgatgactaaacaggtgtccggaacaaactaaatgttttactcacatcgtctcatttcattctcacaacgacccca

SEQ ID NO: 519566 - DNA, 982 bp, Homo sapiens
ctaaaaaagcaaccccagcaccccaaggccgctgcgcgatccgactggacagcagagagcgcatgtcgagccagagtacgagcgagcatggcagaagagaccagcaacagcagcagaagtagcagagcggagcacacagagcagaaaactccacccccgccagcctagtccaaactatcctgccatcagtcgactagcaccacacatggcagaccagcagctacggtctcccactctaagcggaacgcagtgagacgagcgaaccacaaaaagagcgacgaaagagcacgatataatcagcgacacggaaggcagccaggcatcaacgacaccggagagcatcacacgcgcgctccgagctcactgcacctcacagagagacagagaccgctctccaaccaagctggcgcgtccgagagagcagcccgagactaacagcaagaagaggagaccacacgcgctcgtgcagcagcattacacacacatagcgagacacagcacgagggtcacgaggagcaaacggacaagacgcactccgcacaagcagggcaaagcgctcagagacagcgcatacgcagcgcagcaagcgtccaaacagaaaagacaaggatacaacaagacggagctacaatataagagctacaaggaattcataaaggaatagcatacgagcaagccagtagcgcgacccagacacgacagacgcgcgcaacagtgtagcaacgcagtacatccgaggcatctacactagcaacaagagcgtaccacgcactatcaggacccgaccagcacgaaactaccacgagctaccccaccacacagagcataaggcagtactacaacgacatcaatagaacccaaccacacacactaaccgtcactcagtacatgcagcactcacacgacatgcatcacacagcagtacgaaccacacacgaaacacataacagagctcaccaacacacacactccaacaacagcg

SEQ ID NO: 519567 - DNA, 151 bp, Homo sapiens
gtcgtcatccgcagcagtctgttacaaagtgccatagcactcgatacagccggtcacgcaggagctggtctcaccattaatttggataggtggatcgttcgtgccaagactctatcattcgttacggataaactggtgtacgcgatgcggg

SEQ ID NO: 519568 - DNA, 192 bp, Homo sapiens
ttaacatacagtattgggtacagtaatgtgctgtgcaggagtctgtaaactaggagcagtggaatgatgtagccgaggcctgtggggggcgctgccatccagttgatgcgcacactccgtcatgctcccacagcagcagagtcaactgaggacctatttctcagaacgttttctctcggcaagcacacgcga

SEQ ID NO: 519569 - DNA, 349 bp, Homo sapiens
  misc_feature (313)..(313): n is a, c, g, or t
ccgatgctttgggtgcatgcatgtgcatcgcacatggataaaaaaaaatcccctatctgcccagtcaaaataaatgtacacctgaaaactcagatgcaacactaacttgcaaagattcccacaacatacaaaagaagtgatgctttcatgtgctggccgtggacaaatgtggaaaaactgaagcgtatacagcgctgtggtcagaacaacctcatgtgcagacaggggtggactgtggcgtgccgggcagcgtgcgctatgcaactcagacctgggactgaacgagacatccgacattaccttacccagacgncctgacgacgtgaaaaccagacgattaaccgaactc

SEQ ID NO: 519570 - DNA, 118 bp, Homo sapiens
atgtgtctgaactgctacaagtgaaggaggaagttccacagtgtctctgtttgcctcctcctccataaacccacggcataaggccccggcataaggtgggcccacggcataacggtgg

SEQ ID NO: 519571 - DNA, 229 bp, Homo sapiens
  misc_feature (4)..(4): n is a, c, g, or t
  misc_feature (228)..(229): n is a, c, g, or t
tttnaactcccttcctgcagtccgctctagaggatccccgagtgggtcagtgtcttcactctattcactgtagaggaccaaaaccaattctccctaaatagaaagtgctatgttataatcaacttgaaacaggtagtttcattttgaagccccgcagggttcaactacttgagggaatagtctggtaataaataaaatactatctcattacaaaacatcctttgcttnn

SEQ ID NO: 519572 - DNA, 317 bp, Homo sapiens
agattctttccatggttcaagtatgcagctgctcacccttgggaaagccacggcgcactggtgcacagagacaagccctctcctcacttggtgatatgaagtgagggagtgaggggtatccctcagcctaggtggctttatttgtctgatccctatcctgcctgcgagcctcactccagtaccctctacaatcccaagaagacttaagaatagcctgggctataggattttcaagaagcaggaactggccagttcctgcttcttgacattgcagaaggactgaacctgcataccatccgcgaccgagtctggcagat

SEQ ID NO: 519573 - DNA, 665 bp, Homo sapiens
gatgtagaaataatggaattcttactccccgattacaccgccccctggatccaggactcacacttctgacccgcgctgtctttttggggtttttttgagattggagtctcgctgtgtcgccccgactggagtcccatggtgggatccggctcacctgcaacctccacctccccggggtcaagccgttctcctgtcgtcagcctcccccgtagctgagattgcacggcacatgcccccaccgccccgctaatattttgtattttccgtagggacggggttacacccactgttggcccggctggtctcgaactcctgacctcaagtgagtccaccccgcctcagtctccccaagtgctgagattacaggcactgagtcactacgcccggcccacagtctgtctgtcttgaagtgtgagcaagcagctgtggtcaattaaacccattagtttaacccctctagaactggggtctgccaaactcccaccctgcagcccaatttggcccacctcctttttaaagtaagggctgtgagagtggtttttactttttttaatgatttaaaaaatccaaattatattctgtgaccatgaccggtgaatttatatgtgaccagtggaaattatatgaaatttaagagtccataaataaaatttgttgggacacca

SEQ ID NO: 519574 - DNA, 465 bp, Homo sapiens
aagaatattgtactccaatttttgtatccacacaagattagaatacaaataacttacccggtccatagtaaaatcagtatgtgaatcatggatttttgtcaaactcatttggttcggggattacaaatttcaaaaccaaagttaacaaagtgagctagaagccaaactaaactagaatctgggtcttttaaactacccagttcaaagctctttagtaaaaggggaaagactaacaccatacgaagagaaaccagagtataagttcagaacacagattcaaaggcacaaatctttcaggaaaacatcagtagaaacaacaagacaccaagacaaaactaagtctgaatcgattaaaacacatgactcatctattcataagctctagacttagaagtcacattaagaaacttcacaatggatctttaaaacacaaaacagactttaaacaatggtaaggaaagctca

SEQ ID NO: 519575 - DNA, 402 bp, Homo sapiens
  misc_feature (400)..(400): n is a, c, g, or t
ctgggactcctccatgctttctgtcactgctcaggccaaggtctatgaacgttgtgagtttgccagaactctgaaaaggaatggaatggctggctactatggagtcagccctggcccgacctgggtgtgtttagctcagcacgagagcaattataacacaccgagcctacaaacctacaacccgtggagaccaaagcacctgactatgggatatttcagatcaatagcccgatactggtgtaatgatggcaaaaccccaagagctgtgaatgcctgtgggatcaattgcagtgctctgctgcaggattgacatcactgcagccatacaatgtgcaaagagggtggtgagagattcccaaggcattcgagcatgggtggcatggcgagcacactgtcaaancg

SEQ ID NO: 519576 - DNA, 1173 bp, Homo sapiens
  misc_feature (673)..(673): n is a, c, g, or t
  misc_feature (706)..(706): n is a, c, g, or t
  misc_feature (898)..(898): n is a, c, g, or t
gccaagatcagctactgatggtcgtcgcagaacgtgaacgcgcgctcggtggctgaggctcctgcggtatactggtcgtggtcgatctatcctgattctccagacctcggtttttacatccccgtcgtccccaaggtttacgcctgaaacagtgttgtgcaaggacgggaaccattgacagcacgatggtgagggactgaggacggtggatgccatcgaggctagaacgcatgtgatggtacactcgcaaagactagtccactgcaagcgcacggctttcacggtgtcgcctgtctcaacggcgtgcagctgggcatcgtgggtgcccaagagcagtccaatgtgacatggcatctagtcaaggtccttcgtgatgaactgcagtatccgagcatgattcgaagaccaggcagctggtgccttattgctctggtgccaaaatgacatgatgcccgcgccatccccattgcttagtctagcactgtgctagaatgagacagcgctctgctgaggtgatgccgcatgcgtcgctgtcactagagcgttacgcgtgacgggccgtgtgggagcctatctgcgggacactcccgagaaagtatcctaggcatactcccttgaaagtcaagtaatatccttgctgaacgctccgcagtcattccgaagagatgagccntagtaccctcgacaaagcgtggggctggtgccngcagggggtggcaagtgaggtgtgctaccagaggaatgggcgtggaaagcccgggtgcgaggaggagaaccatcaccctgctttccttgtgggtacccctggccccagtcagggctattgcagcgagtctgtgcacgtcgccggccgcctggcgaggtaacgtcgctggttggaattcgaggtggcctgcgnccttgctgtgtccgtagcgtagtaccagcgtcctagttacgctcctgggcgtttcaccggcggggaggaggaggaggccgcgctgggcgtcggtccgaggggtctggaatgttggtaggggccgtctttcgcggcagaggtggcgggttgcttcctggggtcaattgggcacaagatgggctggcccatgggtgcgcccctgtggcctaccagagcccttgttggagattgggtggcctttgtcttgttcgcccgcttgtcgtggttcgggacaa

SEQ ID NO: 519577 - DNA, 103 bp, Homo sapiens
gcctgacagcagcatgtgcagcggtggttatggaggtggttcatggtgatcagcagcaactgtgagttgtggttgtggaggtgtgttatggtgatcaggcgat

SEQ ID NO: 519578 - DNA, 364 bp, Homo sapiens
gtgggcccatcccctaaatttcagattaaccccatttaccccaacatgtttatcaaaccttttagagttttatttggaaagaaatcaaatctctgtatccccttgaggagaatttggatttgtttgaaattatctttttacccccaagcccttgtttttttctttttgaaaattttttatgtaaagttcccccaaatattttttttatttacccccaaataatttataatttataggggttggaccctttgcaaaaagtgttttttaaaaaaaccggattttatattttcttgcttaaataaaaaaatcccatttatatgtttatgggggtttaaaataaacccattttttttgtatataaata

SEQ ID NO: 519579 - DNA, 109 bp, Homo sapiens
agctccactctgcccactcccagcacggtctaacatacagccagcagcacatgggcagtgggcagcttgtccttgtggcaacacagccacagcacatcagtatcgggca

SEQ ID NO: 519580 - DNA, 1111 bp, Homo sapiens
  misc_feature (111)..(111): n is a, c, g, or t
  misc_feature (626)..(626): n is a, c, g, or t
caaataaagtataggcgatagaaatcgaaacctggcgcaatagatatagtaccgcgaagggaaagatgaaaaattataaccaagctagtaatatagcagaggactaacccnctatagccgttctggcgagtaatgaagttaactaggaaataacgttggcgaaggaggagccaagagcgtaagacccccggaaaccaggacgagcgtacctagagaacgagctaaagagagcacacccgtctatgtagcagaatagtgggaagatttataggtagaggcgacaaatcctaccgagcctggtgatagctggttgtccaagatagaatcttagttcaactttaaatttgcccacagaaccctctaaatccccttgtaaatttaactgttagtccaaagaggaacagctctttggacactaggaaaaaacctgtagagagagtaaagagttgaagacccatagtaggcctaagagcaggcaccaattaagaaagcgttcaggctcaagagccactagctaaaagagtcccagacatataacttgaactcctcagagccaaattgggaccaatctatcaccctatagaagaactaatgtgagtataagtagcctgaaagattctcctccngataagccggcgtcagatcagaacactggactggcatttacaggccaatattctacatcaagcaaaaagtccttatttaccctcatggtcaacccaaaacagggtggtcataaggcaggtgacaaacggtaaagggatcgggaaactttacgcggctggttcccaaaaccatacgcttataattcaccggttggagggccgccgtgtccccgtgacagggttacggggccgcgggacctaacggggcagggggggcaaaaaaccagttggccctaatatgggaggcacgctttataatggtcccccaggggggtacacagggcgctcaataaccacgagaaaaaacgccccgggaaaagagggaggtaaacaccagatgagagaccagcggggcgtatatttagtgagcggctgaacaacacaggtgcttactaaaacaaccggtgtaataaggtggggcggcgagacaacacaacaacagatgt

SEQ ID NO: 519581 - DNA, 502 bp, Homo sapiens
gagcttaacattcatagatcagatcggatgccatggtgattcaatgccaaatctcaagtggcttcttatttacatccatacaagaaccgggtatgaacgcgattatgtacaaatgctaatttaaacgcatggtaaatccaataagaacactaagatgtaactgatcaagtaactgagtgatgaacaaccacacattccccctctccaaatttgtctcacgttaagataaacccaatgccatcactttggcctcttatagtagtatttggggctggatgtgggggctcatgcctgtaatcccaacagttatgaaggctgaggtggaaggcatagttgagcccaggagttcaaggctgcaatgagctatgatcataccactggactctagccgggacacacagagcaagaccctgtccctttaaaaaacaaacccaaaaaaaagcaaacaactaaattaccataaaagagggtacccgcaaggccagatgcgggggctcatgct

SEQ ID NO: 519582 - DNA, 913 bp, Homo sapiens
tgatgttaaaaatgataatgaaagcaaaattagctgtatctgtaattttctctctagtgccaaatgaatgccttagctactcatagtgcatggtactgtaagtgaagacctgtagctttttttttttctttaaggaaaagcattataatgatgtagcagcatcagatataaaccttaaaaaaaaacgggtttcaattaacatttatatatggataaggcttggtaaacgtgggtacagagaaaggtggcagtgggatcaagtataaacccatttgaccaagccaaaatcagcaccctaggcccttaaattaaaatagagataccccacaaaatgaaatatttggaaggactgggaggggacaagacggggggactatcccccaaggttgcaagatacttttcaacagtgtgctactcataatacttggtcttctggcttacagtcaggaaggtttccgaggtaatctgtcatgtaataagataccctattttcctaacctggatttacacggacgcgttctcaaggtgggctaaaatgagggtcatttattggaggtgagccctattggaacattaccagatttgatcctccgtgggatgaattcagggaaacttctttgtccctgtggtcctttagaactttctaagtggctgaaaagaagaaaaatgccttcttcacgggaggggactcatgctcttcaccagttaagatacagaccctttattttttgaaccatacaagggccggtaatagcagctaacggaaagcttgaaccggtttcacggggcactatatgcttcttttcttaacccacacgtcaaattcgctgtggtggggttaacacttccctgtgcccgacgcatataagcgtttagaggagttgtttccacacgtcttgggcacaaccattgg

SEQ ID NO: 519583 - DNA, 194 bp, Homo sapiens
aattcatgtgatatgcttacgggtaagctcagagaagggtcggatctgagagatggggaggcctgatgtgggagtggggggccttgctccagcccgcgatcccctactgtgacttgcttaggcgtgtcaggctccaggctgcagtgggctggtaccacatttgatggatgaggcctgggtgcctattctgacta

SEQ ID NO: 519584 - DNA, 119 bp, Homo sapiens
ccaggcgtccatgccagataacacagctactcagaaagtttgccacctcatgggaattcatgtgacagatttcaccagatccatcctcactcctcgtatcaaaggttggcgagtcgcca

SEQ ID NO: 519585 - DNA, 582 bp, Homo sapiens
gggggctctctctggggtactgctctgccccttttcttcttctgctgggaggttggggtctctgggagctctgcaggtgcagacacccccacccagaggttgcagctcggatggagaaacaggctgggtcacaaaagccccgggaggcagcccctgctgtctggcgtcttctctggggaaagctttccggagcctgatggaggaagacagaggaaagagacctgtgttccctgatgcaactggccagccgcttcccggggaggaggaggcagaaatacacagtaactgattgttgcctttggtctgtgaactgtactatggaacactggaacttactccttcacctgactgcatgtttgtgccccataaccagcctcactttctgtctgcctctcacccacacaccctgcctagcctctgggaaccaccagccaactctctgcctctgtaagagccactctttcagtgcccacaaatgagtgagaacatggtacatttgtctttctaccccggcttacttcccttaacatgacagccttcaattccatccatgttgttgtaaacgacatgatttcaaaaaaa

SEQ ID NO: 519586 - DNA, 972 bp, Homo sapiens
acattttcaaagccccgtctctactaaaaatacacaaatgagctgggtgtggtggcacatgcctgtagtcccagctactcctgaggtgaggcacgagaatgcttgagcccaggaggcagaggtgcagtgagcggagatcgcaccactactagcttggcaacagagtgagactccgtctcaacaaataaaagaagacctgtctgatagggaaggtctataagtgagagacagatctttaatttttatgtatttatttattggagacggggtctctgtgctgggttggagcagggtgcgatcacacctcactgcagcctcaaactccccaattcaagtgatcctcccacctcagctggtgtgtgccgacacacttggctattatcatcataattatatttatttatgtagaggcgaggtcttgctctgtcgcccaggcgggatctcgaacatcactggactcaagacagtccctagacatcaggcctacccaaagtgaggaattataggcatgagccaccgaacctagaccaaggttacacaacacacaaacacagaacctgtggacaacgaaaacacaacacgggagacaaaacacgagccaatagaaaccacatgtgcacacatcaccccctagctaaggccacactgaggctcaagcaacgaaggacgggcacgagagctccaacgccagcacagccccacaaaaaggggaaaggaaaaccacggagacgaagacaacacgcaaccaacgcatcgggacaactcacacacctgaggaaccacgaaggacaccgtacataaccttgaggcaacaggcagcacaagcggcaacggactagctcacaaaaccagccacgccaacacgatcagcaaggaatcacgacagcacccacaggccaatcgcacgcgcagcacactcaccgcctgctcaagaacaggcacacacacaccaagacaggcaccactcacgcc

SEQ ID NO: 519587 - DNA, 353 bp, Homo sapiens
  misc_feature (20)..(20): n is a, c, g, or t
  misc_feature (185)..(185): n is a, c, g, or t
  misc_feature (227)..(227): n is a, c, g, or t
  misc_feature (260)..(260): n is a, c, g, or t
  misc_feature (343)..(343): n is a, c, g, or t
ccttttgggggaagtttttnaattaagaaaaacacacgcaactcctgggggtggctccacctgtccccaggacagggcctgcaactccaggggctcccaggctggattttccaccagaccagtttggggggcaggagcttgtaagaaatgcagaaccccagggacctgcagcggtttgggcagtncctccaacaaagcggcttaaggggaggaagtccggccctaanctgggagccccgtgctgaggctgattgcacgcnagggctctgggggttgggtggacagggttcctccgagaaaggggctcccagcagcaagaccacactgtgggtttaaagctgcnggggggaagc

SEQ ID NO: 519588 - DNA, 305 bp, Homo sapiens
  misc_feature (38)..(38): n is a, c, g, or t
gacccacctttccctcacttgtccaacaatggaccacnacccaacacctggaacctcagatgacgagtcaccaatacgtccttgctctccaatatgtgaagagggggaaaagcctggaggaggggcaaagatgaaagagaaaaaagcaagacgggagagtcacaatcttctgaggctttgattacatctcactgagcccccctcgttgcatgaaaaggaggggtggagggagcaattacgcattcaccttgtgctcactaaatctacactttataagcaaataaacagagtagaggaagaagtca

SEQ ID NO: 519589 - DNA, 100 bp, Homo sapiens
agcaacgtgttagggtgtgtatgtgtgaggtatgtggagtgtgtgtgtgtgtagagagtgtgtggagggtgtactgtactggggtgtgggacgggtgtat

SEQ ID NO: 519590 - DNA, 409 bp, Homo sapiens
  misc_feature (230)..(230): n is a, c, g, or t
  misc_feature (366)..(366): n is a, c, g, or t
  misc_feature (387)..(387): n is a, c, g, or t
gctgtggcttttaggctggaaatacaggatgaggaagaagcagccctccataagagtgatgagggagttagtgttgtagataaaagggttgaccagccaagatctggagccggaaagcctggctgttggggctgaaatttgcctatgtgcagggtggtagtaaagaaagaagtaaggcaggcaggtgatgtattagactcgccaccctagcgtttgggccttgaacccanggtgcttcgagtactctaggcaagcagtctaccgctgagctccatggctagcccctctgtccctttaaatagatgtgatggctccaggttaggtcaagtcaggtcaccctggagccaaatcttggaactaattacnttctgtccgacgatgcaattntcgctcaacagttaattgcttt

SEQ ID NO: 519591 - DNA, 732 bp, Homo sapiens
aatttaggcatggcggtgcccaggattgctccgtcgatgacgtttcgtgtgtgcggctggtggggtacggtgccgaggctgggggccggtgtcggattgaggccgctatggagccgtagattctggaggcgcgaatcaatagagaccactaacccccgtaacaaggagctcgactgggccagcatcaacggagttctgcgagcagctcaacgaggactttgtagtgggcctccaactcgcacacctcgtgagtgcgtggctccacaagatcgcagtccccacaggagtgggaggcgatccagtgccttgactggtgctggaaacatgcatgaagagctgcggcaagcggttccacggacgaagtgtggcaagttccgatattctcaacgagctcatcaaggtcgtgtctcccaagtatctgggctctcggacatcggagaagtgtgacagaacaagatcttggagctcctctacagctggacagtgggacctgcccgatgaggttgaaaatctgcagaggccgtaccaggatgctaagagaaggcaggggattgtcaaggtccgagcccaagcttccagatgacgactaacctttccccttccgtcctccacggacgaagaatgtgatctttgaagatgagggagaaatccaagatgctggcccggctgctgaaggaggctcccaatgccgaagaacctccgggcagccgaataggctcaatcaaagagatg

SEQ ID NO: 519592 - DNA, 168 bp, Homo sapiens
agcacagtgctcgtgagctaggaggtgaaggcgtcgtgtgagttgaggctgggtgggtctggaaggcggtagattctccctgaagtccagggcttggggagctggcagggagacagtgttgtgcgtggtgagccaggtgctgctgctggacgctgtgtagactgcttc

SEQ ID NO: 519593 - DNA, 378 bp, Homo sapiens
agtttagagaaggcaccaaagccttcactttggtttggcaccagtttctaaccacctgtttcttctaccccacctacctcttattggtaaaacataaatgcacaattatgtttgtagagcctctaccaaggagtctccctccctctttgtctgttgattagccaatctctgactctccattttccaaaagtaagagactccagcacggccttctgtctgccccgcagtaaagtaactcccatataaactgcgtatttgaaagcgagacttcatgacaaccgcccgtcttccatttcacctgcatcttatctccgtgactccaactcgcgggtctgttctgtttttccatgagactcaaaatactggcggttttctcca

SEQ ID NO: 519594 - DNA, 207 bp, Homo sapiens
cacagcccagtcaccgtcgagtcgtgggcccaggttgggggtccagaagctgcagaatccgatgagactgacgtgcaagtaaagtctaagcccggatgaccagccctgctgccgtcactggatgtgcctcccccgccacctgtgtgttcttttgatacattcatcttctgtttttctcaattaaagttcaaagcaaccacctgagga

SEQ ID NO: 519595 - DNA, 209 bp, Homo sapiens
cacgaggtggaagtggaagaactcagacgatgggaggcaacgtatcatgaaatgtccaagcatgttctaagggactgtaagcaatagcagctcgagatgtgtttttaatgcaatagaagccaagctacaagaagctacagcttcacgtatagacaaccttctttgaaatttacagaggaaaagtgtttgacttgcttgacaggaaggca

SEQ ID NO: 519596 - DNA, 213 bp, Homo sapiens
agacgttcccatccaggaagttcccagatgtaccgaaccccgcagccgcgaccaggagccccacgtcgaggtgcgtcgtctcccgcacgaccgtcgcgggaccggacggctccgacagatccaccgccagcgtgcgcgtggcgatgccatgccgcgagccgagctccgccccgagcgcgtcgagcacgtccttgcggcgcgcgacgagcgcga

SEQ ID NO: 519597 - DNA, 432 bp, Homo sapiens
  misc_feature (195)..(195): n is a, c, g, or t
  misc_feature (204)..(205): n is a, c, g, or t
  misc_feature (212)..(212): n is a, c, g, or t
  misc_feature (220)..(221): n is a, c, g, or t
gcacaggattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaagaagcagttgaangcggggggnnccttttnccccaaannacctcataacctatatgtgtgtatgtctacatctgtgtatatatcataggatttgagaatcttaacacatgtataaataagtatatataaactccaattttaaatcttaaaattgctgaatttaccctcatattctttaaaaaacttaaagcattatgaatgtagagaaattcaccagagctcactgcctatttgatggctgtaacaagtc

SEQ ID NO: 519598 - DNA, 108 bp, Homo sapiens
cagaactatgagttcaccaactatctacattgtatctcaagaactgtaaaagtatctggtacctggaatatgctcaataaatgaatgaataagggttaaaaaccctga

SEQ ID NO: 519599 - DNA, 283 bp, Homo sapiens
cgctcggtaccgaatcacggcaggcacaacagcatcaataaaaaagtccccacaaaaacctcatccaggccgggcgcggtggctcacgcctgtaatcccagcactttgggaggccgaggcgggcggatcatgaggtcaggagattgagaccatcctggctaacacagtgaaaccccgtctctactaaaaaatacaaaaaattagccaggcgtggtggcgggcgcctgtagtcccagctacgtgggaggctgaggcaggagaatcgcttggacccgggaggcga

SEQ ID NO: 519600 - DNA, 275 bp, Homo sapiens
actctagagtatccccacacgaacgccttcggtaccgggcgtgcgggcaacagcttgccgatggcgttgcggcgttcggtcggcggcgatgtgacgttgcgggtggtgccggggctgtattacgaacgcttgagcttggaggccaaaagcagcttttttgccgagccgtggacggtcggctccgaggccgatcgcattggctatcgcttcaagggcggcagcgcgttgagctttcagccgcgggaacagccgtttggcgccggctccgatccttc

SEQ ID NO: 519601 - DNA, 98 bp, Homo sapiens
cttcccagcctttatgcaaaaaaaggggagaatcaaagctttcatttcacaaatgttgcgtggaaaagtatccgtaattaaagtttcgaagtaattta

SEQ ID NO: 519602 - DNA, 1199 bp, Homo sapiens
  misc_feature (216)..(216): n is a, c, g, or t
ggaacaggaagaggacgaaaaaaataaccgtccgcgacgccgagactaaaccggacccgcaatgcacgcatgaatcaggcaaaggtcagtatccagtcatagccaagctaccctgtgcaggcctcctgggacatcgcagtataccctacagagccttggcatcttcctcaggcttccaccctatatccgatgactccactctgtcctagctcagangctctatcgtccgagcttgtgtgctccgcaggggctgcgcacagtcgcccaccattgtctagccgcatttcctggagcctctctgtactcttcccattggcccaggtctgtgggctgtggggcctttaggttccagaattccccatggcttattatccagtcggtcccatcgtatccacctggtctccacatgtgctggtggaaggagggtatgatgcacggtgcggcagatttggagctggggctacctgtgtggccaacatgcctatccgtccaccgtcctgtgatgcccgtccgcaagtgcgtgcgtcagcttgcagtcatgcagggagccaacgtccgtcgtaagtcagcggaaggggaacttcattcatgggtggtccagatggtggctacaccatctggtgaggaacccaaggccaccctttgtgccgggaaatgacatcacataacttcagaacttctcagcaacgtaacgtgcttgagtcaatattcactctgaggtagcagtatagagcacattgtcgtcggagagtggaccttgctggtgcccaaacgtacaagggcacttttcaaatttcaacttaaggacgcctgtacagaggaggcagataacttccttaaagcatttagaaggcacgcgcacggcacccattcctaacaatgcacggtgggctaaacgcgcctcaggaatacctcaaatatacccgcgataaaaacgggaccatcatggtatcaacatactagtagaaacagaaataacatacgtctcgaacgaacattgtcaatcactgtcactctaccgggcaccactcgttggagcaatcccatcaccgatctacattccacgacacaataaaacaaagagccatcaccaatttacacacacaacaaaattcacatacacacactaaatcaagagacacacttcacttcatattgctaatacttcatgctagaacttcttgcatcttcagttcact

SEQ ID NO: 519603 - DNA, 174 bp, Homo sapiens
  misc_feature (142)..(142): n is a, c, g, or t
gagtaagaacacacaaatgtcatcaactgatgaatcaataaacaaatgtggtctatctatacaatgaagtattattcagcaatacaaaagaatgaagtactgatacatcctcaacttggacggccctagtaaaacattcagntgcaagaagccagtcacaagaagagatatcag

SEQ ID NO: 519604 - DNA, 1226 bp, Homo sapiens
ctgtgttttttttgctcgatttgacaggcagtgcagacgcgaggagcggcgttgtgtgacgttaggttgtgtcggctgcttgttggctgccgtggtcgtagtgctgatacggtttgtgtgttcgtttgctgtcctagtgcttattttcgtgctcatcacgtggtttcctggtcgcctcttgtcccttgtgtggcctgcttttggtgtgcagtatgcccccgcttttttttcctgcgacgcagccctttggtgtttaaggttgttgtctgtgtatcacttggccgttattttccggctgtcgccgttttccccctacctgtgcttgttgtgggggctctgtctccgtgttgcgcgacttgttggttctggtgttccgcgcgcttcgggtcgggaccctattggttctagattggccagcttagcgcatttccctggataatgtggactagccagtctttcaggaccttcagatagccttagaaggtttgccactgtctaggtctcgccaccattttggggaccaccctggactggtcacaagccagggttcaccagttatgtgggagtgttaaggttaagcttttgacttgacgcctgcgtgtgcaccagatgaatatccttccgtaccccagtccccagtctgtcctatggggacccaatttggggccggccggctatcccggagcctgggaaagaggccctcgcccaggtgtatggccagggcccagggtggcctggggccaccccagcggatatgtgctttagttatttggtccacccagccgtccatcctgggcttttccttactgtgtcttgttaccaggcctccacccaatcccccagaactctctctccttccttccccctgtccaactttctctgctttctgagaattaagaaacccatattgtgtaaccaccccaccactttaacttccagaaaagcacatagccctattatagtgggtgtgaatccagaccccgatgctgttccagatgacctacttacattttccatgtggataagtattaagaacccataccaccatgccatctataactgctgggccatcccagttgactttttaatgttcagaatgggattcccccaccacttgacaccttccagctatatcgcccgaaagcttaatctatggatatggtattttgtgaatgatctctttcaatctaaaggacaccctttcttttacaatcaataaaaataaa

SEQ ID NO: 519605 - DNA, 347 bp, Homo sapiens
acgagctctgtaccctgtgggtatgcatcaatacaggaagggcccagcgttggggacgagccccaacgttgagaacaagtaagtgaacaattagttgtactgaaccacgtagttacgaaacagctgatcatgaacaacctgtgtgtaatattatttccctaaacacgtagcacccttcagcaggaccctataaaactttcctccagcccttgcctctttgcaggtagccccttctctgctgagctgcccaatgcaacatattttcacaatttctctaataaatctgcccttctttacctacaactatcttggtcaatggctttaccacctgcaaaactgaccctagg

SEQ ID NO: 519606 - DNA, 1438 bp, Homo sapiens
gctgtcttaacgagagccaaacagagcccagtgagactccggtgtgaggaaacctcattgtatctgatacggatagttacttatgctaagaccagtaaatggttgattccagtgaggaagttatggcgaaacgaacgaatcagataaacaagagaaatgtgcgtgttcaagatttgcatgctgtattaggattatcttgtggattgatgttatttctacttttttgattgtttttgccattagagaagttaccaagatttacacgactggtcaatgcacacgtcttgatgaccagaaaagtattgtgtccgcgattcatctaacctcgccttcgacataactgtctctactaggacatgggattcattgtcccgccgttattgttggaggtgaaccactttaaacttgctttgtccctagcacttcctttgtaacacgacatacggaagatcgacacacgatacggaacatggtgcttcttatttgacgcaccctcgacgtttacgcgccacttgttgacatagcctgcaattccttccatttaccccgctattatcttgcggcttttcgacacgcccttgccgtgtcatcacttctttcggtcaaatgctttgtccctattttccgtccgaaagtcttatgattcgggcgctattctggggtatcttccaagttcccaaggcgttaggccttggcgacacgcatctacaactttcgtctggcaaatcttacgtggcactctcacgtttgtgttaacccacgacatgacaccggtttatcctcctatacaaccagctttctttgtaaagctaagtttgacattctctcgtgtgaacacaaagcctttcttttcggcccgttctacttggcggcggcttaatataaggcttcggcgccaacctcccccggtttatgggaccaaccaaaaccccacctcaaaaagttccatttgcggcccgttcgttcggaccactaaagtgcactccattccatttcggccaaactgtgattccacatacgggttttcgccggaggcatatgtaggaggcgaaatacggtttctttacgcggtgctacgaaagattccccttctgtgttatacacacgagcattttattcgccctttttatcaccctttaagtgtgcccgctaatgagatgtcgcccctccgaaagtcatttctacgccgtgaggcagatatcaagcacacgcggattcttcaggacgcatttaaatcatgctgcacacggctgcgttcccttctcgactagcaaaagaggcgcgttagggtttacaccaagttttcccctttgggtccaatagcccatttgctaacactttatcgaggcgccgtttgaacacagagaactctgtagttaatcatgttcctattcgcccaattactaacctcaactctggcttagcggggtccacttca

SEQ ID NO: 519607 - DNA, 411 bp, Homo sapiens
taatgtcagaacataataattctacagagctcaaatcacaagctcgacatattccaaatgttcatcaataacagaatgaatatcagtcccatcaataagggggaaaatcaaagaaaaaaaaacggagagggtggcagatgtcagagctgactgaaggttgacaactattctcctttaaaaagagcaccactgcttcctcaatgtcactgacggatatgaacaggcaagaggaaagtacctgtccttatttgccttatatacagaatagggtaattgaatgccagtgggtctgtttaggaatggctcgctaacacattgaaaaaatgaaagacttcatccttgtcgtagatagccacttcagtgaacatttcagtgccagtgactgggtgatagatttctaccacatctgtc

SEQ ID NO: 519608 - DNA, 383 bp, Homo sapiens
gaacgaggtagggacccagaaaaatataatgaaacctcaaagcccaggtattcggggaccatctaacttagagcaaacagccctccccctcagggatctggtggtccaatgaagtgtgaaaagatgataattactattatcataatcattagaatatgcgggccaggcatggtggctcatgtctataatcctacgcaccgggggaggccgaagcaggaggactcactggagcttaagagttcaagaccggccggggcaacatagggaggacttatctctacaaaaaataacaaaaatcagccaggcgtggggggtgtgtgcccatagtcctagctactggggaggctgaagtcagccagggtggcacaagtgcactccagccg

SEQ ID NO: 519609 - DNA, 188 bp, Homo sapiens
attacacagctccagttacaacagcgccagttacagcagctccagttacaacagctccagttacaatcagctctcgaacggaaagccacatctcgccacgtaggacaggaatcgggcaaattacaatggaagaaaccattgagaagatgcaggaataatgtattcttatatactagctttgttactgg

SEQ ID NO: 519610 - DNA, 156 bp, Homo sapiens
tccccagcattgtgcatgcaaaatgccatggctgcatgttcctgtatctcccaaggcagcactctccatttgctcactttgcagctaagtatgtgctcccttaggttcttgcagtccatgctgctggcctgactactatggagacaaagggaaaca

SEQ ID NO: 519611 - DNA, 691 bp, Homo sapiens
  misc_feature (552)..(552): n is a, c, g, or t
  misc_feature (559)..(559): n is a, c, g, or t
  misc_feature (576)..(577): n is a, c, g, or t
  misc_feature (677)..(677): n is a, c, g, or t
ggttaacacaagctgcctatagacggcaaactaaaagagcaccctgtaacacctgcccactgggacgtcagttgtaaacatgcacccctagacactgccatggcatcgaagccccacagccttgcctgtctgtatgctcccctagagatttgagcagcagggtgctgaagaagcgagcgacaccccatcacatgccctgtgagggggacaagggaaccttttctgtttcactaggatgacgagtgtctcctgaaccaaacaccaataacacaatgaataagactatagttaaacatatctagactctggacccagaaatcaagacaagaaagataattttgtgcatattgtacaacatctctgaggctcagtttcccaaacatggattctacaagtggagtattgagttcaaattccagttcttcttaccaattgtgtgactttgtagattaccttgtgtgtcctcatttataaattcaaggcacaatagcacctatctgacttagtacttgtgtaaagtaaatagtccatgtatggtaaactaatacatangaccccnagtagaaagagtctcannaagtgcgtaagacatgttcactggtttgtggctataatgggtgtaataatttctcatctgcgaagaatcaacaattctacttcccttgactgtgacatgngtgatttatcgccc

SEQ ID NO: 519612 - DNA, 104 bp, Homo sapiens
  misc_feature (41)..(41): n is a, c, g, or t
cgccgcggagggtcaggtcgtttctgcgcgggctcccggcnatgctactgctgctgctcttcctcgggccctggccatggcagagccacggcggcgaagtactc

SEQ ID NO: 519613 - DNA, 184 bp, Homo sapiens
tcgggtgctctagaggatccaattctgcaccacagcctgagggcggagcgggtatggtggctcatacctatatcccagcactttgtttgagaggcagaggcaggcagatcacctgaggtcaggagtttcagaccagcctggccaacaaggtgaaaccctgtctctactaaaaatacaaaaatta

SEQ ID NO: 519614 - DNA, 199 bp, Homo sapiens
tctgccactctaggcctgaggatggggagctttggtgcttcaagtagttcttctgggacttgtccccacagggaatgcaagtgtctgtcatggaaacattacccttccttgttcctgctactgtcacctgggcatttagcgtttgtttggctttcagggcgaagcattacatagttcaaaagtgtactttatctccaga

SEQ ID NO: 519615 - DNA, 195 bp, Homo sapiens
gctgcggtcgactctagacggactcccctctaccctcgcggtgtgccttgttggtacgacgtgggctacgggcactttttaactcttacgacgcgacaagcctataatcacctggcccgctcactacacggggactggccactggctacggtttatagactagttgggttggttgtgtgtaaactgacgtgtggg

SEQ ID NO: 519616 - DNA, 475 bp, Homo sapiens
  misc_feature (475)..(475): n is a, c, g, or t
agaacacaaattactttctcggtcgataaaatcgcctgccaaccctaccactggtaagaccggtccatatgaagcacatttctacactcaactaatgccgtgtataaagccatacccactttctagattgatgaggccatgatcgtgtgaatgcctattatagtccctccaccagattatgtatcatatgaagctgaatgcagggaaaggaaactgatacctgaaataagagcagggacgtggtatagatttgcatgccataataactgacctatgaagccccacctttctcttaagattgaacatgtgtggcctttgcagcccttatatgtacttgtgtcgaagtgccaggattaaaggaaactccgctaccatgcactcctcctactaaaaccactgcagcttggctcccactcattgaaccctactatgcatagcattcttggaagagctgactgacatgagcagccccatn

SEQ ID NO: 519617 - DNA, 290 bp, Homo sapiens
ctgctccgcccctctctgggtccagctgctcttccttacctgcctcgccttttacccttccctgtcgcgtttcctctcctcagagactctgccattgatgaagctgctgtccactcacccctagatttttgctgcatagccaggaagatctgtggcctggaatgttttggggaaaactgaaaggactgtgttatgggagcgggagcataactggcacctggctaaagctaccccttttcattatgcttttcttgctccagcctgagcagagaaacgtggctacaagacag

SEQ ID NO: 519618 - DNA, 375 bp, Homo sapiens
aaacccggggggatccctttctttccccgcatggccatttttgaaaaaaccaggaattttttgggacccattggcccctttgattttgctctaggggcttccccgggcccggggagggaacttcccccaaactttttgttttttttataaggccggggggaaataaaaagggagaagaagattccctcggcccggggtccccagtattgggaagggaccctttttgggaaacctgggaaaaaaaccatcctcttgggagaatttttaaggggggaaggttggccaatttgaaaaaaaaaaaattaccccggggggcggggccctcccttaaaactaattaaagggccctttctaaaaaaaaaattttttaaccca

SEQ ID NO: 519619 - DNA, 277 bp, Homo sapiens
gaaggtcaagtcacgagtccggatgccgtccaaggccaagaagagcgttgctgaatacgtcgcgatccgagcatgcaaggagttcaacctgggcggctgggggcgggacacaggagggacagcgtgcgagcgtggccagggcgtgcttcgacctggcacagaagcgcatcttcgggctcagtggaagaggactggtaccgtcgcttgctcggttctgacctctacctggaccgtattaaccagaagaagatgagtcgcccgctttaggggcgactgg

SEQ ID NO: 519620 - DNA, 792 bp, Homo sapiens
ggttcctgcgacgcccgtgccgcaccggacccagtgctggaggcctggcctggtggcacactgggccactgctggtacctgctggtgctggacaactgggtctgttccaatgtcctgcttgctggctgggctgtgtccctgggcatgtgacccaggtcccgagccggcctgcagttccgcgctggtgtgctgccctgcgttgtctgtggctgtgggcactggtgtgcgcgtctgggccctgcaggtggggaacagctctgggcagcctggagccaactgcgctggatgctgcagctcgcccttcgaccgaatgtgccggtcaactggagcttcaggagtttgctgctggactacagattccaggcacctgggtgtctcctcacaagggctgtgttgatcatcccatagttttgacagaagctgtgtgcaaacccacgtgtattccacggcaaatgattgtctgagcttctttattgaggtgctacgggattcccaaggtttgcctatggaatagcacagctcttcaggcttctagcagaataagccaaaggaactcgatgtgcaagtgagctaatccatttctcatctggataccaggtgtaacgcagtgttttaccccagtcttaagaaggggagattagattgctaaagaaacttgcaatggtgcgatcagagtcttggcaggaatgcacagccagaactggtaacctacagaggtctcctaccaagctgaagtaccctggggcacacatgtgaggcatcaccctacaggcgcagttgaggagaatctga

SEQ ID NO: 519621 - DNA, 443 bp, Homo sapiens
cttcttcctagctccttcaccacagtcgcactggctcctggtactctatttcctatcttcaccacgaacggctgcttgtttcggtatgctccgtttgtcctagcttcatcaaacactggttcctggtatcctgtctgctgctgtcttcctcagattcactgaatccacttctgtgtagcaccttggatcagctgtcaattaatgctagtcctcaggatttaaaaaataatcttaagctcaaagtccaatgcaaaaacattaagttggtaattactcttgatcttgaattacttccgttacgaaagtccttcacatttttcaaactaagctactatatttaaggccttccaaattcttctaagctcttccaaaagccttctgcctgagttagttttagattacaccagtccttttagtagctttttgatgtgcggtaaaagctt

SEQ ID NO: 519622 - DNA, 1651 bp, Homo sapiens
  misc_feature (1244)..(1244): n is a, c, g, or t
ctgatctggtgcttggttcggtgatgtcttgctcgcttcaacgagtgttcctggtcagtcttctctgctgagtggtgatcgcgcgttgtagttgctgttctgcttcagagggggccccttcgtttttgagtgcagtgggggtgtgcccctggtgagcgctctttctttctacttgttctcgggggagttgcccctttgtgagatttgagccggtggccaccctgtttggacgaagggggtttccccacagtgggccccccttgggggtgcacaaggatcggtgtggttgtgccgtcctccccgggggccaccccgccgttgttgttttcgtgggaagccctgctggtcgcttttgacgcaggagttacactttgggggccctcttggaagttctgtgggccaccaggaggaacccctttgcggtttttaagagcgttttccgtaccaccacgctcacataggggtagaagagaagggggtttgtgaccaaatgaggagaccctggttccgtcccgaggcgccccgccttcgtagaaacaaaagaggccttgggggggataaccacagaagaggggggacaatattttggcgtgtaagaaagccccaccaggggggtcttcctctttcttaggggcgccactctctctcacaccaaggggggggtgttttttgtccacgcgagctttaagttgcgaaccttacctggggttgctttttctgacccctctggttaaggccctataatgtgcacagtgccccacatagtgttcgtgtgccccccttgggcacttgttgggggcaacacatggggaaaggaagtggtacttcgtacttagggggttgtgtaataacgccttgggcaacccactcgggccccaccctggagagctttcggggggacaaaaagagggggagatatatatttcaacagctggagagccacactctgtgtttctggcgtctcacagaggcgtctccctcggggtgtttatgcgcgctcactcccccccctcattggagtatttccacgggagatttgggggtgtcacaaaggctcgggcactgagataccccacggggcccctcggcgacagcacacactctcggggagattgggcctctggagagagtcgggaagagagagaatacctcggagactctgtctttcttgtgtcgcctctctctccgctccgcttgcgcacacacactttataactcgggagaactctctatattcctcgctntaaggagttttcttctcgagggctctggtgtgttccctcgtctctgggtgggggaacaagagaggagacaataaggaggagaagggagagggcttctatgagaagaaggcacgcccctcttctttgttcctctctcgggggtataaatgaggcttgagacctatgaggtaaaatgtgagagaagaacccaagaagcctcctggaattttttaatattcccattaaatagttaggaagatataataataataacataataatgataatatttctttaaatattttgagttctttgataatagttgtaaaaaataccatttcccttctggccctgaagcctggagtgagacacctgaagaaaaactgtgtttcatttaaagatgttaattaaatgattgaaaccttgga

SEQ ID NO: 519623 - DNA, 327 bp, Homo sapiens
tctgtggctgcagtccatcgaactccaggtggctatggcggtgccagtggatgtcggcagtggccttaggcctgggtggaggaagcagctactcctatagcagtggtcttggcgtaggaggtggcttcagttccagcagtggcagagccattgggggtggactcagctctgttggaggcggaagttccaccatcaagtacaacaccaactcctcctccagcaggaagagctatagcactaaagtgcgtctgctagctctcggtcccacagtcctcaggcccctctctggctgcagagccctctcctcatgttgcctttcggagaaga

SEQ ID NO: 519624 - DNA, 221 bp, Homo sapiens
aaggcatgcacacatcccaaccacaggaagccaagccagactgacatacatcatatgcgacatatcgatgagccatgtaactaggaggccacagaaacatagaggggctcatccgcatcttctactcgcgatcttaacggtcacagtgtccttgaaagggccatagctgataaacttcgggtcgatgtgcacgtaggcatgcctctaacttcaagctatcg

SEQ ID NO: 519625 - DNA, 394 bp, Homo sapiens
cccccttttgggcccccaaaaaaagggggtaatttgggtggcccgggaaaacccccccggggggccctttaaggttaaaaaaaaggggttaaaagggggaaaggggggtttaggtcccccccccccccgccccccccccccccaaaggggggggcaaaggggggaaggtttaaaagggtgggggggggggaggtttccccccaaattgggggaaaaattttcccgggggggcccccaaaattttaacccaaaaggttctttgggggggggaatttttgggggtttttggttttttttttggggttaattttttaaattttggcttttttgaattttttgcccggccttaaattttttgggtttggttaattaaaaaaattttttaaaattccca

SEQ ID NO: 519626 - DNA, 992 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaa

SEQ ID NO: 519627 - DNA, 389 bp, Homo sapiens
  misc_feature (12)..(12): n is a, c, g, or t
  misc_feature (384)..(384): n is a, c, g, or t
attaaaacagancattttggccttataatgaagtaaacatgaacacaagttttgcctaggtgtaaccctcagttagagatcctgtctgtaggaataagagttaggtacaggctggatgctgtggctcatgcctgtaatcccggtactttgggaggctgaggcaggagaatcgcttgaacccaggagtcggtgactaatgtgggcaacattgttataccctatctctataaaaataattaaaaaattaagcaggcattagggtgcatgcccatagttccagctcctcaggagactgaggctggaggatcccttgagctggggagttccaggctgcagtgagtcatcatcacgccacggcactccagcctgggctacagagtgagnccttg

SEQ ID NO: 519628 - DNA, 815 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgcctccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaa

SEQ ID NO: 519629 - DNA, 775 bp, Homo sapiens
  misc_feature (16)..(16): n is a, c, g, or t
  misc_feature (62)..(63): n is a, c, g, or t
  misc_feature (67)..(67): n is a, c, g, or t
  misc_feature (107)..(107): n is a, c, g, or t
  misc_feature (119)..(119): n is a, c, g, or t
  misc_feature (134)..(134): n is a, c, g, or t
  misc_feature (140)..(140): n is a, c, g, or t
  misc_feature (172)..(172): n is a, c, g, or t
  misc_feature (181)..(181): n is a, c, g, or t
  misc_feature (193)..(193): n is a, c, g, or t
  misc_feature (201)..(201): n is a, c, g, or t
aaaaaaaatggtgganggttttttaaccaaataatttcttgcccaaaggggaaaagcctccnntttntttcccaaaaaaaaaggttgggttagaaggaaccatgtgnaaataaccctgnaagtttccgtataanaagggncccgttggcctccagagccaggcaccaatccnccacctttnataacccacccngccgcatntacctgtgttccaggaataaagtgttgcagagtgcctgcaattacacaccaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaa

SEQ ID NO: 519630 - DNA, 580 bp, Homo sapiens
caacttcgacggacgcattcagtaaacacagtatgtgcaaggacagagaagaactgagtaatacaacaaatacatctgatttagcagacatagagaaatttgaatcaataccttaaaaaatgtttgaagtcatgtatctaccataaaaaaaagcctaaacaaaatttgaaaaacatttttacagtcaatgttctcaaataattatctgcttaaattgggtggaaaaagatgaaaagtaactcccagtaatttgttacattactggatatccccaggatcaaggagggtaacaaaagcaaagccataagcaatctctagaaagcaatggaaggaagataaaagcaaaacttaggagataaaacaggaaatcaataaagagaaaaaatgaattatgagggggggaaaaagaagggtaaacaaatccaaaagctggttttctttttgttttttgagatgtgaatgcgtccgtccgtcgaaggacgcattcatacagggagcttggtgtagtggcaggtgcctatagtcccagctactcaggagactgtggcgggagaatgacttggaccagggagttggaggt

SEQ ID NO: 519631 - DNA, 1624 bp, Homo sapiens
  misc_feature (266)..(266): n is a, c, g, or t
ccccgtcacaagccctggccccagatccctcagagtctacgggttcagagtctaagccccacgtccctactaccgcccaatgcgccgtgcaccccagcgacttcagagcccgttagaacatggccgagtggctgtccagaccccgagtcacgcaagcgggcagccagggagcgagtcgtgaggagacaagtgagcctgtgaggagagcactgtggaggcgccgtaagtggctgacgcgggactgacgtactcgtggtacagttctntccatgacgtcgtgcatgtggccatggacgcattgagggtgactcgcgctcgatcgaaatgatctgcgtcagtgccgtagacgaacggatctgacatcgcaggccgggcgcactcccagtctcagcaatcaacttgatgggagcattgccttgtggacgcaggcttcagcgttccctcagaatgacaagacggaagatgaacgacgaagtgcatgttccgtgggggacaaggctctgccaaagacagccgcggcagggcttgaggaggctcgaggagaacaagacattaggacctcacgcacacggtggcccggaccactcctcaggcagcgggggtggtccaggcatcttgggattgccttgccctatggtccctgggccatcctggtaccaagttggcagtcctgccctcccatggcgtggaacgccgtgggaacagccagtatgggcgccaccgtggccgcctggcgcaagggcgaccggccatgggagccccctgccagggcgcgctggatatggcagagggacacgaccacagaggtagccgggacggacaagtgagtgacgagggttacacgccaagagccaggtggacggaagaatacccgcggggaccaacgggatatcttcgtcgccaacgggaaaccgtggggtggcaaaggaccatccagcagcgatcctatcggggccaataggcctaacacatatagacacgcctatcgtagggagggaaacgcaagttgggcagacaagcggaacgacgacttggcaaggacatgaggcatatccatacattgacaccagagggtggggaaagctcagaggatagcgattgaaaataaccatgataaatggcaaagacacacggaattggtgatggcccggggagccaatcgactaccccgggacgagccaaggtcccaaggacgttaaggagataagaaagacacgaggatgatcggatagagagcacagtcccacgagcaaggaagacacgcagagcgcgacacaaacagtgtgacacacgaacagtgtgtcacaaaatcaaggggacacgtgcgagacacaagagagtacagaacggctgccagcatcgaccagagagttagtggtagacagccactgggcacaggcccacacaggatagcgaccaaggagcaaaaccaccgacacaggcgcaggtaacagagagcgacacacgaagagcaaagaacacaagcgaagatacgacaccaggctaatcgacacacaaggcaaatgagacagagagagtccaagcagaacgaaagtaatagaacagaacgttcagcaaagcgagcgagaaaacaggagaacacaaaagacaagctgagcacccg

SEQ ID NO: 519632 - DNA, 1225 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaaaaaaaaaaaaaaaagaagacaaaaaaaaaaaaacaaaagaagaaaaacaaaaacaccgggcgcatccaaatgatgtgggggggggcgaaaaaaagggttatacgaaagcgcacacgtggccaacacggtgttcctcccaccccattttgtggcaccaggggggagaatgcgggggcgccccaaagagggagcgcgtataatgtggaaaacccggggtacccgataggat

SEQ ID NO: 519633 - DNA, 113 bp, Homo sapiens
caaagttgcggggactacaggcatgagcctctgtgcctggcctattgcatactttttatggctacatagtattccatggtatatatgtagcacattttctttatccagtccac

SEQ ID NO: 519634 - DNA, 190 bp, Homo sapiens
gtcccccttaaagggtgtgcggtggggggtgtggctcgcttctttggtgtcctgctgctcaaacctctaaagggagtgtgcagtggtgaagccccagtgggcgtgtgttacccggtgctcttttagtttacccatcagctcattgagaactcttgcaactcctgttggagttgcaactccaacagcctct

SEQ ID NO: 519635 - DNA, 2015 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaatttccccatcgtacgtctatgtgcgtgcgggcacgtcgaaactgcacacgtgcacacacgctgctctgggccctgtttggtgtggtgtggtttaattgaggcttacattatgctgaagagtttttctaaaggcctactgtatttattttagtaatgtgctacattagagtagaaaaaataagaacgtgaagaagaaatagcaaaaggagaaaattaccacagatttacagaacaatatgttttaagagagacgttgagaaagattcacgtggccgtcctcagcgtctcaaactcctttgaagggagatttgagcttaggctgttgatgacataagatgcaaaagcaaaataatatactctctttattacccagaaaatcaagttgccagtcaaaactgagaaatgagaaagaaaatcagatttctttattcatctctgttgaagcctagaaaaccaaaacaagctggttgtggttcagcatcatggtttaggaatcaagctgtcagttgtgagtcctactgaactgtgggttttccactgtaaagctccactgtgtccattaggaatcaggctgccagttgtgagtcctactgaactgtgggttttccactgtaaagctccactgtgtccaatatggtagctcctagccacatgtgggtattgaaatttaaatgagctaaaatgtaatagagtttaaaattgggttccttggttgcactggccatagttcaggcactccacagccgcctgtgggcagtagttccagtgctggtgcagaggacgatgctctgctccccgcggaagctctaccaggcctcgctgctgcggagcatgcgaagaagatgcacagtccttccctccttgcgatcagctgcctttttccctctccccttccttccctcattctttcctcctccttccctcccttcctttcttccattccatcatgtcttgttttcctcccattcccttcctccctgcctctttccttccctcattctcttccttccttccgtctgtcct

SEQ ID NO: 519636 - DNA, 118 bp, Homo sapiens
cctgctttatccatggctgatgggtttgtctgcctctctcgtctcgcctaatctcactctcgatggattcacggatggccagcgtgcttgcaagctggccatccgtgaatccatcgag

SEQ ID NO: 519637 - DNA, 284 bp, Homo sapiens
  misc_feature (237)..(237): n is a, c, g, or t
ataacatgacaccaatgcaacacaagcaagagagatcctgccctgaaactcactgttgttttaggctttcggcggaccctgctataaatatacagattttatgcccagtctgtgaccagggccgaacctctttcctgaagggctgggggactccttcgaggaacaagaacagcccggctgtccacaaaggagcccgttttcaggggtgggatcacaggtcaggtgctctctcagcanaacttcaggacccgggcaaaccataacactcatctcactaggaggca

SEQ ID NO: 519638 - DNA, 1109 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaacatccagaatggaagcctgcttcccccaactccattacctatactacaggatggattgctttttgtgagaccccttcttccactgtgcaatttttgcattatttaccctccccggga

SEQ ID NO: 519639 - DNA, 428 bp, Homo sapiens
gtctattccctatatacagcagcgtgtctattccctatatacagcagcgtgtctattccctatatacagcagcgtgtctattccatatatacagcagcatgtctattccctatatacagcagcgtgtctattccctatatacagcagcatgtctattccctatatacagcagcatgtctattccctatatacagcagcatgtctattccctatatacagcagcatgtctattccctatatacagcagcgtgtctattccctatatacagcagcgtgtctattccctatatacagcagcatgtctattccctatatacagcagcgtgtctattccctatatacagcagcatgtctattccctatatacagcagcgtgtctattccctatatacagcagcatgtctattccctatatacagcgtcgacgc

SEQ ID NO: 519640 - DNA, 955 bp, Homo sapiens
  misc_feature (36)..(36): n is a, c, g, or t
  misc_feature (61)..(61): n is a, c, g, or t
  misc_feature (64)..(64): n is a, c, g, or t
  misc_feature (114)..(114): n is a, c, g, or t
  misc_feature (157)..(157): n is a, c, g, or t
  misc_feature (161)..(161): n is a, c, g, or t
  misc_feature (196)..(196): n is a, c, g, or t
  misc_feature (210)..(210): n is a, c, g, or t
  misc_feature (243)..(243): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (312)..(312): n is a, c, g, or t
  misc_feature (329)..(329): n is a, c, g, or t
  misc_feature (349)..(350): n is a, c, g, or t
  misc_feature (352)..(352): n is a, c, g, or t
  misc_feature (356)..(356): n is a, c, g, or t
  misc_feature (358)..(359): n is a, c, g, or t
  misc_feature (388)..(388): n is a, c, g, or t
acagaacaaggtgttgtgttggagggctccgtcttnagtgactttgtgttcctggaggcgntgnacaaccagggagtcatccgaaagcagtgtgtggaccactacaacgaggtnaagagcgtcaccgtctgcgattacctgccccccccacctggtnattnacatcgatgtgcccgttccagaggtccagaggcgnattcagaagaaagnagatccacatgaaatgaagatcacctctgcctntctacagnacattnanaatgcctataagaaaacctttctccctaagatgagtgaaaaatgtgaggtttnacaatattctgcaaggnaagctcaatattcaaaaaanntngtanannacattgaatacctgaagttcgataaaggnccgttgctcaagcagaacaatcgcactttataccacctgcgattactggttcaggataagtttgaggtgctgaataacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagctggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaa

SEQ ID NO: 519641 - DNA, 137 bp, Homo sapiens
ttgccctcaaaaggacattagtcttaaaatggcacagaagttatgcttggtctctcctctccagcttctcttacctctcctgtatcatctcaaccttggttcagtttgctccagccacagttgcgtttcacttccga

SEQ ID NO: 519642 - DNA, 304 bp, Homo sapiens
  misc_feature (16)..(16): n is a, c, g, or t
  misc_feature (39)..(39): n is a, c, g, or t
  misc_feature (177)..(177): n is a, c, g, or t
ggtcaggccctcatgncccctcccctgcctgtgatggantgttctgagggctttgcatttctggaagcacagggagttccaaatgagagggagcttttgtgcttgagagcctctgggccttggctccagagcacgagcaggccaggacctggagagcccagaccctgtctccagganccaggaggccagatggggccttgcctgaaagactggccccttgatcgctggaggcatgtgggtggcaactagggctgggcaaggaaaaagaaaataaagacaaccatatttagcagtgcaaaaaaaa

SEQ ID NO: 519643 - DNA, 654 bp, Homo sapiens
tcgtactgaattggtggtgtcgctcactggatggaagagatggctgaactgtatcctggatgtacccgctggggcctgccatgctttggaggggcaggaggccccattacctatccctggaggtgcaggaccccaggaggggcagggcatttctttttctttctttttttttttttaagagggagactcactctgtggcccaggctggagtgtagcggcatgatctccgccgcccgaggtcaggtgattctccgtgcctcagcctcccaagtagcggggaatacaggcgtgcgccaccacgcggtgctaatttttatattttttaagtagagacggggtttcaccagtgtgggccaggtgggtctagaaccctgtgacctcaagcaatctgccgtgcctgcggcctcccaaaagtgcggggattacagatgtgagccatgggggcgggccaggttcatttcatagtgatcagtgggtctgatcactcagtgtcttctttttgctactcgttcccatctcgggggacttagcaatacactcagaccccggaatcccctcttaagggttcaccggattcagaaaggctaagctcacaatccaggtaatcaaacatctccacagggagcgggaagatgttgttgacatgggtcccag

SEQ ID NO: 519644 - DNA, 117 bp, Homo sapiens
gtcagagtcgttagccgggggcagagcttccggtaccatccaggtgtccaggaaggtgctggggccgcttgggcaggagctctgtggtccccttcagcttctgcaagcaggcgcggg

SEQ ID NO: 519645 - DNA, 247 bp, Homo sapiens
ggtcgacttaaaaaggtaattaaggttaaagaagttcattaagatatggcctcatcccatctgactggtgtctttatagcaagaagagactaggacacagacacacacagaggagagaccatttgaggacacggggggaagatgaccctctaccagccaaggagagaggcctcagaatgaaaccaacacatctcacaccttgaccttgaacttcttttcacacagttctggaggctgaagttcgtcg

SEQ ID NO: 519646 - DNA, 495 bp, Homo sapiens
catctagttacttgtctctccctttgttcccctatactctctcctctagtactcacagttaaatagactaggtcccttttctagagagcaagatgaacgcgaattggcaggattcttcattttccataaaaatttctaaactcctccctgcacacatacactttctccctgcctcaacagcttgcacacatattcccctcttctcaaacaccaagcctctgggttctgatcctgctccctccttccttcacgatagtggtgctcctgcaatactcttaccaactccagcatcaccaagctctcccttttctaaacatctctctacaataagcactttaacatccttcagaatcttccatttaacaattaaaaacaggccaagcatggtggctcacacctgctgtcccagcacattgggcggccaatgtgggcagatcgcctgagtataggagttcacgaccagccagagctacatggtgtaacccatggctacga

SEQ ID NO: 519647 - DNA, 114 bp, Homo sapiens
agggcactcctgagacttcaacgtgcccgctgtacgtgtgccatccaggccgtgctgtccctctacgcctccgtgcaggaccacctggcatctgtagctggactcctgtgcgac

SEQ ID NO: 519648 - DNA, 185 bp, Homo sapiens
  misc_feature (113)..(113): n is a, c, g, or t
ttgtaggaagtgggctagggctttttagtattagagcgaaagcctgcgaagtacaaggaggcctgctgcgccgcgtgcctgtttccgcagaccccaacgtccccaacgtcgtngtgactggcctgcccctggtgtgcagctcggccccgggccccctggagctggaactgtcgggctagtcgggg

SEQ ID NO: 519649 - DNA, 583 bp, Homo sapiens
actggtgggggccacttgactagtgttccccccagtatggtgtctccgtgcggattacccccgaggctccccaggctgtaggcccccccgccttctgtcctaagataaagctcaatttgtggtaggaattggatttgctgcagggttggcgcaccaatcctcccaagaaggctacccctcgccagatttctagcagtttgtgagaaattgtattaaaaatggcggagaagttcataggtgaagaaatgtcgagattgactgggggatgtagtaaatagatctgcctcgcgggagtatattgtacaagctcgcccctcctctgttctggatagataacaattccatagacacacccacggggggtttgtatctatttgcggattcgattggggaccccccgcgcgggcttgtctatgtttgcgccaccacattgggcgccacataatactggtaaaattattattagtctttgttattttattcccctagtcccttcaacatcccccacggtatcttcacaagacccacagaattttctttctttaataaaattatataaatcttcccatcattgacaagaaat

SEQ ID NO: 519650 - DNA, 111 bp, Homo sapiens
tacttctttttttttaaaataaattttgtatctaacaggaaggcagttcttatgaaatttttgtattttcaaaaattgttttgttcaactaaaattttatgagtaaagtta

SEQ ID NO: 519651 - DNA, 364 bp, Homo sapiens
  misc_feature (81)..(81): n is a, c, g, or t
cgccgccgccgtgggcagtggcaccttggggctgtgcctgtcgctcaaggtcctgggcattggtccgggcgatgaggtgcngaccgccgcatacgcctggcaccagatcgcgcacgccatcaccatcgtcggcgccacgcccatcctggtcgatattgactactggtccggctgcatcgaccccgtgaaggccgccgagaaggccacccctcgtaccaaggccatcctggccagcaacatcaatgggcatccagccgactggaaggccctgcgtgaactggccgaccgctatcagctcaagctgatcgaagacagcacggaagccgtgggctcgcgctatcaaggccggctcacgggcagcttt

SEQ ID NO: 519652 - DNA, 631 bp, Homo sapiens
ccccaaggagagagtgttcagatatggcacatctatataaaacgcagcgatgctggctcattattgttataatgtgacatctcctcaatgtgataactgtattgtggttaagagattgtccttgtgtataggaaatacgctcctttggcatgaataagggggcacaaacgtctgcatctatctaaatatttgtggaaaaaaacaatgagggggtgagagtgggtaagcaagagagagggagaccgggaaaagtgaagtaaagggtatttgcaagtctcgtgtactgttctcgccatcttccctacctttagaattaattccaaagaaaaggttggacacaaggactcttgcctgtacatatgaatcacaggcttcttagtaaaaactctgactcagtaggtcgggtgtgaaccctcagagcctgtatctgaatgagcccttaagtggatctgctgctcgaaagagtgtcagtgtgaaaaagcctgtcttcccagcctgttccacagaatccaacacaggcctcggcaagcctgtggatttcattacaaggacctgtgggacacacacttgatgttggtttcttaaatggggaaaaaaatggtaattgccacagtcacaaaaaacacaagag

SEQ ID NO: 519653 - DNA, 343 bp, Homo sapiens
caggctggccaagatagtggaaccccgtctctaccaaaactacaaaaaatttagctgggcgtggtggcaggtgcctgtaatcctagctacatgggaggctgaagcaggagaatcacttcaacctgggaggtggacgttgcagtgagccgagattgcaccattgtactccagcctgggcgacagagcgagactccgtctcaaaaaaaaaaaagacccgtctctctacaaaaaatgaaaaaactagcagggcataggggtacaacctgtagtctcaactacttgggaggctgaggcaagaggattactggctgcagtgagctgtgatcatgccactgcactcggg

SEQ ID NO: 519654 - DNA, 434 bp, Homo sapiens
cctcccaccctccttccctcctcctcttcccagctcccccgccctttgctgctcgcagcctcgccagtgagaatctactgtaagtgtgaattgcttcgacgaagtcacacacccacggagggaagtaatctggaggctgccttggcatttttagtgatgtgtgggcctcaccacttaaatccagtttattgaatctgaagtgatttgctcctctttctggactacacaataaacaccctccaacgtccccagccatgctcttcccatcatttggctgaaaggggaggaattcaaggccttagagtggggaagctacaatttggaagaatcctggaagcacagattaccctgtgaagcagcatccccatgagggtctctttcttctgtgatataagcaagaaataaatgaattgtgcaaatccaaaaaaaaaaaa

SEQ ID NO: 519655 - DNA, 322 bp, Homo sapiens
  misc_feature (50)..(50): n is a, c, g, or t
gagaacgccgggaagagggcacgttttccccgaattgggtctataaactngttggggcctcccattaccccatttattgaatctgaagtgatttgctcctctttctggactacacaataaacaccctccaacgtccccagccatgctcttcccatcatttggctgaaaggggaggaattcaaggccttagagtggggaagctacaatttggaagaatcctggaagcacagattaccctgtgaagcagcatccccatgagggtctctttcttctgtgatataagcaagaaataaatgaattgtgcaaatccaaaaaaaaaaaa

SEQ ID NO: 519656 - DNA, 310 bp, Homo sapiens
ggatgaagctggtgtccccaggacctcccagggcccacctgcctggacccctgcagcctgtgccctgacgccctggtgccctcgtgcatttgctgggacgtggctgtgcagcggcagagggaagggcacagagaccccgccccgatgattcccaccttacaactgagggctgagctactccccagtcagccaggtcagactggagcccagggaaagcttccggagccccagcaagtcaggttgagagtgtgtttacgctaagaagcaaattgaggaacagtctttataaaagaggggtcctaacccagag

SEQ ID NO: 519657 - DNA, 411 bp, Homo sapiens
cggggggatcactagtactaccactaggagctgcagttctcacgcgagagtggacatctacgtggtgcctagccgtatagctggtgagaccaggaatagtgtatgtataacatgtgaagaaggaccatgtgtgagggtggggagtgaagctcccacatgtggaatggaagcccttggcattggccaagggcagaggtgggagcatgagggctcatttttccatggccctagcccttagctacagggaggcctagagagaggacacttggcaagtctaggatgggaaacaaggttaagcctggctttgctattcagacctgtgcagccctgattttggggactgggcccaaggagccatgagtcttaggcttgacactaggggccttacatggccaggtctcatatgggatt

SEQ ID NO: 519658 - DNA, 146 bp, Homo sapiens
gccttaattttagaaagcagcttactagtttccccttgtggtataaagtattctaaactcttctgactttgaagaacccgtctactgtattattcctaaatactctgtttctactaagggacaattatcttaagcccatggcttta

SEQ ID NO: 519659 - DNA, 520 bp, Homo sapiens
cggccatacatgtgtgatgacagtaaatacagcttggttagtacatataggtggacaggagttacagacaaagacataaatcagtacatggaaggtacagattgtgttcagctgggtgcagtggctcacgcccgtaatcccagcactttgggaggtcgaggtgggcgaatcgcctgaggtcaggagttcgagaccagcctggccaacatggtgaaaccgtgtctccacaaaaaatacaaaaaattagccagggatggtggcaggcacccgcagtcctggagccactcaggaggttgaggcacgagaattgctgcggaggttgcagtgagccgagaccacaccactgcaccccagcctgggtgacagagcacgactctgtctcaaaaaaaaaaaaaaattctacggtattttaataatacatttggtagtcccacttatacccacttgggtccgtgggttgcccattaaatcaaccagtttacagttcccccttgaacaccatgctttaaactgtcctggt

SEQ ID NO: 519660 - DNA, 122 bp, Homo sapiens
ctgtcgatgggcaggaagcaggcgagatcccacacaactttgtaattaagggagtttccggagcttttggtttgagcgcctctcacctccatttaaagcacatctgtgcacctaattaaaac

SEQ ID NO: 519661 - DNA, 96 bp, Homo sapiens
gggggggggggggttttttatgggaaaggggttttgggggggcccccccctcccccccccggcccaaataaagttgggcccccctttcccctttta

SEQ ID NO: 519662 - DNA, 484 bp, Homo sapiens
atgcttgggtttggtaaggatggaggggctcagcgtctgttcccaatcggcccgttcccagtgccactgggtgggcagcaagttcctctgagagtctctccgtatgtgaatggggagattccgaaggcttagatcaggttgcagccagttccccgctcggtactggtgctcaacattcctgatattttggatggcccggagctgcattacgtcctggagatccccttccagaagcccccccgcgggggcggggaggtaaaggcccttacagttgttccccaaggacagcagggcctagcagttttcccctttgagtcaggctaggggcctccccttttcatcctccccccccccccgccaaggttttccccctggcctgggcttgggtgcccatataggaggtttgtatgttcccccacagtgcggaggggtcccccattgcaaaaccctgcccagaacagtaaaaagagcctgcatgccatga

SEQ ID NO: 519663 - DNA, 1801 bp, Homo sapiens
gaattcatgcattagcagagggagcacgtaagttgggactagacaaaggaaacgctacaagagtagcaaacggtaaacaagcgcacactcacggatatacaattgaatatatttaacaaagcccacacaagggctttttattttgatataatagtcgttagcggaattcgattcagcaaagacaagggcgtgtacagcgcacctaataaaaggagaataataatgaaaaacacaacggactggtttataattttaaaagaaacgtcacacactcattcaagtcattcaagactgttcaatactgggaaggacttagcacatcagacaacttgttggcacccaacttcgtatatgctgttcggcttttcgattggtttgcaactcgtgacacttgtaacacacaaaattactttattatcaattgtgacagcaatttcagttacattaggagttgcgacaattatatcaatctcacaaggtaagtcgcttaatggttggcttggcatgttttcagttttcggaattattttcgttgcttatcagctaagaattatttgcagattgctgaacaactagtctatctattcacgctagacttggctgttatcttaaacgttgactggaataagagtatggctaaaaaaattggtgggcttgatttaaaaagctgggtagtaacagtgctttgctgggctggtttatggtcgttatcagctattgtaattggtcgattcacagatgacccacgccctgtcatggacgcacttgtattctcatcagctactgtcggaggcttacttacattcttaaagaaacctgaaagttattacgcttggatagtaacaggtattacatcacttcccctttggtatattacttacaagcaaggggacgcaacttatcgaatgctattgtcttcattagtttacgtcatgaatgacgcaattggtttgactgtttcgccttggttctctaaaaaaggacgtgcaaggttagcagaacaagaagcgcaatacttagtaaataaaaaacaaagtacggagctttaaataagctcttttttttattgcataaaagtttgtatatattcattttcaatggtataattatgcaagcgggtacttgacatgggctttttgcgtttgttagtgcgtgtacaaaaaaatgaattagcgggctgtaatgtgggttatgcgtacatgaaagccgcaaaggagaataacaaaatggctgatgaagtagtaacaccagagattgatgaaaagacggaagttcctgtaacgttcacagaaaaagatttgcaaagcgctaaggatcgtgcatacgataaggcacgtaacgacttgcaagcaacgtttgaagaaaaacttgcacaagcagttaaagacgccaaagcacaagcgcttgaagaatctaaaatgactgccgaacaaaaggcacaaaaggaattagacgacaaaatcaaaacacttgaagcacgtgaggctggaattaagcaacgtgagctaaccgcagatattacaggacaattgtcagcagcggggttgccagttgatttggctaaatcgttagctactcttggtgacgaacgaaggctgaaacgaccggtgcaagtagtagcagtgcaacgaaggccgattcaaccagcgcaaataacagtagtgcagtaaaggctgaaacgaccagtgcaagtagtagcagtgcaacgaaggctgaaacgaccggtgcaagtagtagcagtgcaacgaaggccgattcaaccagtgcaaataacagtagtgcagtaagggctgaaacgacc

SEQ ID NO: 519664 - DNA, 491 bp, Homo sapiens
  misc_feature (12)..(12): n is a, c, g, or t
gggatggctacnatcaccaaatgcactgtctgttttaaagcaagacatgggagggctatcagacatcttagatgtacgtggggaaggcgccccgctacaagaaccagtattatctgagtgggcacctcctcccagcactgggtgtaagtggctccgtgccatggagttgttgggtaataacgccaggactggcttgatgacagtgactcacagtagaaaaatgtccttgcaaaagaccaaagaacccactttaatttgcacagcttagaatgggccactggttgccctgccaagggatccctgtaccagctgattttcatatccacaaacacacacacaaaagcacctatttaaatattgcaaataataccacattgcatttttattatgctttatagtttacaaagcacattacaatgctactttattattcttagtgtgctccaatataatttcacttgccttctcttttctcacctttttctcatctt

SEQ ID NO: 519665 - DNA, 550 bp, Homo sapiens
  misc_feature (29)..(29): n is a, c, g, or t
tcgaatcgacggttctcccttaaattaantgactaaatgtataacattcaatattccatgggctcttctggacaaaggatcggcataaatacaaacaaaactcaggacttcttccctaaacgacgaagatgaaccaggaggcagggacgggacgcttcatattacacttgcttacttacagtcagtgcagaaatattacagaaatacataagaaaaaatcatgtcttggcaacatactgaaattcatacaaactgtatatatgatgtcaagcaaataatgatactgcttattttttagccacaactgccaagcccttcagaggagaaagatgtctgggtcactataagagatgaggacttgggaaacttggtttgcttcaacaagtatatactgggcgcctactatatggaaggcactgtggaatcccaaattataccttttccctcaccattaaaaaaagaaaagcatctgaagaacatgagttgatattctgagaaacaactagaagtacatggcttctttagctactaagaaaccgtcgaattcgag

SEQ ID NO: 519666 - DNA, 689 bp, Homo sapiens
  misc_feature (516)..(516): n is a, c, g, or t
  misc_feature (554)..(554): n is a, c, g, or t
aatagattttatatgataaagggttaagtgaggaaagaaaacaaagatatttgatatatatgcagacacaaacacaaccatattcctaactaagaatgtaatactcataacagctgcagtcctcacttctgttattgctcatgtggtcttagctggtatttataattaccttcttccactacccattccatattaccttttccccagcaagtaccttaactgcttctggttctttacctgatgaggtaaattaaatccccaaatcttcatttctgaagggtctgcgccacgagtagctctgtctaaatcacatggttgtactcttccgttcactttaatcacagggcatggcaatttagtactaagagattccctaatggatattttgtatttcagatatactgttacttacctccattgtgcagtaacaatccaatttgcccttggtattcaggaacaatcacttaatcagtgcagtaactcccttctttgcctgttcatttagaggtgtgaggngcccaaagtggctgagggtctgggagaagtctaatatncagttcaatgtaatcactgtgtttcttagtggaagtattctgcctttggaatgaagacctgtatgccagcagagcattagggtacagggacaggaagcaaacaatcattagcagggcacttgtggtatgggttgc

SEQ ID NO: 519667 - DNA, 162 bp, Homo sapiens
tgtctgatctggtggcttggcaaaagacaatttcaatattttctccctgccgaagtgctttgccatcatttcttccatagccttgacagcaccatctccgctctacaaaagataggaacgctataacttttaactcttcactcgttccgattctctaaactg

SEQ ID NO: 519668 - DNA, 145 bp, Homo sapiens
aactaccttagttcgctgtatacagacattgtcttgctttggttaccttctataagatgaagtagctacaatgttactcactattacttgaatcaagatattctcaatagttgataaattagatccatttcagcgttgaggttat

SEQ ID NO: 519669 - DNA, 1260 bp, Homo sapiens
  misc_feature (695)..(695): n is a, c, g, or t
cccagacctcgggcgcaccccctgtcacgccgccttcatccccggcctgtctcctgagacccccgcgcatcctagtaccctttctcctccaggagacggagtctctctccggacctggccagcagatcccctattcaagatccacccacgcttcgtggataccagatcgcgtcccatctaggttatttccgtgggatactgagacacccccggtccaggcctcccctccagcactgcgcccttctccctgatggagcctcagctttccctcgagtgccctcctaccttttgccgggagagccccctaggcccctgcaggggcaggggcctcctcctaccgacaccaggcccgtgttcgctgctcttctgagcagatgccggtgggtgcgccgctcatcccgccatgacctgctcctccgggcttgcggcatgctgcatgcatgcatgctaccggctgcttgtggctacgtggtgctgagcgcctggtcgctggccggccgcgtggactatccatgctgccaggactattcgacgtggcagctgtgtgaagcggaggcgccatcgaggccattcctgcggacagtatcctgtccgaggctgcgtgctcgcctggcccgccgagccagtggggaggtgccgacctggtgccgttgccggaggtgcgtgctcgtccctggtacagcagcgatccgtgnacgggtgccccggggtagagtgccgacacctggatgccccgagcctgaacgccgaactactacgccataggaggtcaccctgcgtgctgaatgcgtaggaaacccatagcgaaatcttatgagcactgtccactgcatgaagttacgccacaagacctttgtattgttccctcacacgactcggaagaccccgacaaaagggggacactgaaagccggaggtaggacctgcccggggcaacacacgccctctgcggaacgcccaacgtaaacagcgggagccacacacggagagcccggtccaccgaaaatagagcagacactgccggcggagacccctcacgaccgcggctgcgtgaagccccccaaaccaagcaagggggacactcatggaggcaccgcgaaaacaagccgaacgaggacaccagccgaggaacacagaagacgacaaaccaacacaactacgtcaaacgtacgtcacaaaagcaagacaagagcaacacagcagcatgaccaactgacacagcacaacctagctcgaggggacgaacacacagctcatacag

SEQ ID NO: 519670 - DNA, 227 bp, Homo sapiens
gtgaaccctgccggctgagcacacagcacacacacaaacgcacagtacacacacttatacacatgcacacacagcacacaaacgcgcggtacatacacgcacacacatgtacacacagcacacacgcaaacgcacagcacacacaaacgcacagcacacacgcacacacagcacacacacgagcacacagcacacaaacgcacagcacacgcacacacatgcacaca

SEQ ID NO: 519671 - DNA, 135 bp, Homo sapiens
gattgtggggctgcagccgggtacggtcacgcaggatggtgcggaatgatggcctctgggattggctcatagcgctcagacactgcgctggtgagctgtggccagcctgtgggcagcgagggctcgggccagccg

SEQ ID NO: 519672 - DNA, 980 bp, Homo sapiens
  misc_feature (670)..(670): n is a, c, g, or t
  misc_feature (694)..(694): n is a, c, g, or t
acctgcacccaggtgaaataagcagcctgttgctcacacaaaacctgtttggtggtctcttgacagcaacgcgaatgaaatttggtgccatcactcggatcaggggacctcccttgggagatcaatcccctgtcctcctgctctttgctccatgagaaagatccacctacgatctctgctcctcagaccaaccagcccaagggaacatctcaccaattttaaatcggatcttctcagcttagcggctgaagactgatgctgccagatgactttggaagccccctggaccatcacagatgcccagcttggataactcttacagtggaggaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggcccaccctatctcccattcactgactctttttggactcagccactgcacccaggtganatacacagctgtgctcacacaganaataaaaaaaaaagtccgagaatagcttctccgtgagaaccagaagattcggatccctttcttgtgatggaccccgaactatgggtgtcacgctgcccgtagttggaccggcaaacatgccttgaacactttgaaaacgaaccagggtgggcagtcgccggcacaacaggtcagccctctttaattggccctcagtcgaggacggggtgagggcggcctcgcaaccaaggcgtcggggtacccagttttggcggaggattacggccggggggggacaccaccacgg

SEQ ID NO: 519673 - DNA, 130 bp, Homo sapiens
agatcttgtcactgcagttttgcaatgctcagtgcaaccccacgtggcacacttgcacttgtgtgtcccagtgacagcagcacagcttggacagtgttcttggcaccaacatgcaaagcgtgtgtgtgtg

SEQ ID NO: 519674 - DNA, 1018 bp, Homo sapiens
  misc_feature (679)..(679): n is a, c, g, or t
cgggcttcggcgccctatgaacttcggctggcaacacaggagacacgcgttcacgccacggatttttccccgttgctttcacatcgggccggacaaaaggcccaaagtgggtttcgcacatgttttgcacaccaccttgggcatctggattgcgccggcaatgacagtatttctgggaaatgatgaaaggttgaaagcttgtccccctttcctgggcttttcccgcgctcactggcctttcccacggttccaaacccgctctgttccccgccactgtcccccacacttgcccctcgggagaatgtagacccccatctcccttcaactctccctgccacagaggaatggcaacactcgcacatcgcggcgaatagaagggggatctcgcggggccggcccccccttcgaacacatttgccggccctcatgagtggacttacacacataggcggcaacaccgttctttcaaagagggaccgcggagattctcacaaccccacagctgtagcacgagactctccaataccctgtcacggttcttcttggccctcttggcttgttgcctgtggggcatgacagaatgtggtgacattcacgcgtttcccctgtggaaagtcggcggtgtcctcgacacaggatcacagactgtaggagaaccagtccttcgtgcccgtttctngcctgtcgcctcgcgagaagcattaggaagtcacgccatctgaacaggagcctatcaagagttcacacatgacactcgtcgagggagataatagttagcctttcattccttagctcgccttggggaaacaggcggagaaggggttccgggaggctaatggttgctttgctgaatgtgttactggggtacccatacgagttcccataggggctgctccctccaaaagggaggggacagatggggagcttttcttacctatttcaagggataacgtgcctttgtttttaaatgctttcatgttacttgcaaaaaaaaattactgccccgcaaagcactatt

SEQ ID NO: 519675 - DNA, 175 bp, Homo sapiens
acactgacgggcttacacggctctactcgctgctcagtacacggggggctcactgtccgcgtgctctccgaccacacccaccttcacttttggcacaccacaccgacgccctgcctttctccgccactttcctgccggcacggtccacgactttacgggtgactgactggacttc

SEQ ID NO: 519676 - DNA, 3540 bp, Homo sapiens
gcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagttagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgacctggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacagctatcccatcaagctcttctatacgtccaacatccccatcatcctgcagtctgccctggtgtccaacctgtatgtcatctcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcccgtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttgcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggt

SEQ ID NO: 519677 - DNA, 1321 bp, Homo sapiens
  misc_feature (1264)..(1264): n is a, c, g, or t
agcgggcggccgggctgcagcgcgtgggagcacgaagtgcgtggctgactcggcgagggcggatccctattagtgacccggaggcaggctctggggcccgccgggtccagttcaatctcacctgcgccgcaaagggggccacgtatataccactatgatatagcaaccctaagccggtttgcaaatctgctttgctctccacaggaccttcagcccgtccagctgacctcacgcattcctccccaccgttgtcctatctccccgtttccgctgggcccctgcgccgctgcggcctgctcctctctctccgccatcctcctagcccggataggttcgcccgctcccgtgctcctccagcttccctctcgccgccccgcctcgcggccttccttgctcctctcccctgaccgggccctccgcaaacttgcctagccgcgtgcgagtttgagccgcctttgcggcggccccctaatcagccgcatttcggcctcagcgctgtaactgcggatccgtttggcccgccgctacgtcggtacgcgactccccacgctgctctgatctgattatgccctggacccttggcttgcgcctttcgtcccttgcctctctgttctcgcggcccagccccttcaccgagctcggcccgtgggcgccaaaaatctgacttcccggcccgcgacagctccggtgagacgaacagcgagccgcaccacgctacggccagtctcagagaacgtttcgccgctacagcggcgcctctccaagtatcgacccatgcacatagagaaatcgctcctccccccctgggagcagcatgggccctggcaccgcgctacctaagaccgacgcatcccgccctacggccgtactcatccacaccgccgacgggggcgacagaacacccgactccctattatagagacaatattctcggccagcgccgccatctactccagcaacagatgtcagctccaacatcagcgtgatcgatatcggccaacgcagacaacagtgggctagcgcgattaggtgcaactccttacacgctggtccccccacagcgtcttctagtacgacactatgcgtctccgtaccacagtaagcgcatcccgacaacgtcggagttgctgcaagtcttagctcaagcgtactctttcacaccttcggtcgtagcatcacgcggccgttacctctgcgaacaacgcgtgagtcttataagcccccgattgggagtctacacagtcagcagtcgactatgctgcanctgatccgcacggtgttgtgtgtacctccatactactagctgatctattcgaccgcc

SEQ ID NO: 519678 - DNA, 353 bp, Homo sapiens
tgagatggagtctgactctgtcgcccaggctggagtgcagtgctgcaatctcggctcactgcaacctccgcctcccaggtttaagcaattctctgcctcagcctcccgagaaggtggggttacaggtgtgtgccaccatgcccagctaatttttgtattttcagtagagacggggtttcaccatcttggccaggctggtcttgaactgctgacctcgtgatccacttgcctcggcctcccaaagtgctgggactacaggcgtgagccaccgcgcctggcctaaaaacactcttgtcctaatcagagagtagttagttgtctttgtgggagtagggaattggtggtggaaatgt

SEQ ID NO: 519679 - DNA, 114 bp, Homo sapiens
attcctgagagcaagcagattgtatagtgctaatgcaaatggagcaaagcgttcgctgagccagttgcgtgagctccagatcgcaaaccttccctaccccccgtacgaggccaa

SEQ ID NO: 519680 - DNA, 145 bp, Homo sapiens
ctttttttgggagggggccttccagcatgtggggaaagccttccatcaggggaagatttttaagtgaaaattttttgccatcccctaaatgcctgcacctgcccttcagggaaatgggggtccttaaaggaaacttgccctttta

SEQ ID NO: 519681 - DNA, 269 bp, Homo sapiens
ataggctggcctccaatgccgtgtagtctgtagagaacaccttcactcctactgctctaacccaggtccccacggataccttggcaacggggttgtaccactgtcactgtacagaatcagacacgctctcccttgcgtggcatcagcatgcccaaccatggtatactcatcactagcaggacaacactgacccatctgccctctccctgctggaccatggacaccttaaggccaaacacagctgactccaggtgcacactggctgagaa

SEQ ID NO: 519682 - DNA, 281 bp, Homo sapiens
attttagaggatcccccgcgtgccggatcagtagtgggatcgcgcctggagtgcagtggcgcgatcgtaacactgcaggccggatgcggtggctcacgcctgtaatcccagcactctgggaggccgaggcgggcgaatcatctgaggtcgggagttcccgaccagcctggccaatatggtgaaaccccttttctactaaaaatactaaaaattagatgggcatggtggcaggtgcctgtaatcccagctacttgggagactgaggcgggagaatcgcttga

SEQ ID NO: 519683 - DNA, 1087 bp, Homo sapiens
ccattaataaggatatgagtaagtggaaatagagttgagcaagataatagagtaggctatggaccccgtccagcaactgcagtggtgtggcccaccacctgcgaggaagataggtagtcgttgaccgacgtgtggcatcggcatgatagatcgggctccggcagggtgcggagggtgaaacactcgcgtcgttcagcttgcgcgtcaccgacagaatccatatgcaccagctaccacaacgcgcaagagcaatgacaccaacaacacggcgcagtacagggggcacaacgcgagaagcggccggggaagcgcgcgcacggagcgagaggtgactcacaccgcgcggagcgaggggggaggtgtagagggggagtgaccccacagctgcggagcgcgccgcccgcggcggagagagagaggcatcgcggcgcgcgcccgcgcggagagagagaggggagggggggcaccgcggggcggggaagagagagagacagtagtgtgtggcgcgcccccacgcagagggaccaccaccgcgtgactgcgcgggggtggagagagagagggtagtggggagcgacacgcctgcgccagcgagagagagagaccgaccgcccgcggctgcgagcgagagacaaacgcgcggggtggagggggggcgcggaaggcacgcagcgaggggggccgcgccacacagagagagaacacacatccctcgcggcgcgcgggttgtgggcctccacagagagagagaagaagaagaaagggcgggtgggctgggggccaccccacgcgagaaagagaaagagaccccgagagggagggaggggagaagaaaacacacacacacctccgcgcggaacacccccccacccaagggggagaggcgcccagagaggaccaccccacgcggaggaacccgcgaccccgcccccgcgggcgcgcccggccccgccccccccccccggcccccccccccccgcgcgggggggggcgagagagaggggtggggggggcgggggaggaaaggctgggcgcgccaagagaggggggcagagatgtgtcccccggagggggggggcggggggga

SEQ ID NO: 519684 - DNA, 112 bp, Homo sapiens
  misc_feature (32)..(32): n is a, c, g, or t
  misc_feature (36)..(36): n is a, c, g, or t
  misc_feature (41)..(41): n is a, c, g, or t
  misc_feature (64)..(64): n is a, c, g, or t
agcccgcgagtgttttaatgacgttaaacctngacnctacntaatgtggccgccccaccggcgntttttatgcctggaacgacgagcgcacgagtagtgagcgaggaagcgg

SEQ ID NO: 519685 - DNA, 156 bp, Homo sapiens
tactgccggtgctctactgacttgggtttatcgtcgtgaccgctgtggtctggcacgaaattgaccaaccctggggttcgtatcgcttcagtttaactttcgtttattgctaacagcttaatcactggctgtttccctgtgggcggtcgtggctag

SEQ ID NO: 519686 - DNA, 701 bp, Homo sapiens
  misc_feature (462)..(462): n is a, c, g, or t
  misc_feature (471)..(471): n is a, c, g, or t
  misc_feature (473)..(473): n is a, c, g, or t
  misc_feature (483)..(483): n is a, c, g, or t
  misc_feature (486)..(486): n is a, c, g, or t
  misc_feature (491)..(492): n is a, c, g, or t
  misc_feature (498)..(498): n is a, c, g, or t
  misc_feature (501)..(501): n is a, c, g, or t
ggcacgaggcggaaccgagcccaggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaaacctcgccaacttcgncttatgacncncagaaactangantatcnngcggcnagntgcaggtcctgagatatactatcatcgactacgcatgtcggaggagacacgagcacctggtggaaggttagctataggaggccatgatgacaacactgtgaccaagacaggggacaaaaaaggagcaccatactgaaacgaaggaaggatgccacacatcaataatcaaaaagcatatccaagaacccacatgaggagac

SEQ ID NO: 519687 - DNA, 170 bp, Homo sapiens
gaggcgactgtaaggataaagaaaaggaaggggtggtaggcgcagaagcgggggacgaatataggcacaccgcatacatacatagataggcagctagtggcggctagcagcctaccggtgcctatcctacataagacctaccacacaacagactatgtagcaccgaccct

SEQ ID NO: 519688 - DNA, 450 bp, Homo sapiens
  misc_feature (12)..(12): n is a, c, g, or t
  misc_feature (54)..(54): n is a, c, g, or t
  misc_feature (68)..(68): n is a, c, g, or t
  misc_feature (137)..(137): n is a, c, g, or t
  misc_feature (248)..(248): n is a, c, g, or t
  misc_feature (368)..(369): n is a, c, g, or t
  misc_feature (385)..(385): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (412)..(412): n is a, c, g, or t
aaaaaacttgcnccttgacacttaagacagtttttaaaggttccttcgcgaagncactacgtagacanagagctcgcaagtgaaccccgggcacgcacatcactgtgcgtggtagtatccacggcgaagtaagcatnaaaaagatgcttaagggatcacgatgcagaacagcgctttgaaagcctggttggactcttcttacctctctggcgcaaaccagagctggatagaacagctctatgaagacntcttaaccgatcctgactcggttgacgctaactggcgttcgacgttccagcagttacctggtacgggagtcaaacccggatcaattccactctcaaacgcgtgaatatttccgccgcctnnccaaagacgcttcacngttactcttcnacngatctccgncccntgacaccaactgtgaagcatggttaaacgtccctgtag

SEQ ID NO: 519689 - DNA, 275 bp, Homo sapiens
  misc_feature (7)..(7): n is a, c, g, or t
  misc_feature (107)..(108): n is a, c, g, or t
  misc_feature (114)..(114): n is a, c, g, or t
  misc_feature (125)..(125): n is a, c, g, or t
  misc_feature (129)..(129): n is a, c, g, or t
  misc_feature (136)..(136): n is a, c, g, or t
  misc_feature (150)..(150): n is a, c, g, or t
  misc_feature (164)..(164): n is a, c, g, or t
  misc_feature (199)..(199): n is a, c, g, or t
  misc_feature (203)..(204): n is a, c, g, or t
  misc_feature (219)..(219): n is a, c, g, or t
  misc_feature (241)..(241): n is a, c, g, or t
ggatttnttggtggtagcatccacctccttcccccaacccaacagactagttcaaatttgggtaaataaataaaataaataagattcctcaagctggcctacccttnntagganccgtggtttcntccngccactntggatgcccgatgnccatctggggttanttggggcgtcctctcctctcgggtttttgggagcngctnngggatggcagcatanggggctggatggcgcttggcanatggctgctgcgcgcgcagcattgctgagctgcg

SEQ ID NO: 519690 - DNA, 216 bp, Homo sapiens
ttgccaccagcaatagggcaaaaaaaagcttgagagaaacaaaaacactgagagtgggaaacatatgacttcaaacattcatcaacatcagagaatccatactaagagcatttataataatatatgtgatagagatttcacaggcaagtactaggcatcaaaacttttgatgaaccatacaatgtggcgtgcatgctagctttaccaggcatcaaa

SEQ ID NO: 519691 - DNA, 117 bp, Homo sapiens
ctgggacacagatgtgaagagggtggctgcgagttcttgttgtcctgtgctctgagagtgtgccccgattcatcaagtacacaggctatgggaatgctgtggccttctggctgccag

SEQ ID NO: 519692 - DNA, 202 bp, Homo sapiens
  misc_feature (105)..(105): n is a, c, g, or t
ctctagcaggatccctttaacgacccgacagaccaatgacatttatgtataacatgaagacggactttaagtgccagctggcccgctgccagacagctgctggancggcaggggccggggctcagcaacgctgtgctcctgacgatctacatctcacggcttgggcctggccatcaaccgcgccatcaacatctgcgctagc

SEQ ID NO: 519693 - DNA, 168 bp, Homo sapiens
  misc_feature (44)..(44): n is a, c, g, or t
ctctgaggatccccaggcaaagctctacagaggagccaagcagncatagttgtatatgatatcacaatgaggaggtcctttgcagacgcacaaattggggtaaagcacttcagaggccaggcagtctaaccattgttataagctttatcgggaaaccaggccgaacta

SEQ ID NO: 519694 - DNA, 104 bp, Homo sapiens
ttacacgctatgatactgttcctgtgtgcgataatagcgaggtgcgataatagcgaggtgcgataatagcgaggtgccgataatagcgaggtgccgatgaatag

SEQ ID NO: 519695 - DNA, 729 bp, Homo sapiens
cttctccaccaacggacctctggggacacgagtctgagccgaacaccagagacactcctgccctttgcagaggcagaagccttcctcaagaaagctgtggtgcagtccccgcaggtcacagaagtcctttaagagggtttgccttggatccggtgcacagttgtgagggctcctctgtcatcacctaccaggatgtctggaggagaaaaagacagaacaaagatggaagtggcctggggcccctggggggtggggtcctctcgtgtgtgttataaaatcgtgccatcttatacgtagcttgatcgtctcatgtagggaggagccgagatctgctccactcagtgcatgcgtgtgcatcgcacgcgcaagacatacacttctcaccacaatacacacatatacactcacagcctctctggcctcttcccttggggaggggccacctgtagtatttgcctgattggtggggtacagtggatgtgaatactgtacaatagcttgtgctcagactcctctgcgtggagagggtggggtgcaggaggcagacccatcccccccaaagcaccctggggagatcttcctctctctatttaactgtaactgaggggatacaggtctggggatgggggacacttggccacaggatactggtgcttaggggtaccatgcccctgcatgcctgaatcgtgtactgctcgataatgttccgaatagaatatttgcaaaaaa

SEQ ID NO: 519696 - DNA, 323 bp, Homo sapiens
  misc_feature (176)..(177): n is a, c, g, or t
ccctagctaaagcctcccccaattccccctgccacccccccccccacttggctgccttaggagtcttgtggcattgctgtgaattagctcccttggtgatatgtcctatattggctaaattgaaacctggaattgtggggcaatctattaataactgccttaaagtcagtaacttnncccttagggagggtgggggaaaaggttaaattttgtattcagggggtttttggggaccttttgggttttttaaaaaatgtttttggagggggttatgcccaatccatgttttatttcagggccaataaaatttaggaaggcttcca

SEQ ID NO: 519697 - DNA, 1247 bp, Homo sapiens
ggacgcgtgggtccgcaagggaaagatgaaaaattataaccaagcataatatacgcaaggactaacccctataccttctgcataatgaattaactagcaaactaactcttgcaaggagagccaaagctaagacccccgaaaccagacgagctacctaagaacagctaacacagcagcacacccgtctatgctagcaaaactagctgcggcaagactctatacggtagagcgcgcacaaacctaccgagcctggctgcatagcctgcgcttgtccaagactagaactcttagcttcaactttaacactattgcccacagcaaccctctaaatcccccttgctacaactttacacctgcctctacgctcccaacacgagcgaacacagcctctctctgcgacacctaccgcaacacaacaccctctgtaccacgcacgcacgctacacaaccacattttacacacccacaatacgctacggccctacacaaccccagccaacccacaattacacgcaaaagtcgcttcaacgacttctaacacccacataccttacaaaacaatccccaacaccactactacactgcaacatccttccacacccaacttggaaccacatctctcacccctaatagcaagcaaccttaatgcttcacgctcataacgctaaccatgcacacaaccatccatcctaccgcactacagccactgcgatccagcactttaaccacaccacctcgaacctgcacaacttaaacagccccacatactctaccaatccaaccacaccaagttcattctatttaccccattcaacttgctcacacccccaaccaccagtgcactgcctccattaccgaacaaggcttacaacaccacgtacacaacgcgcaccctcggcgcacacatcttaaaccaccggactgtcataacccacaacaaccttcaccctcctatacactacaccacgatatcaccactccaccgtcctggactccgagtggcacacactggtgtacaataggcgcgctgcagcgcatacccttaaccggcttcaaacgtataaccataaatacctggcttcccctaactaagggacccaggctttaaacaggctccacacacagcgttccacagttcacaaacatacatactcatgagaattgacatgctcgtcaaaaaggcgtaccgtaccatcagacaacataaacactaggcgcatactattaacgcgacgagcagccaaacc

SEQ ID NO: 519698 - DNA, 863 bp, Homo sapiens
  misc_feature (792)..(792): n is a, c, g, or t
cctagcgccgctgggcctgaacggtctctgtcgagcagcggacgccggtctcggttccgcaggatggggtgttgttaaagtggtcaagaataaggcctactttacgagataccaatgtgaaatctagaagacgacgagagggtaaagactagattaattatgctacgggaaacgcattggtggatacgaaggataaatgataaagtagcaagcgaacgagcgcgcaagagtaacaggagtgaatagtgtacgtgtgacgaaatcgatgagatgatccatttgtcaggattggctctatgtcgcgcagtcatgagagaggcggagtatcgagtagatctagcagcagagatatggcgagcagcgaatctgcccaacaatactggtagtggaagggttggcgtcgtgacagaattgatgctgacaggcatgattgtcactcgggcctggctgactgaggctcgcagtgccttcatcgaactaggatttggctactggcacagaggatgctagtgacaggcgcaacgtgggaggctgaagcgtggtagatgagatagcaactgtaggcaaacgcagttgcatggttcgagaccgagggtgccatgtcaggctgcatactgttggactgcgaggcactttgcccaaggagactactcacgtggcagatgagcacgtgtttggggagcctcgtgaaggggagctggggagatggcgaggggctctggtcttagtaccgcgtcaccagataaccgaaagcagagtatcccatgcgtttactggatctctggaacacgnctgaggacactttcacatggcgggtaaagttgacactcggtgaaggctatcattcattggggcccagaatt

SEQ ID NO: 519699 - DNA, 136 bp, Homo sapiens
ctgacaatcactctcggactgcgtctcgctgctgggggcatatgccccagcaccctgtaacacccctgctgttgcctgggcagagaggaaggggagggcacggatgcctgtaattattaacacactgacttccatt

SEQ ID NO: 519700 - DNA, 193 bp, Homo sapiens
ccccccggggggggggttttttagggggggtttccccccggaaatggggggggtaattttaagaaaccttttttccccccctccccccccggttttttggggaatttttaaaaaatttttgcgcccccggggttccccggggttgggggggggggggggatttttttttgttttatttttttttttggtttga

SEQ ID NO: 519701 - DNA, 204 bp, Homo sapiens
gtatgtgtacatgagtacaagtccccatggaggctagaagcattgcatctctctgtatctggagttacaggagcatagaagcaacatgtactcattggccaggacaccaggcatggccagaagccctgcaagagtggctgctgtgagtctctgatcctcagaggaaggcccagctagcaagcaccacctgctcctaacagccat

SEQ ID NO: 519702 - DNA, 407 bp, Homo sapiens
tgtttatcgatgcaccactgcttctgcaggaggctgctgcctggaaacagtgggtggtggtgtgagtggagactccttcaccattggttagtcttcttgatgctgatgtcctgttagtgagttcttatgtgatctggttgtctaacaggatgtcacacctctttcctctctctgtcttgctcctactcctgccatatgaaacatctgattgccgcttggccttctgatatggttaggaggggcctgatcagtgtgggcctgctcagtggacctagtcagttgggacttggtcagtgaggcctatttagtggggggtggtcagcaggtgtctgcttagagagggtctcattagagggatctagtagtgcaggtcttggtgagtgtgttcctagtggcatcgataaaca

SEQ ID NO: 519703 - DNA, 190 bp, Homo sapiens
actcagttccagcccttcatggcagcacgaagttcatcagcatttaaattgcgctgagtttttagcagagcttaaaacaacctcctcaaggtgacctgttaaaggctttcttcagatgtttcatacccaggggctttcctcttttcctgagagatatgctgtctttgtatctgtttgacacaaggtgcac

SEQ ID NO: 519704 - DNA, 83 bp, Homo sapiens
gcacgacccccattccctctctactcttgacagcaggattgaatgttgtgtattgtggtctattttattttcttcattttgtt

SEQ ID NO: 519705 - DNA, 413 bp, Homo sapiens
ctatactgatactacaacgtcatcgactgtgacccaatcatcttcatatacctgtgaactgttcctaccgtgctcgagtggtcaaataccagcgtgacggtccgaattgcatgcaggacaatcaaggtggtgctccaaattactaccccatacagctctggtgctccgtaacagcaggcttctgccctgtatcacagtatccaatattctgtataaatggggagataccagactggcaatgattattacattattcaggtgtgggcattctatgtgaacgtgctgaatgaggcacagaggaaacgtctgtgtgagaacattgccggtacacctgaaggatgcacaaatttgcatccagaagaaagcggtccttaacttcactgacgtgcagccttactacgggagccacatcg

SEQ ID NO: 519706 - DNA, 346 bp, Homo sapiens
tattagtttttaaaaagtcctttagttttacttaattctgtggtcatgatatatgattagggcgtctagatctatatacggcagaacacggaagggaatgatctttactcaagaatttcagaaagtcagcactgaagtcctgacctatccgtagacacattggtccctttccagcatattttaggcatcattctcagcaaagcaggccatttctcccacctgcaaagtaccatcacttctatccacttgccacataattcaacagcaactcacattaagcggttactcagcacagttaatcatagaaaagcattcatttgcttcatcagttcatagaaaatatctg

SEQ ID NO: 519707 - DNA, 412 bp, Homo sapiens
ctacggggctctctgcgtcgccctgcggctgcgtgcttggcctggcgtcgttttcacctgtgcccagctgctcttccgtcctggcctcagtagctccccccgccttggtctcccgcggtgttgggcttacagccctgcgccactgcgccgcgcctgcgcctcagtttctgctccttgcaactgggcgcctgttctgcgagctagcgcaagtcttgttgtcttgtgtcccctgccccacagctgtgcgagatactagctaagatcactgaacggttatcaaactcaatctgatggtgaacgacgatacagagatcaagcccgtccgcatatttaccgtggggacactgaggcccaggaaacttggagcttcttcaagtaatagctcggcctgtactgccccatatggtagccg

SEQ ID NO: 519708 - DNA, 4728 bp, Homo sapiens
gagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtga

SEQ ID NO: 519709 - DNA, 4776 bp, Homo sapiens
gagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagctcttcctggtg

SEQ ID NO: 519710 - DNA, 3294 bp, Homo sapiens
  misc_feature (6)..(6): n is a, c, g, or t
  misc_feature (81)..(81): n is a, c, g, or t
ggtggngtgtggctgtggcagggggggcatccaaccttctctctttggagtcccagatgcccgcaaaggctgacagcttgnctctcccgctgcttaagaggaaggcatcggggccaggtgtggctctggacctagagccactccgtgggagcctgaatcacacccctgctcacttggagtgttttctgtttccaggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtga

SEQ ID NO: 519711 - DNA, 717 bp, Homo sapiens
  misc_feature (203)..(203): n is a, c, g, or t
  misc_feature (392)..(392): n is a, c, g, or t
gcggcgttggcggctagtgcagcaatggccaagatcatagctcgtgatcttcgtgggaagaagaaggaggagctgctgaaacagctggacgacctgtaggtggagctgtcccagctgcgcgtcgccaaagtgacaggcggtgcggcctccaagctctctgagatacgagtcgtccggaaatccatagtccgtgttctcacacntattaaccagactcagaaagataacctcacgagatactacacgggcgagatgtacaagcccctggacctgctggctaagaagacacgtgccatgcgccgtctgctctacatgcacgaggagaacctggagaccaagaagcactatcggtaagagaggctgtacccgctagcggagtacacactctaagnctgatgtgcgcacttgtaatatagcacagctggctgtgaagaaacatttctgcataaaagtcatacatatgaagcacgggctgtatcataatctcaaggctgaattttgataaacgaatccagagacctaaagcttttgtggggggcccgactcccagttgcgccaagtgggatttttgtttatattcttgggccgactctttaaaataaagggacggggccacgcctttccctaactctgtgacaatgagctgcccacttgctccagaaggtgttttatttacatactatacgcctttatgttttactagattacacgcttttt

SEQ ID NO: 519712 - DNA, 111 bp, Homo sapiens
tccagagctgcagtttaatgtttaatagccaatactcaatacagagggctagcgggctactaagaccgacgcgaacagcgcgatgcgtagtgacgccgagcgttagacgta

SEQ ID NO: 519713 - DNA, 2777 bp, Homo sapiens
  misc_feature (109)..(110): n is a, c, g, or t
  misc_feature (113)..(113): n is a, c, g, or t
gccaaagaattttaatccctaaatatgttctcttaaaggaaactcctgtctgaatacgaagcatagctgggatttttgcaaagtcccttttacttcctgccatgcctcnngtntacgggactcgtcttcttttattctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtga

SEQ ID NO: 519714 - DNA, 108 bp, Homo sapiens
tgaagacttaggcctagcaaattgtgttggttatgtgagtgtgttataaatcagagatgtacatgattgccaatctgcattatcttaccagtgtgaccacacgtgtta

SEQ ID NO: 519715 - DNA, 4459 bp, Homo sapiens
  misc_feature (4388)..(4388): n is a, c, g, or t
  misc_feature (4390)..(4390): n is a, c, g, or t
  misc_feature (4433)..(4433): n is a, c, g, or t
  misc_feature (4453)..(4453): n is a, c, g, or t
  misc_feature (4458)..(4459): n is a, c, g, or t
gagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagatccgtntncgcggtaccggctcgaatcgaatcatggcatagtgttcctggngaaatgtatccgtacattcncacann

SEQ ID NO: 519716 - DNA, 1042 bp, Homo sapiens
  misc_feature (43)..(43): n is a, c, g, or t
  misc_feature (65)..(65): n is a, c, g, or t
  misc_feature (79)..(79): n is a, c, g, or t
agctccgctcgatgttggtgaattgtaacggataccatttccncagaaccagtatgccatgattnggattcgagctcgnaccgacggatacggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtga

SEQ ID NO: 519717 - DNA, 219 bp, Homo sapiens
accgcagtgcagctgcatgccgcaggcgactacttagaggatacctctgacaaacctcatcaatagactggagacgtacagaaatattcaaccatatctacagaatgctcagctagtcatgtcggccggcttctagaaccaaagtgatgtttggatgtggagtgacatattatcttagcggatgacatcatatcgtgaggaaggttgagccttatactg

SEQ ID NO: 519718 - DNA, 362 bp, Homo sapiens
ctgtgcctctgggtactcctcctggtactcctcctctaccttttaagtcaaatcttccagtaagccaaagtctaaggaaagaaacaagtacattgttgcctattgagaaggtaatacaaagccctttcatttcctttacaaactttaagggcctttataatacttcctaaatggctgggctcagtgtgctcacacctgttatcccagtcgctttgggaggctggggcagacagatcacctgaggtcaggagttcaagaccagcctggccagcatggtgaaaccccatctctactaaaatacaaaaactactccggtgtggtggcacaggcctgttttcccagctacttgggaggctgaggca

SEQ ID NO: 519719 - DNA, 2438 bp, Homo sapiens
gagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctaggagtcagagccgtgtggctgagttttggctgctgatcatggatgctgggcccctggggcatgagcgcctgccctcagcctgtggataccagcccccccaggggcctgagagtcactttgtggtacaggccacactgctgaatagggtgatgctggcaagaggcatgtgctggcggagcgagtgctgcccatgtggacggggcaccgagggatggcttgaaaggctgagcaggcttgaacaagccgccctccttcccagaacgcctcctgcagccctgactaatggtcttgcccgggaacttggttaattgagtatttctgaaaatatatctgcctgccactgggaaa

SEQ ID NO: 519720 - DNA, 122 bp, Homo sapiens
tatgagctgttctaatctcagccttgctagcagatgggcttacacctaaaataagaccagcttctcgcctactcattttctgttcaaatcctcctttatagtaggatgaaaagctaggagtt

SEQ ID NO: 519721 - DNA, 2377 bp, Homo sapiens
gagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtacccccgcccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccggcaattagaatcggcagacacgaggacacccaactctcaaattgtcttaagagcattctcttgagcggtggattgttttgttggtttaaaaaactacccatcaatgattttcaatgcttcgttgacagagtctcaattgaaaaa

SEQ ID NO: 519722 - DNA, 169 bp, Homo sapiens
tggggcgtaggttgggagcgggagtgaacatttcttcaggtgtgactactctggctggagcccagcaggagcttctgaacatgaatgctatggaccatccacgagctgctgcaggatagcaagccggacaaggatatggaggcttcagcagcaggtgaaggctccatat

SEQ ID NO: 519723 - DNA, 409 bp, Homo sapiens
  misc_feature (14)..(14): n is a, c, g, or t
  misc_feature (379)..(379): n is a, c, g, or t
ggttttcttgccanctgggggggcatcaataatcgccccttggagacaaccaaaccatatacttcccattcattttcgtcgtttgataggattattccacggcctttcctaccagttggttcaaccttatgtcgttattccagcttcaattgtgagccttgattgctgcaacactaggaacggcaattcggacatacaacaaaaaaccctttaaaagccccaggcccctgttcttcggatggattttttgagctttgtttcttcatatcgctccctcgttggaaaatcaaaagttaagtttgaaaacaatcttcacaggagcccaagcacaaattttgttattcagctgttctagttaattcatttttgccagttgaanaactattaatcacccaatccaaaaaaaaaa

SEQ ID NO: 519724 - DNA, 220 bp, Homo sapiens
gggggcccggcccccggggggggggttttttttggggttttccccccagggggggggggtcccgggtttttggggtttcgggggaaaagggacgggcccggccgggggcccccctaggtttgggggcccccgggggggttccccccccccccccccgggggggcctttttttcggtgggggttggggggggttccttttttaccccccctgctttgggta

SEQ ID NO: 519725 - DNA, 478 bp, Homo sapiens
  misc_feature (88)..(88): n is a, c, g, or t
ttactggcatttcctgcttcatgggattgactgcagactctcattccctcagtatagtgtatgaatgggaagcacttcatagccaagngtctgtatagtcaatccattgtgcgtgtgccttgcaatgtgaaggcggcgaaaactgtgtccaatgggtaaagtataacgtcagaacaaagactggcagcaaagttagcaataagttctggaaaataagcatccaacatactctgcacagggctagtgctctcagctaggtggctatagtaagctcgtttctctttagaattagtaggacaaacttctggaataacttgagctgatagatgtaatggaagaactccgatgacagcaccgtaagggcaagatcgcacaggaaagaatgcggaagaagtcgtttggctcatgaggcactcccgatgccgtatcactcttcccaattccttctttttaacacactcgccaaaatgcccaggtc

SEQ ID NO: 519726 - DNA, 585 bp, Homo sapiens
  misc_feature (491)..(491): n is a, c, g, or t
  misc_feature (515)..(515): n is a, c, g, or t
  misc_feature (519)..(519): n is a, c, g, or t
tctgttgcccaggctggagtgcagtggtgcgatctcggctcactgcaacctccacctcccaggttctaatgattgtcctgtcgcagcctcctgagtagctggcattacaggtgcccgccaccacgcctggctaatttttgtatttttagtagagacagagtttcaccatgttgatcaggctggtctcaaattcctgacctcacgtgatccgcccacctcggcctcccaaagtgatgggattacaggcgcgagccaccacgcctggacctggtgtgactttttgaaagcatgcccattcatctgctcactcaaatccacccagtacagaggagtgtggtgaggcctctgcactgcagggctcaggagaatcagggccttggaaacgccaactttgcctacaccactagcacccctgtgaagcctagagatgcaagccttgtgtttcaatcttcacccgaaagatctgaagggtgcagtgggcattggtcatnctgggctgtctggcattcatcctnccgnctgggctgagcacagtgatccccttgggaagccttaccctcaacatgcattcttcgtgggaggtgc

SEQ ID NO: 519727 - DNA, 138 bp, Homo sapiens
  misc_feature (104)..(104): n is a, c, g, or t
  misc_feature (131)..(131): n is a, c, g, or t
tgctgatgtagcctgtctgtgtttgtgtgtgtgtgtgcgcgcgcgcgcatgtttgtgccgggagacagcaagctggtagtatgtctttctggctttaaaaatanatggaattaataaaaaccctttgtacnattcaaa

SEQ ID NO: 519728 - DNA, 100 bp, Homo sapiens
gacggagaggatcccgagcgagatacatactaaccagtcatggaaatgcaaatcagaaccacacaaggtatcggcccacacctgtgaggatggctaatat

SEQ ID NO: 519729 - DNA, 312 bp, Homo sapiens
atatgtaatgtgaccgtaaacaaacctcccttttgctgtataaatgaccctgactcagacagtcccttatagtatcgacaaacagattctgacactacccacccagtcgtctctcagacctcataacgttgatgcttcttacatgggtgcccgttaagctgcgggggaccccatacagttgtcaagcaaacatgctggtgctcctatctggccttcgtattagaagtcccctcttctgggaaacatgcctcctttagtgacctgaatggtcaccaattcacctcctgtaggtctttgctttggtgtcacctt

SEQ ID NO: 519730 - DNA, 158 bp, Homo sapiens
gacctgccccatttatagcataatgtcttccaggtttatccatgatgcacaaaggacaggatttccttatttatttatttttttgataggatagtactctgtcacccaggccggagtgcagtggtgcgatcacagcttatggcagcctcatcctcctg

SEQ ID NO: 519731 - DNA, 151 bp, Homo sapiens
gcatgctgctcttcatgtgaatgtgcgtcgcggttctccacagcatcgcatgtcgctgctcttccatgtagatgtgcatcaggttctcctcagcactcgcatgtgcctgcctcttcatgtgaaatggtggcgtcaagggttcctcctcaga

SEQ ID NO: 519732 - DNA, 277 bp, Homo sapiens
tgaggagctataaaggcgagccgggtacattgcaatgttatgctatcaattataagctacctcgggagtcaatggtagccggcccggtctcttgctggaagctcgggtcgtcctcgtcctccagtgattgttttccagataaccagtgcctccctgcttctctctcgtcctgccagagctcttttcctagacatctctctgacacacacgagaaggtgctaggtggagaccgagttaccccaagccaaagccacgtcgacgtgcccccacatcacct

SEQ ID NO: 519733 - DNA, 733 bp, Homo sapiens
  misc_feature (733)..(733): n is a, c, g, or t
gcatctcagtgcagaagagagcgatccgcgatccctcttggacatgtgcatacgtatgccgattcgatcatgattgtggctgccattgcgtgagtgcacttgtgtgcctacaaatgagcgggtacttatcgtggggtctaaccaggtctccatataatagctagaaactggctgcaagagcaatggttgaggcccaaggtgaagatctaggaggcgctccttattgattgtctcacacgcagctcgtccagaatgtgagctccagagcccatctcgtttactatctaggcatacatctatgttaatggatcgcatgtatgcggatctcactgaagatcgagctaccctcctgtgagagtctgacggatactattggccaggagacttctgcccttctggaatgatgacttagttcgcccaaggatcaatggatggtggtaaatcgtgtgactgattgcagccgcatggcaacaggctgccggggcattgtcaagtcgatctggatgggtctcttctgaagaggcttatcatggagcctgaatcgctgccgatgtggtattgccagttgtggtatgaagttggacatagaatcttgaagtcctatctaagtctccatgcgagttgctagggggagattgaacgtagaacgggtgtcgcattatggccatgtgactgttgtgggttgcccaaggcaggggtccagaaagtgaaggcccggggggaggatattggn

SEQ ID NO: 519734 - DNA, 794 bp, Homo sapiens
acccacttggtttgttacgtacgcatatatttgtgtggagtggtttttctttctggtcggctgttttgattataacttctttattacggtgcggccactacgtgcgctcacaccttttttttgtgtggttcccgccattgctttttctgcggtggcctcttccttcattgttttcttctcttccccccctcgggtgatttccttctctttcttttggagtcacgcagacgttgtttttagttccttttcgttgtttttccgtccaccatgtattgtcttgtggcacaccacctgttttgattataagcgatataacaccggcgggtgttcttctcttcttagaaagaggaacgacgctcgggggtccccccctcttcatcatccacactcattctggtggtgttcccttctccttcataattacccactcttctttggttggttttgtcgtcctcattagcacacccgtcgaggtgtttttttttgtccgcgtgtgttcacggcgtgtgtatatgtgtttgagtgcgcgtgttttctgagccaccgtgttgtcctcccgcccctggaggttttttgaatcccttctcttctttttctcgaccgtcatcattgctgggggccatctctttgtgttattataaattttttccccgttcttgtttttttttttggttttttttgttcctgtctctttttttttttttttgttaaaaaaaaaaaagaggggggaggttttttttcctttttttttttttattcccaacaaatgttaaaaaataaccgggtggttttta

SEQ ID NO: 519735 - DNA, 379 bp, Homo sapiens
tgcccctgtttttaaaacaagttgggaaactggatgggctccagggggaagggagaggtttttcaaggggaactgtttttgcatccatggcccggtctcctgtttaaaactgcaggggtgcaggcaaaaccggggagctttgcccagttagggccacccccttacccttactccaaagaaagggcagcaccaggctttttggccaactgcctgtttgcccacgtggccaccctcctgggggggggcagcctcactggttttcctgcactgaaatgcaactttttttgccatcctcctgggggaccgggtggcatccatgtaaagtctcccgccctggaccaccactgttggaccccagaaaatcggcggaaaaattgat

SEQ ID NO: 519736 - DNA, 308 bp, Homo sapiens
ctgaaagtcaggctatggatcgtgggctccttgtaactcacgtaattgtttcacatcaggaaaactctgggctgtgtgcagtgagctcacacctgtgatcctagcactttgggaaaccaaggtgggtggattgcctagctcagtgacaccagcctgggccacatggcaaaaccccgtctgtgccaaaaatgcaaaaaattagctgggtgtggtgttgacgtttgcggtcccagctactctggaggctgaggtgggaggattgcttgagtctgggaggcggaagttgcagtaagccgagatcatgccac

SEQ ID NO: 519737 - DNA, 763 bp, Homo sapiens
gcttgcagcgcttggtgtatgctgattggcgacgcgccggggtgggctgcaggctgggaaatggcatggtttgtatcttgtggctcggtcgaagcgagttagtaccagattacgatatcggtgcgtgtagtgcgggacgtagtatactccgcgggtccacagtagacgcctccaaggggcagcacaagaatctacctagtgggttatcgggtcccaggataatcctcattgacactggcagaaatggcaatttccagaagtacatcatgcctgtgtttaagagcaagtggctcataaacgtcgtagatttaaacaacaagtctaacgtccaggtagaagttgtacgtcgatgtcatcatggggcacccagagatcattctgggaggcactacggagatatgcagtcaataccgtcatctaattaatgagacactacctgattgccaggtacgaaaaatgtgccctacggaaatccatcgggcagtacggacgacgcattatgggcgacacgtggagagcagagcaactggtgttacatctgcaagaggatggcagatgtgacttaagacttgaggggagccactctaagagttctactattaccccttggacacactggatgatcacatggctctaactcttagaacgcacggacgcatgctatctcttctggaagaatgcatccctaggggacgcgaagccccgggtattttgaccaccctctatgattcatctgacccctttcatctcgagtctattggac

SEQ ID NO: 519738 - DNA, 154 bp, Homo sapiens
ggcgaaaaaaaaaaaaaaaagtcagactacatcgaaaataactcaattataccttttatcccattaagtcgagtcgaatctatagtctccgagtcaactagtctccgcgatttgatgggagagcgttcgacacatcccttggcgtggtcgtgtg

SEQ ID NO: 519739 - DNA, 170 bp, Homo sapiens
  misc_feature (160)..(160): n is a, c, g, or t
  misc_feature (166)..(166): n is a, c, g, or t
agacggtgaccactcctggcatatcttctgggcagcgacgcagctttacagtgcactggtggctgctgcatggactaggcagcttctagtatctgctcctcaaagttcaaggactcatctgcctccttgggtttggcccggggcttcagctgctctagcntttttnggct

SEQ ID NO: 519740 - DNA, 257 bp, Homo sapiens
aaacgggacaacttgtccatcgtttcactgtaccagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttttaaataaaaataaaacaaaatacaaaccgtta

SEQ ID NO: 519741 - DNA, 440 bp, Homo sapiens
  misc_feature (29)..(29): n is a, c, g, or t
  misc_feature (40)..(40): n is a, c, g, or t
  misc_feature (55)..(55): n is a, c, g, or t
  misc_feature (59)..(59): n is a, c, g, or t
gctgttttcctgcgcaggagccgcaggcngtacagcacantggcgcccagcgganatgnatggtcttgaagccccacttccacaaggactggcagcggcgctcggccacgtggttcaaccagccggcccgtaagatccgcagacgtaaggcccggcaagccaaggcgcgccgcatcgccccgcgcccgctcggttcccatccggcccatcgtgcgctgccccacggttcggtaccacacgaaggtgcgcgccggccgggctctcatccttggaaggaagctcaagggtggccggcattcacaagaagggtggccccggaccatcggcatttctgtggattccgaaggaggcggaacaagtccacggagtccctgcaggccaacgttgcagcggcttgaaggagtaccgctccaaactcatcctcttcccccaggaagccc

SEQ ID NO: 519742 - DNA, 325 bp, Homo sapiens
tagacgtgtagtggatgaacccccccatctcattcatataccaaatctctccctcacgaggcgtaacgcgttctcctcgactctctcaatcttatccagtcatagcaagcagttgagggtggattaaagccgtacccagctacgctaaaatcttagcatactcgtcagtcacccacagttggatgaataatagcaattctaccgtacaagctctaacataacgcattcattaagttttcttatttatattatcctggtctactaccgcattccgtcgactcaacgttatctccggcaccacgaccacgtactactatctcgctcg

SEQ ID NO: 519743 - DNA, 438 bp, Homo sapiens
gatctaagcaactttgaaataggcaggatgccattgtgacagatgggtctccgtgtggccaagatgccaagtattctatgcatcaagtgtctctgctaaaagtttgaatccccgccaggaaaatccaaatggatgtctgtctccaaacccggacataatgtttagggcgtgaccctctcccgaaatccactgccgccgggcgctaacgttccctcgtccgaggtctgggtgtgaaggttgggaactgctagcccagagttcaatcggatgcaacagtcccccagctgtccctgctcctgccctctactgcagacgcaggtccatgacacctcagagccgtgctcctgccaggcctgctttttgtatggaaacccaagaaaaataaatatatgttggttctgaggaaaggaagattgtacgcagatatgtggtttccaa

SEQ ID NO: 519744 - DNA, 894 bp, Homo sapiens
  misc_feature (273)..(273): n is a, c, g, or t
  misc_feature (283)..(283): n is a, c, g, or t
  misc_feature (310)..(310): n is a, c, g, or t
  misc_feature (318)..(318): n is a, c, g, or t
  misc_feature (322)..(322): n is a, c, g, or t
  misc_feature (363)..(363): n is a, c, g, or t
  misc_feature (434)..(434): n is a, c, g, or t
  misc_feature (436)..(437): n is a, c, g, or t
  misc_feature (444)..(444): n is a, c, g, or t
  misc_feature (464)..(465): n is a, c, g, or t
  misc_feature (566)..(566): n is a, c, g, or t
  misc_feature (575)..(576): n is a, c, g, or t
  misc_feature (591)..(591): n is a, c, g, or t
gacagtggttctcaaaatttttttctctcaggacctcttagaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttggaaacggantctcgctctntcgcccaggctggagtgcaggggcgcnatctcggntcantgcaagctccgcctctcgggttcacgccattctcctgcctnagcctcccaggtagctcggactacaggcgtcctccaccatgcctgggctaatatttggtatttttaagtanannacggggntttcaccgggttagccaggnntggtctcgatctcctaacctgggtgatccgcccgcctcggcctcccaaagtatggggattacccgggtgagccaccgggcccgggttgcaaataatctttntttttttcnngagacagagtctcgntctgttgcccaggctggagtgcagtgggcacagatctcggctcacgggcacgctccgcctcccggggttcacgccattctcctgcctcagtttcccgagtgggctgggactacgggggcccgccaccacgccccggctaactttcggtggtctttagtaaacgcacggggttccaccgtgtgggccaggagtggtctcgatctcctgacctgtgtgatctggcccgcctcgggctcccaaagtgctgggattacaggcgtgagccaccgcgcccggcggcgaaacacgatttgtcctaccatg

SEQ ID NO: 519745 - DNA, 418 bp, Homo sapiens
tgggtgatagcgaggtcagacacatcaaagtgatgcagcctgggatcatcaggatataaaatctaggaactatgactaaaaatgtgttcctttcttaaaaccaacgtgacactacaaatagcatccttgagaaaccaatatgcatgtttaataatttttgttttcccactgcgtacctatcgattagtctttcctgtatgtagctctgaaggaagcctcacttctttcctggcatagggagttccttaaacaagagtcagggactctggatgcccatttcctcttaacatatctattattctgggatagcaaacagaggaaagatttttaatagaagttgtttactaacttcaggaaattgccccttcaggatttgaacaatctttctaatgttagagaaggcttttcaccctcaaag

SEQ ID NO: 519746 - DNA, 240 bp, Homo sapiens
ggtcgatctctagcacgatcccctgttagacattctagggaggacgggctgaatagttaactgtttaaatgatgtttatcattggtgttgcagctcctgttggatcaccaggatgccattgctccggtagcacaatgtatcccatagtccacgtatacctgttgggatctacctcgggcgaggtgcccgaccatcgagctcccctacatagcgtatgagtgtcataacttttgctctgga

SEQ ID NO: 519747 - DNA, 702 bp, Homo sapiens
aaacgtttcaaatgttgggtataatcccatcgtaacatgtgtccagactgggaatcatagacggtgaaaggtgcaaagcctcaagcgcgatgtctccgccagtgtttacacttagacgaccattacagctcgaccatcaatttaggaagtgaggtgtgtcatcaacaagttatcaagctcgtgcataggtcttgagctataggtaggccaattgtgtatgcgtagaccatgatctatgttgaagggacgaccctgtgatgatatcatcagtgattaccgtcctaggtgcctatttcagacgagttaatgcttgcagatgtctatgccacatatgtcacatggaggacgtccctgctgccacgggcaagggtggcaagaatcgtcgtcaacgtggaaggttaccgcactagttgggcgcgcctctgggtgtcacaatcagcatgtggtttcgtcaacgtggcggtagcgggaaaatgacaattgtgaacatccagcatcttaggtttttgtacactaatggggaagaaggggcatgctgaacgtttgaaggttcatcatggtcatcagtctctttctcaatgaacaaagcctgaatgagtcactgcgtgtaggaccatttattgttatggcacgcgctgcatcggtggaggctgtgcttcttacagccaacagtgagcagtgtgttcatttgtcgataaacag

SEQ ID NO: 519748 - DNA, 408 bp, Homo sapiens
ttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagacagagagaaagaaaaagaaagaaaagtaagaaagaaaaaagaaaaagacccccaagtaag

SEQ ID NO: 519749 - DNA, 103 bp, Homo sapiens
  misc_feature (5)..(5): n is a, c, g, or t
ttgcncttaaagcacgagctatctcactgctccagctctcttaagttggattaccagttattactcagcaaataggtggtggtgtcagcagatgaggtggggg

SEQ ID NO: 519750 - DNA, 530 bp, Homo sapiens
ccaggcatcctttcagacaccattcttggagtctcttccctccatcacgtaaacctcacagccaacagtgaaggcactgaactccttccaggggctgagcaggctgccttgggcatgctcttcttgaccttaaaatccacctgatagatctggtagggaggtagaaattttggtggtaggaaagccagcaattatcaggtcaaagggtttctgataaaaggagttattcagcagaaaggtaatcagattatgggagccttaagtgccagtttgggctaaattctctgagtcactggcagattgtaagtaggggaatgacgtaataaaaccactgcaaagccaggagtttgtgatgggaagataggaaatccctttctttttttcccacatgggaaataaaaatctaaagatgtgtggggaagctccttagagtgccaggactttcagtatcccccaatttatcattaggttctgtccagacctcgttccgcacacagtagcctagggacacctctggaataaggtgtgac

SEQ ID NO: 519751 - DNA, 389 bp, Homo sapiens
ttacaggatccccactcagcaccctcttctacggaggaaggaacgggccagcagacttgcggcactcctgctccccttcccatttctgcacttgggggtctagtgaggcctcctgtgcgatacgatgaattcctcccgtcctgtatcatcagacctcccgcctgtgatgcctcctggatctactcctttcgcctcctcccttccctgagagcagcccctggatcatgctccacctccgctgctgcctcggaccacctgcccactctatctgccatcacgctgtccacgctgagctccctgcgcctgatcatggcttcatcgttgaacctccttagaggaacacatcaggctgtgcgataccacgaattgggattctaggttgccccaga

SEQ ID NO: 519752 - DNA, 530 bp, Homo sapiens
aggacattcaggtgatcgtacacctagaaacgccaggacgatttgccggagccagacacgccggtaaacaccacttagggcgtcccggggaatatccacatcgacattgcgcaaattatgttcacgggcgccacgtaccctgacaaaaccggtttgccgggcggtgagcggtgggatgttgcgctgtgaagtcatgggcaaccttgtcttgcgcttagcaccctgcgcacgcgttgggtcagggcatcgggactgtagggtttgctcagcaggtggatatcggcgctgagcagatgattggaagacagaatgtcgcgggtgtggccagaggtaaacagcaccggcaccggcgggttctgcgcgcgggcccaggtggccaggtcggtgctcttgacccgacccggcatcaccacatcggtgaagatcaggtccggcgacacgccgggcttgaaacacttgcatcgcgcggtcgccatcctcggcggtcagtacggtataacccgactgcttcagcaactcgaacaccgtca

SEQ ID NO: 519753 - DNA, 255 bp, Homo sapiens
caaggtgcacagatcactcatggtaccagatctgagaagctaagaaacctctaatctaaattgctcattaccataacaatttagactttacaccagcattgaataatggctggataactgccgaagtaagcgccgctccatgacgtctgcttcacttatttaaaaattgtgtatcagttataagtactgttcatggtgtgcagatataaggggaatagggccttctgtagaattatacatgtctaggttagtaaa

SEQ ID NO: 519754 - DNA, 505 bp, Homo sapiens
ctgactctagaggaccccgacgtagcccaactggtaccaatgcacatgatcctagcctgtgatccaatcaactggaaagtctctaagacagtttaagcctgtgatgtgtgtgattaaattttttttttttttttttttttggaaagggacttgggctttgtggcccaggttgaagcgcagtgggcaaccctggggataaattttaaaggcatattttccccattccatttacaaagagtagccgtgtggtctcttgtgctctcatgtgcaggcttctgagccccctcatacaattagcaccggtgtgtgaaacccaaggcatcgggtgtgtggagccaaaaagagcccattcgtgggggtgggaaaaaaagaggtcctcattcaatcagttccctacctaagctgggggacctcaatattcctctgtgcgctcttaagacccggggaagacaaatgaaccaccctatgggtgttcgccagaaacgcatctctggactggggggaa

SEQ ID NO: 519755 - DNA, 123 bp, Homo sapiens
aattcaaagcttctaaccgatgtacgcgggacatgtttctttaaaaggcattttgtgtgtttttaaaatcctgtacagcaagaagcaacttctttctgtcaaataaaaatgagaaatgcagga

SEQ ID NO: 519756 - DNA, 139 bp, Homo sapiens
cccgtgccctaggaggccgcagccctgttgccttcgaactccagtggtcagaccttcctcatatctcagcatttctacaggaccgacctatgccagaatgtgatggagtgcagcacatacacttgtcaccgagccacca

SEQ ID NO: 519757 - DNA, 203 bp, Homo sapiens
tcgttagtttgagaccagggtggccaacatggggaaaccctgtctctagtaaaattagtggggcatggtggcgcatgcctgtaatcccagctacttgggaggctgaggctggaggatcgcttgagtccaggagttctgggctgtagtgcgctatgccgatcgggtgtccgcactaagttcggcatcaatatggggacctcccg

SEQ ID NO: 519758 - DNA, 157 bp, Homo sapiens
  misc_feature (52)..(52): n is a, c, g, or t
  misc_feature (74)..(74): n is a, c, g, or t
  misc_feature (78)..(78): n is a, c, g, or t
  misc_feature (137)..(137): n is a, c, g, or t
accaccaaggtcttcttagttggggactactcctcgtcagccgaattctttntcaccgtggccgtgttttcctncctntactccatgggggctctggccacctacatctttctgcagaacaagtaccgcgagaatancaaagggccatgctggactt

SEQ ID NO: 519759 - DNA, 153 bp, Homo sapiens
acctcgcggtgctctggagtgtagtggtgcgatcggtcatgcaagctcgcctctgggttcgcgccattctcctgcctcagcctcctgagtagctggggctacaggcacccggacgtagaggcacccgcgagtagaaggcacccgcgagataga

SEQ ID NO: 519760 - DNA, 238 bp, Homo sapiens
ctagaggatcccatggagagagaggccaagtggagagcagaggccatccaggactccagagagtcaggtcaaccccgaggacccctgggcccggttcgggggtactccgttcggaccccctggtagagtctcgggagttcacacaggggggcaaacaccccctagagctcctctgccggaatcctgccccctaggcctttgaccactgtcagccagctgtgtcccgtgggcctctgct

SEQ ID NO: 519761 - DNA, 185 bp, Homo sapiens
gtggaacaggtaggtgctaaccttgagtccccacagttccacctggtttgggtctttcctctctaaccatgacatccgtgtcaccccgacagtaggctgccaatctagtgttttacacatccttcagacaccagtgagttccatggggttgtacctatcaagtctatgcactgcccatggccttg

SEQ ID NO: 519762 - DNA, 483 bp, Homo sapiens
gattctttctaaggttttcaaggttcacccacactgtaccaagtatcagtcctttatgccttttaatggctgagtgatgttcccttatatgaatatacacattttatttatccattcatcagttgatggatgtttgggttgtttctggttttttttttggctattgtgaacaatgctgctataaatacttgtgtacaccttttgtggatatatattgctaattctcttgggtaaatacctaacagtaaaactgctggtcataaggtaactgtatgtttaaccattttgagaactgccaagatatcttccaaaccagatgcatctttctacaattctaccaacaatatatgaatcttaactattcgactccaaaattcttcacaggaaggctccatgtgtgtcggacttacccttcaagactttcatttcatttaagtatccaacttgttacctgtcaaaaagcctatcatgagacctatgccc

SEQ ID NO: 519763 - DNA, 386 bp, Homo sapiens
  misc_feature (96)..(97): n is a, c, g, or t
ctcacccctctcttctcgtccatatgacacgaactctcctacatttcactacattatactgctcgtcgtcattactcaagccgtcacaaccagccnnttcactgtgcggcggctcacgcctgttatcccagcactttgagagggcgagatgggcggatcacaaggacaggagatggagaccatcctggctaacatggtgaaaccccgtctctactaaaaatacaaaaaaattagctggatgggggggggggcgcctgtaggcccagctattcaggaggctgaggcaggagaatggcgtgaacccgccaggcggagcttgcagtgagccgagattgtgccactgcactccagcctggacgacagagcgagactccgtctcatcaaac

SEQ ID NO: 519764 - DNA, 245 bp, Homo sapiens
  misc_feature (33)..(33): n is a, c, g, or t
  misc_feature (177)..(177): n is a, c, g, or t
  misc_feature (239)..(239): n is a, c, g, or t
  misc_feature (241)..(241): n is a, c, g, or t
  misc_feature (244)..(244): n is a, c, g, or t
ctagagtttcttgtcaactgtgctcgctgcaantccacttagctttggtgctgcctcctcctcatgccctggcaggtctgctcctgctactattccccacagtcaagaactgctttgaggctaggcaccgtgctcatgcctgtaatcccagcactttgggaggctgaggcgggtggntcacctgaggtcgagagtccgagaccagcctggacaacatggtaaaacaccatctctactanantang

SEQ ID NO: 519765 - DNA, 680 bp, Homo sapiens
cgagtgcacggtgggactcacactggagagaaaccctatgaatgtaggaatgtgggaaagccttcagatctacctcacaccttcgagtgcatggtaggactcatactggagagaaaccctatgaatgtaaggaatgtgggaaagccttcagatatgtgaagcaccttcaaatacatgaaaggacagaaaaagacagtaagaatgccctctggagaaagaccttataaatgtagtatatgtgagaaaggcttttatatctggccaagtgatattcaagaagatgacaaaagtcacactggcgagaaaccctatgaatgcaaccaatgtggtaaaggacttacagatgttagcaaatatgcgcattcgatatcatgaaaggactcacaatggagagaaagcactatgagtgtaagaaaagtgggaaagacttacagatactgaatcacacgcttcagaatggcatgaaaggactcacaactggagagaaacgctatgagtgtaagccaatgtgggaaagcgttcagattgtagaataaaaacttgcacaggcatggaaaggaagtgaacagaggaagagaagacgtaatgagatgtagaaaaggtggggaaaggaatatagaataatggataaaaaattagaagtgatgaaagggactcacaatggagagaaaacgtatgaa

SEQ ID NO: 519766 - DNA, 260 bp, Homo sapiens
ggcagcagatgagagtgagagaggcatgaaagtcatttgagagtcgagcccaaaagatgaagaaaaaatggaaattcaagagatccactaaagaggccagcacattcttaagatgccgacccgcaatattaagaaggtgcccgtaagcttgtcatcatttagagcgacctgacgtcagagagcggctgagctcttaaaaggcaaatgttccgagctttaggaggattaaactgttacgacacttgaggtcacttgaggct

SEQ ID NO: 519767 - DNA, 169 bp, Homo sapiens
caggcaaccgcccaatagggcgaactgacccgccagcgctcggccggcgcccgctggctttgatgcaacaccacgccgtccgctggcaaagggcacgtgggtggctttgccagtagctgcgccagtgcgccgcttcggtaaagtccttgatcgggtggctgtagcgcct

SEQ ID NO: 519768 - DNA, 167 bp, Homo sapiens
cggctagagcggctgggcatgatgctgatctttgccgggatccactcgaatactctctttgtttggtcctcagtgcatgttttcagatgatacatatataacgagtatgggaaccaattaactcctgttttcacagaaataataattccgaaagaccgctcttacca

SEQ ID NO: 519769 - DNA, 469 bp, Homo sapiens
tgcaggaatccagcaaaagagagatccaaaaactagaaaccagtcgaagacttgaggggggatcgagacgaggagaaatgtcagctcaagacagacttgcaggcactgagcagcgaaggcgagctgaagaaaacgccctcagcaaaaggcctgtggctctgagataatgcagaagaagcagcatcggagatagaactgaagcaggcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaaagaactgagtaaggtaagaaacaattatgatgaggagaacaattagcttaaaaaatcaggttgagaccgagatcaacatcaccaagaccaccatccaccagctcaccatgcagaaggaag

SEQ ID NO: 519770 - DNA, 398 bp, Homo sapiens
gacccttattacgaaatgtctccacccagcgagtatgcccgtcaggtccaggctgcagccgatcatccagcgcccgctgcgcgctgagacaggcccaactcaagcccaccagaaagaacgccacgggataggaccgaaaaggcaacagcatcaaggccagcacgagcattgccgacaacccggcgccaggcggcaacaccggtaaccaccgcaacgccagcaaccccagcgccaacgccaacatccctgtcttcatggatcatccttttccagtgatccactcagtcttagccggctgaacgacagcgcctatgatgttttgtcacaaagtctgaattttctgtttatagaatccgggcatacttgcccctcgaattgacctggaccccttatgcccc

SEQ ID NO: 519771 - DNA, 583 bp, Homo sapiens
tggcccggattacgccacgtgggcggcgttgccgttgagcttactctggcggctggccaaacaggatctcgccgcgcagcgactgcttgaggatgggggtggcgcggccaatgggcgttccgggttggacagcgggatgcctggcgtggccgagggggtgccagaggtgctttgggaggcgcttgcagaggcccccaggacggcgctctgggcaaaggtcaacgcaggcacagccagggccagagcggccgtgaccgacctgagacagcggggcatggtgtagatccaggggctgttgatcggagacgcgattctacggcaagggtgtccgccgatgtgggtaatatgcgggctgccgggtgcccgaaggaggtgccctgatccgggagaatcacatgggtttggtcgatttcatcaagaagcagttcatcgacgtcatcgagtggacggagtccaccgatggcgtgctggcctggcgttaccccttcgaggaccgcgaaatccagaacggtgcgaccctggtggtgcgtgaatcgcagatggccctgttcgtcaacgagggcaaggtggacgtggcgtctgt

SEQ ID NO: 519772 - DNA, 266 bp, Homo sapiens
atccaaagaattcggcacgagggaaggagggggaaattaatagttgttgaatgggtatagaattttccaagataaaaaaaaaatctagaaatctgcttcaaagcaccctaaatattcttaactttccaaaacttttttcccacaacttgttacggtggtaaaatttaagggatgttttttttacggaaattctaaaattataaatatatttattaagacggaactctctttcgacacaggtcttggtctctgtgtccccgcgcacg

SEQ ID NO: 519773 - DNA, 959 bp, Homo sapiens
  misc_feature (444)..(444): n is a, c, g, or t
  misc_feature (676)..(676): n is a, c, g, or t
  misc_feature (684)..(684): n is a, c, g, or t
caagatgtaagtcctgtgacatggaatcttctcttcgatcaaagtgccccaaagacagaagcacggaagtatacatcacaagaacatttgagctcactaccctaggtgatacataaacgatatacaagaagttagataaattcatgctgacttgaagcttaaattgtggtcgtggtgaaatgtggtcgacaaatagagatagtagttgtattagatgagagagttaaatgattatgaatttagagagtgtttgggggactcggtgctcgattcctaagaagagtgttaattgtaagtaagtatagtacgcgaacagcatggctttgctctgaacgctgtttccttggaacacaggtgacttgaagaatgtcgaagatgtatcgattaaattctctaagaatgtgtcgtgttcatagatcacagctggttatcgagaatcatacnttaatgtacggtgaagtattttaccactgaaggtaattgaactttcctaaatatgttactctgagtaaggatacacactaagtcgtgcttatcagaggagtaagtgggatctgccttgacctctgatagttagatgctaatctggagttttgaacaataagctacagggaagaaaatcctttggattcgtgcatagagaagatcttgagccgaggtttacttgcgtaccatntcgagtangaggtgcgcccctttggtagaatgtgtatgccatagcatctcagagaaaagtggcctgtcgagacttcttggtgtgaattgatccccagagattttgttggataccgctgcgtccagcacaaggtgtttataacgtgtcagacaaaaggagagaaccttcacactgtctcatgattgtgataatggggaataccattgtgctcatcccctactagggcaaaatcctaattattagcaaagggtttctgaccgtgacttatggttcgcgcttgtaa

SEQ ID NO: 519774 - DNA, 854 bp, Homo sapiens
cggcctttccggcttggcccgattttgtttctgcccacctgggtattaacctgcttcttacttcgaccttgttcgctttggcgaccgacgggcttcttcccccggtgacgcgcagcccccagccgccagacacatgcccccagccaagcaccccaatcaggctacccctggaggggatgcccaccctgtcttccgcctgtgccgccatgatgggcctcctcaccgcgcctggagccgcctgagggcctggacctctagaccctggctggtggaaccacgtaaaaggacccagctctggtagaactgccctggagggagaagctaggactcctctgcccatccccccataccccttggggccagaccgccctgaagaggaggctgaagaccagtggaggccctggagaggacagagaaacactggggcgtgaaaacccgccgttcccttcctgaagcctggggacttttggatgatgatgatggcatgtatggtgagcgagaggccacccgtgtccctagaggcccgggaagtccatttgcagatggcccgcgtgctcccctgtctccccgccttctgataaggaccactgccaggttctgataagaaccccggggaggagaaagccgaggaagagggagttgctgaagaggagggagttaaccagttctcttatccaccatcaccccgggagtgttgtcccccgctggaggaggaggacgatgaagaagctgtaaagaaagaagctcacagaacctctacttctgccttgtctcccggatcccagccccgcccttgggtgtcttgccccggggaggaaagagaatccagccccggagaataaaaaaagaaaaaa

SEQ ID NO: 519775 - DNA, 113 bp, Homo sapiens
  misc_feature (7)..(7): n is a, c, g, or t
  misc_feature (74)..(74): n is a, c, g, or t
  misc_feature (92)..(92): n is a, c, g, or t
gttacgntctccaagactcagcttggtgatctgagcgcatgtccgcgcggtcaagacgcaggtctctttgaggnccatgtaatccttgcgtngtaggcgtactggtggtaccg

SEQ ID NO: 519776 - DNA, 434 bp, Homo sapiens
  misc_feature (14)..(14): n is a, c, g, or t
  misc_feature (59)..(59): n is a, c, g, or t
  misc_feature (77)..(77): n is a, c, g, or t
  misc_feature (127)..(127): n is a, c, g, or t
  misc_feature (164)..(164): n is a, c, g, or t
  misc_feature (191)..(191): n is a, c, g, or t
  misc_feature (223)..(223): n is a, c, g, or t
aattacccccaagntggggaattaacccccaaattgacccatcgaccggattaaattgnaccaaaaccaaatgtggnccttatccccataccagtgggaactggcccataaaaggaataaaatgccnaataccatgcctataacatggatggacccttgaaaancatgatggtaagtgaaagaagcccagntcacaaagggcccacatatatcattcccattncacatcaagtttcccagaacagagaattcctatacagtcagaaagtaaattagtagttgcttggtcgtgggggatgggaagacagggtagtagttaaagggtacaggatttctttttgaggtgatgaacatgttctaaaatttgctgtggagatggttgcataaatctgtaaacatattaaaagtcattaaattgtacacttgaaatggga

SEQ ID NO: 519777 - DNA, 167 bp, Homo sapiens
tctggggcaggcagtgggcgctttggtatggtcatcgacactcgtggagggccggtcacgcagatcacacgtgcaccaaggtctctggttttcctcgtgcagccgaccctgcgagcttcctgcagtgttatgtgtccctgggatacttgcgcttagggcgtggtgat

SEQ ID NO: 519778 - DNA, 202 bp, Homo sapiens
attcatctcgtttagatattgtacgagcacattcacagtcacctcttcagagatcactgtcagctaagtgtgtatctgaccaggacaggtatccccttgtcgactaagacggatcaccagcagaagatgatgaggatacgagttagatgtacagagaagaccttttcttaggtacactacacatttccttttcatcataaat

SEQ ID NO: 519779 - DNA, 758 bp, Homo sapiens
ggagctgtaaaacatcatcaggtgtgctatatgttatatgattacttctgttgactctgtgatatatatgtccagttgtctgtatcttgcgctggttgagccctgaaccaggagctaacagggtcgagcttctggaggttggttggaacagtacggaagtgctcgaaatgacatccagagaaatctaaactgctgtgggttccgaagtgttaacccaaatgacaacctgtctggggtagctgtgttaagaagtgaccagctcgtgctcgccatgtgcgtccaatcataggcagaatatgctggagaggttcggagattagtggtggcattggactgtccttcagtgttgtacagagatcctgggtgtttggttgacctacagatacaggaaccagagagaccccgcggcgaatcctagtgcattcctgttgaggagaaaacaaggaagatttcctttcgtattcatgatcttgtgcactttctgtcatatttctgtgaagctccattgtgccagtttagaggaaggaaacactatgtggagaagtaccttattgatagtggaattcatatatttcactctatgtgactctacatgttcgtggactttcctgttgcttgaaacaaatatttggcaaactttgtgggcctctgaatgcgtcgggggggaccctggatttcacctgtacttcattggtcgggccactgtccacgtgtggcttcttaaggcatttacacctgcagaaaacttgtatggacac

SEQ ID NO: 519780 - DNA, 1022 bp, Homo sapiens
gctagtcaatgtaatgtgacacaaaccttcttgactaggtgtaattctataccatatgtaaccaatgctggcgttgctgtgtcgcgacaagtatgtatggcaaatctctaagtaatgctcagatagaaaaggttatacatgtgatctcaattgatagggaccaggatctgaaatagcggagaagagttcctatagatcgtatggttgcgtgcacgcatatcatgactcgcaaatgtagactctcacaacacctggcctgatattgtctaacttgcctgctacgcatctgtcatggaagagaggtctatgactgtatgcaatatcgtaatcccagatgtgcagtacaatccatgtgtcgtgaagatgttcatgtcggatcacagagaatgaaattaaatgggtacggccattggacatgaatagccacactgctgacatggtcacatgatgtcgtaataggctggtgggaaatatctagctgcaaatgaagcagagagcgaaaagtcggttgcatgccattgtggggatgccacaaaagaggttgctggaccatattcggggattctgtcccacaaaagaacttctaacgagaaggggggaggacttgtctgcatggatctggggctgcagtggataatggacgggatcgcgaaggcctacgaaggatgatgaatgatgcagcggcgaggaagtgaggcatactgacgtttgtgtaggtcaaatgcacagcggaagtcagagttacttatatccccaatgtggctcaccaccataagtgctgatcaactcacggctgaccaaagcgtcaggacgcagacgcaggctgccttttaggacatcaataaggtgcgaattcatcaccccattaattgctcccaaacgcgcggactttcccacttattttagccactctggcgtttgacacggcctacaccagtgggacggcacccgcttccagacacagggatggctctcctcaaaagaaaactgctctgcacaggcactcacactggcgctcaaac

SEQ ID NO: 519781 - DNA, 952 bp, Homo sapiens
  misc_feature (941)..(941): n is a, c, g, or t
  misc_feature (952)..(952): n is a, c, g, or t
taggagccctgtgtgatcgtgcgtcagagtcggggctgagaccagccctggcaggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcgggtgagtctccccaaaagtggcgcccttgtgatgtcgaggacaggtctccctgtgtgcccgtgggctgctgtctcaccggtggctcgtagtcgcggagaccagaacccggcagcttcaggggctgcctgggggtgggtgttccctgctgtatgtctgtgtccattatgggtgtgtgtgtgtgtgtgtgtgtgtgtgtctgtgtgtctgcgtgtgtgtgcgcgcgcgcgcgcgcgcgtgggtgcgtgtctgtgtgcccactagcgtctcgtctcttaagtctctctctctctctctctctctctctctctctctctctctcgtctctctctctctctctccgttctcgctcttgtgcggcgccgcgctttgtgtctgtgcgcgtgtgtgtgtgcgtggcggcggagagacatatgttcacgtgagcgcgggagggtgtttacgcgcgcgtcggccttatgggggtacacctcccgtgttggtctgctgtgttgtggtgtcgggcgggaggcaacttattacagggcgggcaccgggattaggtagttgaaagcgctgacaaggtggtataaggacgcacccggggggtatgaatcaccacgagaggaaacggttttgaaggtaggacaagcggtcacaaaagaaggtcggggttatgcaccgaggggccgacaagatgtagctggcgtcgcatgaaacagcgggaaagagggggggcctcagaccacattggccggggggattccngggatgcagan

SEQ ID NO: 519782 - DNA, 1519 bp, Homo sapiens
gattccggcggggtctatctctatgcgttgttcatcaagtcgtctgggcacgcgtacacgacgagtactgcgcgccgccaattcgtctctgctcaatgcgtctgtagcaacaggccccttcacgaatgttactgtactaacgagtcgtcaaacgccatccagtgcgaaccaatgtctttcgtgccatactcctgtgttttggcgaccctgtgcagcaacgcgttatccgattggatctagctttccgttctttggctcgaaaccgagaactactagtagactcaccagaatcactgtcagtaacaattgttcacacccagcacagtagctagggtgcagtgcggccaatcacggcttagagatctgatttgtggttagcacttggcacgggctcgcctattaccaatacactcttcatctgcgtagccttctattgtcgacctgcgcaatggattgtgggctctgggaacgtcgctcagaccatgtatctgtgccaaagcaactttgtgcccgatggagcatatgccggctgatgcgcctactgagcgatcgtcgctgaatgagtgcgaaaccatgcaaggctgtgcgctggtacgacgcatactctttcccaaggaactgtactgagaattcccagacatgggaggatgaaaggtgaggggtatacagcaggcgcagaccgctctgagagaggacttgctccggtggtacctgttgagaacaacaagcttgtaaatccatccgtctgttatttggcaatcttccagttgcccctagcgtgctttctcgaccctgttatgaggagccccccgcagtctttcgttgtagaacctctctcttggggaagacattctctttgtgtccataagaattcgacttgaacaccgttggaatagcttatcattccaaagaatatgagtggcgttttgaagccaacacgtggaggctagagtccgtcccactacaggagtgcgttgccgattggagattcccggcattgcgacatggggcagcgtgagggacagcaccgcttatgttgataccttatccgaaaagaacgggcattcaacaattccaatcaccaacgacaagcaagaaggatatagaaaaaacggcacgtaatcctggtatgaccttgacgtgggagctataccgttcgctcatgggggcaccccccttctcgagataccggctacacaatacacgagggcctttgaataggtccttctaacggttcctctttcaccagttccatagggcccattggttaagaagccaccgcccttcttgcaatatgaaagctttagaatagcgtaagagcaataagcgcgtatggcgagcccacacattttgggtcaaatttgtataacacggcttttattaggaataggctaacacacaatatgtagactttcaaaaccacaaaattcaagcaaagggaccatcaaattagaacagagcgttgcgagagagagaccacagagcggttttagacggaataatcgtggacgaccatttg

SEQ ID NO: 519783 - DNA, 1286 bp, Homo sapiens
gtccctctcagccctcctaatgacctccggcgctaggccatgtgatttcacttccacgtccaataacgcgtcctcagtactaggcgctactaacgcaacacactagagccatataccaatgagtggcgcgaatgtaacgacgagaaagcacataccaaggtccagcacacaccacctgttccaaaaaggccattcgatacgggataagtcctatttattgaccgtcagaagttttggtatcttcggcaggatttttctgagaccttttaccacgtccagacctagccgcctaacccgccgaattaggaggaacactggaaccacgcaacaggcatcaacccgctaaatcccctagaagtcccactcctaaacacatccgtattactcgcatcacggagtcatcaatcagctgacgctcaccatagtctacatagaaaacaaccgaaacgaagataattcaagcactggttattaccaagttcactgggtctctatctttaccctcctacaagcctcagagtacttcgagtctcccttcaccatgttccgacgggcatctaacgggtcaacatccacgtagccacaggcataccacggacctccacgtcatactatggctcaaagtgtcctcactatctgcttcatccgccaactaatatacacgtttacatccaaacatcactttgggcttccaaggccagccgcctgaatactgggcactaagcgcacacatgtgcgtcggacaactcctcgccatgatcatcactctatcgactcgaggggctaccagcacacacgaccacaaaacacacagaagcacaaacccaacagcaccaccaccacacacccacgacgcgaccacaagagacacaacaagacaacaaggaagcaaagaacagcaaacagcccgccgcatgccacaacagagaccaacacagagcagacacataaacacaacaacgcaggcacaagcatacagaccacagacgaggcggaggaaacacgaacaccgaccggagcactcgagagcacacacaaaaactcagcgagagcagaaatgagcacaccgcacaccagcagaagacgcacgcggagaacaccacacacagacgcggacagatcagaccacccagccaacgcgcgagcagcgaagagcatggcacagaataccagccgagaaagaagaaacaagaacgagagcgaagacagcgaagccaacgaagaccgaaatcgagacgagaccacagcaaggaagcgcacagagcaagacaagaacagcacgccaa

SEQ ID NO: 519784 - DNA, 917 bp, Homo sapiens
cggaacagcttccgcgttcctactgtgtgccccctacttttagaaccccggtccgtaaacacgcccgatgtaactttaggtaagcggcacgtgtttggaccgcgggccgacttgtttgcccacgtggacgaacgaaaggtgccgccttctgtgaaacaccgggtccaaattctgggaaacgcggcacccacaccggtccgccgcgagcaaatgtgcggcccccccctttcttctgggggccccgcgctcatcctttattgcgcgcgtgtacggtgttattctcgtagtgcccgcgattccactctgcgcccagggggccacgatattactgttggcctgaacagtgaggtccaacaaaaccgggggatcagtctccctcctgcagccccatgggggtcctcgccaaacagtgtcgcagattttggtggtacgaccacccctgctagaaccttttctggtaagattagggggagcccgcctgtctttgccaccaccggccagattacaatgacagtggtgcgcttgcagtgttgcgcacctggtctcgcccaaccaggaggttctgtctccctccgcacaagcctcgcgcggtttggattttcctgccccacttcgcacctgattactacccccataaaatttgtaggattttaagaaccccactgtagaatttaaactcctcttccaagtcttttcttcacaaagttagtgttctcccagaaatcttttccaatgaactaacaactcctttgtttctctcctcttcgccaaatcttctttgccccccggcgctgaatgctgtcgcggatatgctaaccattctttacatctctgatcccattatacacgcgtccgctaaccccatcgttttcattcgcccaggcgtcaaaaaaatcaccaatttttttaacaaaaca

SEQ ID NO: 519785 - DNA, 567 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (422)..(422): n is a, c, g, or t
ccaattngncntattccagacatctgccctatacaactcctttcccctggcaaccacctccctagggaacagttagacacagcctacttgacttgcctcactgacccccacaccccatgtggactgcacagatgtgcaccagtgaccacttctcagtcacagcacaactccatggaattcgtgtctgcttgctctgaactcaccagttagaactcccccagggaaacctgcttagataatgctctggaccccaataaaggctttgacccacaggtttttctcccttccttgctctctgcccactgagtgagcacatatgtccctgaaggttcctctgttctgctggtcctgcaaaacgtgctgccctcctttctctgggatctgtaagtaataaactgcttctggtatttcatgtgttttgnggagttgcctcctctgtgtctctcctgaccaacacacgtgaacctaacttctttccaaatcatggttctcctatagaatggctatcttggcaggagtaaactggacacagtccagataaaagccacaagggcatctgatagtata

SEQ ID NO: 519786 - DNA, 757 bp, Homo sapiens
ggccgcggcggagcacccagcccggcggagaaggagctcgcccggcgctggggactgggacctggagccccttcccctaccgcacgtacgccccgcccgcgcagcccgccgccgccggcctgggcagttcatccggatggttcctgtcctcccgcggtccgagggcgctggaaacccagcggcggctgaagcggagaggagccccgccgcgtctccgccgcacggtccaggtctggggtctgctgctggagccgcgcggggagaggccgtctctgcgacggccggcccctgtcccgacctgtccgggtccgcggcagcccggccacagccatgggctctggcccgctctcgctgcccctggcgctgtctgccgcgggctgctgctgctcgctgctgtctctgctgacagtggccagtggcctcagaggcttgagcaccgtctattttgagcggctgttttgaagattacaatgagatcatccggctgtagccaacgtgtctgaccagtcatcatccatttctgaggttgtccatgtctcagctggtgaaggtggatgaagtaaaacagatcatggagaccaactgtgggtcaagcaatctggaatgactacaagctgaagtggacccctctgaatatggtgcggagagttcatggtgtcacatgcacagaagatttggaagcagacatgtgttgtataaaatgttgttggaattcaggtggacgaaagacaagataatcaatacatgggaattttta

SEQ ID NO: 519787 - DNA, 149 bp, Homo sapiens
cccatggcgcttgtaggtcacgggtcttcacgaagatctagcataccacctctcagacgcaggaccaaggtgcaggggtcgactcccttctggatgttgtagtcagaaagagtacgggccatcttccagctggcttgcctgcaaaagga

SEQ ID NO: 519788 - DNA, 245 bp, Homo sapiens
cttgcggtctcataacggatatgtaaatctgtcgaaatgcaccatgaagctttgagtgaatgctcttcctgtgggacaattgtagggctatcaatgtcacagaatgtgtctgtcaagggatgttctgtcgtggcaagtttgcatggtgacagcaaaaaatgacccaccatatggaagcagctggctatcacatgcatcaggtgaattatccttgaaccatccatggccaaatacagcgccggata

SEQ ID NO: 519789 - DNA, 174 bp, Homo sapiens
ggtggtgatgaggaagtttaggtagatggactagaggataattactatgattagcatttagagaaattaaaaactgccatttattccacagccaagggacataatgaaaccaaggaatatgaccgccttgctatagcctttgtcttgagaagattcatttcttcattcctcatt

SEQ ID NO: 519790 - DNA, 378 bp, Homo sapiens
  misc_feature (82)..(82): n is a, c, g, or t
  misc_feature (101)..(101): n is a, c, g, or t
tgctgaggtgcctagagttcccattagttatttgcatgttgtcactgcatatgtatgaaaatagaaaaaaaaacatgctttngtaaaaacccctaagattngtatatgttcatttttagggcttctgaaaggggagagaaattcatattgggaaaccagtgttggtgttctgaaatctgcttgtaaaactctcatctcattttacattgatattaaaacattttaacagtgttggctagctgattacttgattaattatactcccatggccccataggaagctgttgtgggcctctgttcaaaagcacagaaaagagcagaaggaaatgtcttagaaagaatcaaagctgatgaaatcagcaaagattgggggaaagg

SEQ ID NO: 519791 - DNA, 298 bp, Homo sapiens
acgagacagatgtaggaagcggcgcaagtcaacacggagaagcgggaggtgcaggcggacaggacgcagaggctgctgtagcttgcgtccccttggagctgggcgacaagactgttttattgcaggtgcgttctcttgagagcgtggtgggggccatctttcctcttcccaacctttagcttagccagcattgttctgaaccaaattgaaagtcttaaggggcatagaggggaaagaaaaaaaaagagaaccagcacatttacaaagcgaacatacccacattcattcctaggacggg

SEQ ID NO: 519792 - DNA, 825 bp, Homo sapiens
gcctcccaaggtgctgggattacaggtgtgagccaccacccctggccagaaaaaaaagcttttaaataaagtaattgtcagcttgggcaacgtggcaagaccctgtctctacaaaaaaaaaatttaagttagccgggcatggtggcactgacctataatcctagctactctggaggctgaggcgagagtatcacttgagcccaggagctcaaggctgatcatgccaccatactccagcctggatgatagagtagaccctactttttttttttttcttttaaaaaagggtgacccatccaggggcaatgaacaagaactggcgtccgtattcccaattgcataatcccttatccctgacaggatatgtaacggcagacatttatacggcacaggatcttgggtcgaccgcactgtgggacctcatagcgacgttgtccgacttatgggcccacaaatcctgtgttgcctcccagtccaactcgaactcttctcaacgcgtggttgggttcaaacgcttccttttttcacgcctctgtcgcccctctcggggacattctcggacgcgctccatgcgctaactactctccctcggtctctggcgacaccttcgtactcttcacccccccggggagaacctcctcccgctttccaacgtggctttcatcacgcggggcggtaataaagcggctcctgaagcgccatccccccgttgctgtggcccccaggctcccggcgcgctcccccaacatcgcaccccctgtgcgcctccctcctgtcgcccccccgagcggtctggccggtcgggctctcaccggcgcccccttc

SEQ ID NO: 519793 - DNA, 164 bp, Homo sapiens
cctagcgcggtacccctcatcgtgcgcgccttcgaacgcgccattccatctgcctcagatcgttacgaaagttcttacatgacctcaactgctactgccgctgtcaagttcagaccggaccgtcggttctgggttgtctacttctgtctcatgatggtgatgtt

SEQ ID NO: 519794 - DNA, 106 bp, Homo sapiens
agaggattcgctctacctcgccagtgggaggagaaggagtcctcatgtcaagttccaggaggcaggaaactggtggagagactcggcctggagaagctcgatctga

SEQ ID NO: 519795 - DNA, 348 bp, Homo sapiens
  misc_feature (8)..(8): n is a, c, g, or t
  misc_feature (74)..(74): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (100)..(101): n is a, c, g, or t
  misc_feature (105)..(105): n is a, c, g, or t
  misc_feature (108)..(108): n is a, c, g, or t
  misc_feature (112)..(112): n is a, c, g, or t
  misc_feature (127)..(127): n is a, c, g, or t
  misc_feature (131)..(131): n is a, c, g, or t
  misc_feature (135)..(135): n is a, c, g, or t
  misc_feature (142)..(142): n is a, c, g, or t
  misc_feature (158)..(158): n is a, c, g, or t
  misc_feature (166)..(166): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (221)..(221): n is a, c, g, or t
  misc_feature (228)..(230): n is a, c, g, or t
  misc_feature (238)..(238): n is a, c, g, or t
  misc_feature (247)..(247): n is a, c, g, or t
  misc_feature (261)..(261): n is a, c, g, or t
  misc_feature (263)..(263): n is a, c, g, or t
  misc_feature (267)..(267): n is a, c, g, or t
  misc_feature (272)..(272): n is a, c, g, or t
  misc_feature (280)..(280): n is a, c, g, or t
  misc_feature (299)..(299): n is a, c, g, or t
  misc_feature (302)..(302): n is a, c, g, or t
  misc_feature (339)..(339): n is a, c, g, or t
gggggganagatcacacacacatacacacacacacacacgcacacacacgcacacatgttgcagctcatgtcantttatgtacaaaatanggtntngagnnaggngcngggntgggggggggttgtnagtngggngcactantgtcacagtgtcaganaacttganatgctcactcacactcagcctgggcccatgtnancnccttccccacccaggggtngggggtnnnggtgggtngtgggggtntggggtgtgagggngntggnataanggggtgangagagtagtcccttctctnggngggggcccctttccaagtttactcaggccaagggtgntgggacaca

SEQ ID NO: 519796 - DNA, 1207 bp, Homo sapiens
  misc_feature (8)..(8): n is a, c, g, or t
  misc_feature (80)..(80): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (133)..(134): n is a, c, g, or t
  misc_feature (153)..(153): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (383)..(384): n is a, c, g, or t
  misc_feature (404)..(404): n is a, c, g, or t
  misc_feature (410)..(411): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (429)..(429): n is a, c, g, or t
  misc_feature (478)..(478): n is a, c, g, or t
  misc_feature (514)..(514): n is a, c, g, or t
  misc_feature (520)..(521): n is a, c, g, or t
  misc_feature (530)..(530): n is a, c, g, or t
  misc_feature (534)..(534): n is a, c, g, or t
  misc_feature (538)..(538): n is a, c, g, or t
  misc_feature (542)..(542): n is a, c, g, or t
  misc_feature (547)..(547): n is a, c, g, or t
  misc_feature (587)..(587): n is a, c, g, or t
  misc_feature (602)..(602): n is a, c, g, or t
  misc_feature (604)..(604): n is a, c, g, or t
  misc_feature (627)..(627): n is a, c, g, or t
  misc_feature (644)..(644): n is a, c, g, or t
  misc_feature (662)..(662): n is a, c, g, or t
ggggtgtngcgcatgcctgtaatcctgtctactcaggaggctgaggcaggagaattgcctgaacccgggaggcagaggtngcagtgagctgagatcgtgccattgcactccagcctgngcancaagagcnaanntcagtctcaaaaaacaaancaaaaaacctgtngntatagtacgaaagaaacgtcttgcagttttctgttgcagagaattaattagaaccaacntgttggattatacacattcacctttcagaatccttttcttctctgtggaaacccacactctcagcngtntntgggaacacagtagattcttaaggaatgcttgttgaatgttgcagtctgcatcttcttgaagtaacagacctgctggtacgctcnntaaaagtaaaatgtgtctanagaccnnttgnaanccnagatgtangagattaatgcaccaaagcactctcctaattacttaaaatgaattattncaaagaatctttaattgaattttctgtgaagtctgnaatttnnaaattatgncccnttgntcanaccancccctgaaaagaacaattaaggcaattaagatagcattanagtttcaatgaagtngncattttctgtgtattaagattanatgttagctgctgaagnttgtggaggtcggacatnaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataattta

SEQ ID NO: 519797 - DNA, 626 bp, Homo sapiens
  misc_feature (238)..(238): n is a, c, g, or t
  misc_feature (282)..(282): n is a, c, g, or t
  misc_feature (307)..(307): n is a, c, g, or t
  misc_feature (420)..(420): n is a, c, g, or t
  misc_feature (428)..(428): n is a, c, g, or t
  misc_feature (448)..(448): n is a, c, g, or t
  misc_feature (450)..(450): n is a, c, g, or t
ctgagcgtcggctcgtcgagccccggcggtgaagcgggcggtggtggagtgatgcggagcctcctgcgtggtgctgtggctggcgacgcgcggaagctgcgcgtctagtttcacatcggagagacggaaagacgtgctttatgaggagatcccgagaacgagaccattggtcattagcctgtttcccaagagcgtgtatagcaggagataccagcgcacccggggcttgccatgtttntggaggtgaaggacccagaggacaaggtcatcctggcccggcantatggctccgagggcaggttcactntcacttcccatacccctggtgagcaccagatctgtcttcactccaattccacccaagttctccctctttgctgtaggcatgctgagagttcacctggacatccaggtaggtgnacatgccnatgactatgcagaaatgctncnaaagacaagttgagtgagttgcaagctacagaagtgcgacagctggtggcaacaagtggcgcagatccaagaaagagcagaactcacccagcggtggcgaaggagcgcttccggagaccagtgagagccccaaccagcgggtgctgtggtgggtcccattctggcaagaccctcat

SEQ ID NO: 519798 - DNA, 293 bp, Homo sapiens
aagcgactctatctcctgcgttcaagcaattcccctggctcacctcctgtagtagctgggagatacaggcatgcaccaccatgcccagctaatattatgtattttacgtagagacgaggtttcaccatgttggccaggctagtctcaaactcctgacctcaagtgatctacccgactcagactcccaaaatgctgggattacaggcatgagccaccatgcttggctatagaaataattttataacagctttattgagatataattcacatatcatacaaatatgcaattcaat

SEQ ID NO: 519799 - DNA, 2063 bp, Homo sapiens
  misc_feature (8)..(8): n is a, c, g, or t
  misc_feature (80)..(80): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (133)..(134): n is a, c, g, or t
  misc_feature (153)..(153): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (383)..(384): n is a, c, g, or t
  misc_feature (404)..(404): n is a, c, g, or t
  misc_feature (410)..(411): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (429)..(429): n is a, c, g, or t
  misc_feature (478)..(478): n is a, c, g, or t
  misc_feature (514)..(514): n is a, c, g, or t
  misc_feature (520)..(521): n is a, c, g, or t
  misc_feature (530)..(530): n is a, c, g, or t
  misc_feature (534)..(534): n is a, c, g, or t
  misc_feature (538)..(538): n is a, c, g, or t
  misc_feature (542)..(542): n is a, c, g, or t
  misc_feature (547)..(547): n is a, c, g, or t
  misc_feature (587)..(587): n is a, c, g, or t
  misc_feature (602)..(602): n is a, c, g, or t
  misc_feature (604)..(604): n is a, c, g, or t
  misc_feature (627)..(627): n is a, c, g, or t
  misc_feature (644)..(644): n is a, c, g, or t
  misc_feature (662)..(662): n is a, c, g, or t
  misc_feature (2063)..(2063): n is a, c, g, or t
ggggtgtngcgcatgcctgtaatcctgtctactcaggaggctgaggcaggagaattgcctgaacccgggaggcagaggtngcagtgagctgagatcgtgccattgcactccagcctgngcancaagagcnaanntcagtctcaaaaaacaaancaaaaaacctgtngntatagtacgaaagaaacgtcttgcagttttctgttgcagagaattaattagaaccaacntgttggattatacacattcacctttcagaatccttttcttctctgtggaaacccacactctcagcngtntntgggaacacagtagattcttaaggaatgcttgttgaatgttgcagtctgcatcttcttgaagtaacagacctgctggtacgctcnntaaaagtaaaatgtgtctanagaccnnttgnaanccnagatgtangagattaatgcaccaaagcactctcctaattacttaaaatgaattattncaaagaatctttaattgaattttctgtgaagtctgnaatttnnaaattatgncccnttgntcanaccancccctgaaaagaacaattaaggcaattaagatagcattanagtttcaatgaagtngncattttctgtgtattaagattanatgttagctgctgaagnttgtggaggtcggacatnaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccaggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagttgttttagctccagtggggagtttcctttttcaaagtatgatgaaaccatcctcatcttttctacccctgggactaatcatttaacacatggttccagacactttaaaactggtgagttatcttgtggttaagcaatttaaagacttctctgtctaatcatgctacttgtcctggttttgtcattgatactctcatagcccttttgaan

SEQ ID NO: 519800 - DNA, 560 bp, Homo sapiens
  misc_feature (238)..(238): n is a, c, g, or t
  misc_feature (282)..(282): n is a, c, g, or t
  misc_feature (307)..(307): n is a, c, g, or t
  misc_feature (354)..(354): n is a, c, g, or t
  misc_feature (362)..(362): n is a, c, g, or t
  misc_feature (382)..(382): n is a, c, g, or t
  misc_feature (384)..(384): n is a, c, g, or t
ctgagcgtcggctcgtcgagccccggcggtgaagcgggcggtggtggagtgatgcggagcctcctgcgtggtgctgtggctggcgacgcgcggaagctgcgcgtctagtttcacatcggagagacggaaagacgtgctttatgaggagatcccgagaacgagaccattggtcattagcctgtttcccaagagcgtgtatagcaggagataccagcgcacccggggcttgccatgtttntggaggtgaaggacccagaggacaaggtcatcctggcccggcantatggctccgagggcaggttcactntcacttcccatacccctgagagttcacctggacatccaggtaggtgnacatgccnatgactatgcagaaatgctncnaaagacaagttgagtgagttgcaagctacagaagtgcgacagctggtggcaacaagtggcgcagatccaagaaagagcagaactcacccagcggtggcgaaggagcgcttccggagaccagtgagagccccaaccagcgggtgctgtggtgggtcccattctggcaagaccctcat

SEQ ID NO: 519801 - DNA, 759 bp, Homo sapiens
ggatgctctcagctatcgtggcacggtctaggttatctctgtagcatagtcactgcggatttcactctacccggaaagtgtgcctgattgtgtggatcatctcagcctcaggaagcttccttcaaaatgtctcactgtcgcaagacacatcctgtgctaacgctcaagtttgcgtaggcgtgatcgagctctcagacactcccgaaggtgtcgaatagtgtgggtcttgctcgaagatgctctagtacatacactttgaattgctcgatacgtggagttcatttgaagcattgaatccaggcaatcataacccaaaggtgtggatgaggtcagcagttgtcgaacatatcgacgcaagcgcaggaaatgcatagagacaggatattgcctttcggctaccaagagaaggaccataataggcaacttgcatcagcagctgatgtcagatcttatctgggcacctggagacggtgattgggtggcctattgatagacacctggtcagtatcgacgcttcgtgagctaaaaagcttccatgaaggggctgggacccgacgatgactctctcattgagatcatctgctccagaaacaagcaggagctgcgcggaagcttaaccgagtctccaaggaaaatgtcaacgacttgatctggagcaaggacattatttcggacagcctctggtgacttccgcagctgatggtttgcccctggcacaaggtagcaagagcagaagaatggtctcgtccttgattatga

SEQ ID NO: 519802 - DNA, 346 bp, Homo sapiens
  misc_feature (49)..(49): n is a, c, g, or t
cttacaggactcctcccctctggcctcgggcttctactctctttttcgnaggagctatgggtgcctagctccttcccctgcctgctcctggaacaaggaagatagcgtactttcttttttgcttgttgttttctggagacacattctccctctgtcgcccaggcagaaatgcagtggcagcgatcctctcaccccggcctcctgaatagttgggacctcaggtgcacaccattacacccaggtaacgtccttttcttttgtagagactgtgttgtccaggctggtctcaaatgcctggcctcaagcaattctccgtctcagcctcccaaaaccctgggattacagg

SEQ ID NO: 519803 - DNA, 1148 bp, Homo sapiens
  misc_feature (8)..(8): n is a, c, g, or t
  misc_feature (80)..(80): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (133)..(134): n is a, c, g, or t
  misc_feature (153)..(153): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (383)..(384): n is a, c, g, or t
  misc_feature (404)..(404): n is a, c, g, or t
  misc_feature (410)..(411): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (429)..(429): n is a, c, g, or t
  misc_feature (478)..(478): n is a, c, g, or t
  misc_feature (514)..(514): n is a, c, g, or t
  misc_feature (520)..(521): n is a, c, g, or t
  misc_feature (530)..(530): n is a, c, g, or t
  misc_feature (534)..(534): n is a, c, g, or t
  misc_feature (538)..(538): n is a, c, g, or t
  misc_feature (542)..(542): n is a, c, g, or t
  misc_feature (547)..(547): n is a, c, g, or t
  misc_feature (587)..(587): n is a, c, g, or t
  misc_feature (602)..(602): n is a, c, g, or t
  misc_feature (604)..(604): n is a, c, g, or t
  misc_feature (627)..(627): n is a, c, g, or t
  misc_feature (644)..(644): n is a, c, g, or t
  misc_feature (662)..(662): n is a, c, g, or t
ggggtgtngcgcatgcctgtaatcctgtctactcaggaggctgaggcaggagaattgcctgaacccgggaggcagaggtngcagtgagctgagatcgtgccattgcactccagcctgngcancaagagcnaanntcagtctcaaaaaacaaancaaaaaacctgtngntatagtacgaaagaaacgtcttgcagttttctgttgcagagaattaattagaaccaacntgttggattatacacattcacctttcagaatccttttcttctctgtggaaacccacactctcagcngtntntgggaacacagtagattcttaaggaatgcttgttgaatgttgcagtctgcatcttcttgaagtaacagacctgctggtacgctcnntaaaagtaaaatgtgtctanagaccnnttgnaanccnagatgtangagattaatgcaccaaagcactctcctaattacttaaaatgaattattncaaagaatctttaattgaattttctgtgaagtctgnaatttnnaaattatgncccnttgntcanaccancccctgaaaagaacaattaaggcaattaagatagcattanagtttcaatgaagtngncattttctgtgtattaagattanatgttagctgctgaagnttgtggaggtcggacatnaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacattttcagttatgctgacagccccaaatgttttccgtcgacgcggccgcgaat

SEQ ID NO: 519804 - DNA, 341 bp, Homo sapiens
gatccctaggagtaagtccaatcaagtagttaacaaccatgtcactgaagagtcaagctgcctgggttcaaatcccagcttctgtcacttaacgatggcatgacctgaggcaagttctttaatttagctatgcctcagtttcctcacctataactgatggataggattcatgttctgagccaggggacccattaaggggacccataggactcatgttctgagccaggatatttttgagagtgaatggggctggttttaagaattagatcaggacaacaggcatcctgtgggactgtctcaggcaaacctaaaaagatggttatcctcataattacggtacc

SEQ ID NO: 519805 - DNA, 1192 bp, Homo sapiens
  misc_feature (8)..(8): n is a, c, g, or t
  misc_feature (80)..(80): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (133)..(134): n is a, c, g, or t
  misc_feature (153)..(153): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (383)..(384): n is a, c, g, or t
  misc_feature (404)..(404): n is a, c, g, or t
  misc_feature (410)..(411): n is a, c, g, or t
  misc_feature (415)..(415): n is a, c, g, or t
  misc_feature (418)..(418): n is a, c, g, or t
  misc_feature (421)..(421): n is a, c, g, or t
  misc_feature (429)..(429): n is a, c, g, or t
  misc_feature (478)..(478): n is a, c, g, or t
  misc_feature (514)..(514): n is a, c, g, or t
  misc_feature (520)..(521): n is a, c, g, or t
  misc_feature (530)..(530): n is a, c, g, or t
  misc_feature (534)..(534): n is a, c, g, or t
  misc_feature (538)..(538): n is a, c, g, or t
  misc_feature (542)..(542): n is a, c, g, or t
  misc_feature (547)..(547): n is a, c, g, or t
  misc_feature (587)..(587): n is a, c, g, or t
  misc_feature (602)..(602): n is a, c, g, or t
  misc_feature (604)..(604): n is a, c, g, or t
  misc_feature (627)..(627): n is a, c, g, or t
  misc_feature (644)..(644): n is a, c, g, or t
  misc_feature (662)..(662): n is a, c, g, or t
ggggtgtngcgcatgcctgtaatcctgtctactcaggaggctgaggcaggagaattgcctgaacccgggaggcagaggtngcagtgagctgagatcgtgccattgcactccagcctgngcancaagagcnaanntcagtctcaaaaaacaaancaaaaaacctgtngntatagtacgaaagaaacgtcttgcagttttctgttgcagagaattaattagaaccaacntgttggattatacacattcacctttcagaatccttttcttctctgtggaaacccacactctcagcngtntntgggaacacagtagattcttaaggaatgcttgttgaatgttgcagtctgcatcttcttgaagtaacagacctgctggtacgctcnntaaaagtaaaatgtgtctanagaccnnttgnaanccnagatgtangagattaatgcaccaaagcactctcctaattacttaaaatgaattattncaaagaatctttaattgaattttctgtgaagtctgnaatttnnaaattatgncccnttgntcanaccancccctgaaaagaacaattaaggcaattaagatagcattanagtttcaatgaagtngncattttctgtgtattaagattanatgttagctgctgaagnttgtggaggtcggacatnaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgatccatccgctatcaagtcctctcccaatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataattta

SEQ ID NO: 519806 - DNA, 457 bp, Homo sapiens
caggatgacgagatggtatggagagggagagagagatccagtcatcaaccagccatcagatatgtgagtgaagtcatcttagaacattcagccccagtcacattggcagatgactgtaaccatataaaggaccacagaaaagaccagcagaacaaccacctagctgattctagccgaaattgctaaatccacagaattgtgtagctaataaaatggttattattttaaggctactaagttttggggatgaattacatagcaataacatgactgaaagggcagggtttgtactgctatattcccagggcctagagggcatgaccatggcaggttttcagttatagactgttgtggattactgtcattgtggtgtcactcctctctttgctttatagactacctgacttcccagtcctcttgggtctcaccaaagttctaagcttgacttccacacatt

SEQ ID NO: 519807 - DNA, 942 bp, Homo sapiens
gtcagaaatgaagacatgagatgaagcaaggagcaaccaccagcttcctcccgcctgaagcttctcaactcaagccagacaggccagcaattccagagtccgagaagaggccttgatgtagagaaataccgtgggacgggggtgctttgagcaccggagaggaataggaggggccggctctcctctagcctccctgctgagagaggatgaagatcgacgttggatgataccgcgttggtgagcgtatagactaccttataacttgcggaaccatccaacattcaaaggctggcccagaggaatcggcgagtagtggcgtaatccggctcaacacattgacgggacttcgcataacctggtggtgccaggagcgcacggtgaccagcatagtggggtgctcacgtaaggtggtccgttgtaatgtcttcgaatgaatgaaaggatcaattgagggacatatctgccgttgtaaatgcacactatctcgattctacagtacgtcgctgatcaccctccatctgtggtgccgtgagtcggacttgggtcccctggaggtcctgtcgagtcaaccccagacttagggcgcataggaggccttttgctaccatatgggcctatggggcaggcaacatggcgaaaggtaaggtaccatcctaagtagcccggtgtgtgataatactaacgatgagaatcaaaggttgtggcgaggtagcaacagggctgttgaggtggggcctggcttttgctgaggattttatgatactgttgggagaatgaacagttgggtaaaggtgttctttgataatcgatagtaactggtaaaagcatgggaagtggggacagtaggcattgtcccggaagttcctggaaaggggaaagaccgttgtggaaggagtccaaggaccctacttattccgtcatgatacagggtggaaggaaagt

SEQ ID NO: 519808 - DNA, 144 bp, Homo sapiens
tcattagcggagcatcataagcggttcagtaagcggagcatcagtaaccggagcatcagtaagcggagcggtcacgcctgctgggggtatgttgtgttggaagaagaggaggcgaggaggtggcatagatctgcccgcttactg

SEQ ID NO: 519809 - DNA, 769 bp, Homo sapiens
  misc_feature (46)..(46): n is a, c, g, or t
  misc_feature (122)..(122): n is a, c, g, or t
  misc_feature (125)..(125): n is a, c, g, or t
  misc_feature (133)..(133): n is a, c, g, or t
  misc_feature (167)..(167): n is a, c, g, or t
  misc_feature (176)..(176): n is a, c, g, or t
  misc_feature (180)..(180): n is a, c, g, or t
  misc_feature (185)..(185): n is a, c, g, or t
  misc_feature (202)..(202): n is a, c, g, or t
  misc_feature (226)..(226): n is a, c, g, or t
  misc_feature (237)..(237): n is a, c, g, or t
  misc_feature (250)..(250): n is a, c, g, or t
  misc_feature (258)..(258): n is a, c, g, or t
  misc_feature (281)..(281): n is a, c, g, or t
  misc_feature (302)..(302): n is a, c, g, or t
  misc_feature (343)..(343): n is a, c, g, or t
  misc_feature (348)..(348): n is a, c, g, or t
  misc_feature (371)..(371): n is a, c, g, or t
  misc_feature (374)..(374): n is a, c, g, or t
  misc_feature (390)..(390): n is a, c, g, or t
  misc_feature (414)..(414): n is a, c, g, or t
  misc_feature (420)..(420): n is a, c, g, or t
  misc_feature (424)..(424): n is a, c, g, or t
agcggaattcgggctggagccggagctccggcggcgcgggtggcgngcacgtccctccagacagtaccacaggcacctggagtaccggacatcggtcgcatgtggcccccgagtgtccgtcnagnagcctagngggagcctgccctcccgcgcctcgtcggggcccnggccaggcnaccnttggnccgccggcgcacggacngcgggcatcgagctactagaatcnagcggctgctnggacctcggcacngttgacanagatttctctggggtaccgcggnaggattactttgaatttcggntggtcgcctgtggtctggcatatttagaacttaagtctatnatttngggcaccatgactttgaggcttntanaagactggtgcagggngatggacatgaaccctcggaaagngctatngatngccggcatctcccagagctgcagtgtggcagaaatcgaggaggctctgcaggctgggttaagctacccttgggggagtacagactgcttggaaggatgtccaggagggatgagaacaggaaagtagccttagtagggcttactgcgggagactagtcacgcccttggtccctaaaggagataccgggaaaagcgggtatctggagagtgatctttaagccccctggagccagaataatacatgcgcccaagccgcattcaactgaatcacaaacacgggacgacggcatgccgctgcgtgacttgaacagagccctctgcgccatgaaaatgcgtcttaagacca

SEQ ID NO: 519810 - DNA, 441 bp, Homo sapiens
  misc_feature (5)..(5): n is a, c, g, or t
  misc_feature (19)..(19): n is a, c, g, or t
tgaanacatttacattgcnacttgtctggccacgggtatgtttaattactgctttctcctgaactggaagatcactgatggtagggtttggtcttctttatgtttgtatacttaacacttaccctagaagtgcttgccacattaaggatgctctgggcccaggtacagtggctcattcctgcaatcccagcactttggcaggccgaggtgggaggatcactggagcccaggagtttgagaccaacctggccaacatggtgagaactcatctctacaaaaaaataaacaaaattagctgggtatggttgcgtgcgcctgtagtcctagctatttgggaggctgaggtgggaggattgcttgaggcaatcctggacaggaggtccaggcagcagtgagccaagactgcgccactgcactccaacctgagtgacacagtaagac

SEQ ID NO: 519811 - DNA, 605 bp, Homo sapiens
  misc_feature (17)..(17): n is a, c, g, or t
agtagtatagcctcatnatgggcgacccttgggagctttaacggcggggcgcgactgttctctatcattgatcgcatcgcgttgatctcaacgttctctctcgctgacagcagactgtctgcgggctctacccaggctcctcactgtcctctcattgtggggtgttagacctttccctggcatgccagcaggtctctgtagtcctggtgtgtctatgaacccgatggtgggatggtcgggctgcccgaaaggctgtgctctcccctgctctcccgggtgatcgcatccgaggacatctgggcccccgccccaccggggcctgggaggccctgggcagcggcttcaacccgcagggggatggacaaaaccctcctctccctcattctctactgtcacagtggctccggaagcctggttggcattgacaacaaaatcgagcaagccatggacttggtgaagtcccacctcatgtgtgcggtccgggaggaggtggaggtgctgaaggagcagatctgggaattgggggagcggaacgctggctggagaggagaatgggctgtgcgcgcctggcagccggagcagtggtcactgcctcctcggggtcc

SEQ ID NO: 519812 - DNA, 680 bp, Homo sapiens
gaataactcaataagagtttatgagcaggcttcttctcctcttaattgatataccataaaggtcagatcattgggtagcagcttcttcttgaaataaagacctgattatacaggcaataaaaatataagaacctaaaatacaataggattaaaaaaaacaaattcacgaaaacatagagatactgggtgtcctcagcttaaaagaaccatgaacgaagggctacacgggcagattgctctactcgtgggcagagtagataaggaggacacctcccacgccgtgagagggtgaagaaacatacggcgactctggctgcgtctatagacaacccggagcggcgacaccaccaacatgtaccgggaataccgggaacaagaccaccgtaggcgcggtgaccccagtgctaccgaaaccatggcgtgcaccaggaaacgagcccgagcacgcaatccatacagatcatgaagggtggaaggagatcgcaggccaggcaagtgacgcaggcgagaagaacatgtcaggtccacgactaccaagatcaagataaccgtatgcacccaggggatgcttggaaaacgacagaaaagacaagcttcaccaccaagaaggcccaaactttctactaagtgccaggacctcgtaccgggtgtgcccaaataaactcaggaacagccccggt

SEQ ID NO: 519813 - DNA, 320 bp, Homo sapiens
aaccaaaggaagcacaacatactcaacaacttccaccatccctactactagcttcaaactcttccacactgcatctctacagacacaataatttaccttagcggacttgcaaaaaagcagaggggtggggcgacggagccactcttcagcacaaaaggggcgccgctccttccacgcattaatattccatattcccgggatgatgtccactttcacagtttgactgtattataacagatttgatgtgagagaagacaaatggcctcacaaaggaaagacgacaaatcatcacactgcttttagcagggtttctctttatt

SEQ ID NO: 519814 - DNA, 173 bp, Homo sapiens
ctggctggcagcgcggaggccgcacgatgcctggagttactgtaaaaggacgtgaacccagcaggagttcgtcagagctcttgggcagccttcctcaaaaagtcccggggaagcttgaaaggtccccgaatggggtggataccgtcaaagctggccaagcaacaaaagagctt

SEQ ID NO: 519815 - DNA, 95 bp, Homo sapiens
agaacgccatggaggaccagagcccacggccgggacacccgcgatggctctatctctgacaagaggatgacgagggctcctcctcccacaactta

SEQ ID NO: 519816 - DNA, 304 bp, Homo sapiens
gtgcagaatttagtaatttatttttttgaaaacatctcacactattgcccaggctgaaatgactcaacatatttatttctttcttcagcaagaattgatcacatgtgcattataccaggatactgagctctacgttgggatataatggtgatcaaggagattatagattctggcagggaaaactgacatcaaacacggcgacccgacatagtgagaccctgtctctactagaagaactttaaaaatcaactaggtgtgggccgggcacgatggctaacgcctgtaatcccagcactttgagatg

SEQ ID NO: 519817 - DNA, 1505 bp, Homo sapiens
ctgataggtcgtcttctgctgggtgccgagttccatctgggttcaggattaatacttgctcttcattaaatctgccgagaacgtcctgggtgtccaagattcgcattgataaccgagcagagtgctggatctacatgtagaatgtaatggctgatggattccataattgcacgcatgaggtagaagagtgtggtagaaatgggtggtaggtgggttatgaatgtgcgacgtactagtagagcgaaagcgcgagagtaaggtattattcacaattacatagagaagttttagagaggagggagaaatccagtgtatatatgaataggcttacttagaatttattaagttaatgttcgagtttccacagtccttccatgcgtggcgagatgggtgaagggtgttcaaagcaagttaatttaaatttccttcccaccattttcaaaagttctttcaccctgccaaaagcattcctaacgtcctagcgcatgtgcagatcatgatacacgcaacgtacttagtagaaggctaggaaaatccatgtcccttattacattactcttactcttctccgtctgacgttcgagttgtcacaatgttctccccgcatgaaatccagtagtaacagggggccagtcgaacgggtgaggtttctgcgcatgagagagggtgacacagagtgagaaatctagtcctttggggatcgccgtaataggacacggtctctagcagagattgatcatgggcttggaagtcgcccgcggagctggtttttcaatataaattctcaccgaaaaaacatcagtaaatgtaaagcaatccctcccattggaagcaattcataggaaggataatggtggggggtaattaaccttatgtggctaaaaatttctaatgcatgaatatgggggagctacgaaaatacctcccctagaaagtgcattgtagagagggcacaacgcctattttctttacacaggtcaatgtgtgttttggctggaacccaatttgtcagactccctactttcggcttatttagggcgttgttgtgacattatttcctccacccggcgtttcaatcataccaaccggtgtaggaggtaaaagtgggttagttcgtaacattgccccgtgaacgaggtctttgaaatgaaggctccaggccgtaaataacttagcgggttgccatgtgaaaggctttttgccttagggacattaattttgagttgtgagtgtcacttttgcaacaactaacgggaattgggacgcatgttctggattagcttcgataaggggaagaccgcattacggaaaaggtcacaaaccgtgggcggcaaatgtttggtagtaatgacaaaggagtatcaatactgataggagaacattgcgtggggaaattaaataacaaagcggagaggaagacaaagtggatttcaaccacataagaaagaacaatccagcgtagggaggtggggagggaccaatgggggagaaattgtagggaacac

SEQ ID NO: 519818 - DNA, 217 bp, Homo sapiens
  misc_feature (96)..(96): n is a, c, g, or t
  misc_feature (156)..(156): n is a, c, g, or t
  misc_feature (160)..(160): n is a, c, g, or t
  misc_feature (165)..(165): n is a, c, g, or t
  misc_feature (168)..(168): n is a, c, g, or t
  misc_feature (184)..(185): n is a, c, g, or t
  misc_feature (187)..(187): n is a, c, g, or t
agcgctgagcatactgtgggactcgtggctctcttgctggaggctataacttctcctctggtctcagttcggtattgccagcgctgcatacgtgtnatctctgatgctgggaagtcctccccttggtctaagatcttccccatgatcttcaggtantgcncggcncancttcgtctgagtctcnntnacacttggaggttatcgtgcccagtgcatc

SEQ ID NO: 519819 - DNA, 438 bp, Homo sapiens
  misc_feature (322)..(322): n is a, c, g, or t
  misc_feature (342)..(342): n is a, c, g, or t
  misc_feature (407)..(407): n is a, c, g, or t
tttttttggactgcatcaggtgctgtttattgaagctgtgaagtgagggtccatcactcagtttcctgttggtgacaaggactgatgtgcctctccagtgagactcgtcagtggtggcgacttacacaaagtttgtctctttggtgctaggtactcctagcctgaacctcggtgcaggtgccaccaaactctgtcctgagtgccgccacaccccttccctccagacacaccaccttggagtttgtgtcttctactctaccaacacaaaaaagacaaaatggtcatccatcacaccctattatctaagcttcaaactacattnctggcctctgttttctcatnctctaatcaggaaggcaagaagttgtcctggttcctataaatggctaaaggtgttctaaggttgnatgggctttgggaatttgggaatcaaaaatg

SEQ ID NO: 519820 - DNA, 418 bp, Homo sapiens
cacaggagaacacccagcagcaatctcttatgtggtccacccatgtgtgtactgtgtgataagactcctggctgcttctctggtctcatctatctgctctctcttctatactatctttgttcactgagctacagtctcagtgatgttcctttttatttaataaaagatagcctattaaaacttacacaagcaaaaccgagctaaaggtgcagaagtaacctgtataccccttgtcttgacacatatgcagcaacccccataatcagcatcccacatcagagtcgcatatatgtaacagttgatgagcctacattgaaacatcattatcacccgaagtccataggtaccattaggattcactcatattccccacttgttctgagaggagaaaaaacgaaggagactgactcttggtgtc

SEQ ID NO: 519821 - DNA, 106 bp, Homo sapiens
ctcttagaggatccctcgctatcatctggcacccgtattgaattcaatgtatattactaatctatgcatgacctctagagcttaatggtgccgattaatatgcgag

SEQ ID NO: 519822 - DNA, 442 bp, Homo sapiens
  misc_feature (442)..(442): n is a, c, g, or t
gaccctgaaaggcactgtatagccattcgtagcgagtgttcccgtcattaagttgatatcagaaaccgggttagcttgcaccaacttgtatcgtagaacatgactcagttactacacagtcgaagtttccatttctgtagagcaccgcgtactagtactacgaaaccgaccctgagtccaatgcggccctgttggataggggcattaattcagtacctgaatatggggccatgagtgacttcaaagattgaccggaccaatgctcgcccgagttcaagactgctgaaacgtaactggttaactagtagtgcaattactaggaactggaaacacagcctgccacccagtgaagtgtccagaccattgtcttccaaccccagctggcctttagaacacccactggctagtcctagagctcctgtccttaccaactctttgttan

SEQ ID NO: 519823 - DNA, 715 bp, Homo sapiens
  misc_feature (65)..(65): n is a, c, g, or t
  misc_feature (77)..(77): n is a, c, g, or t
  misc_feature (84)..(85): n is a, c, g, or t
  misc_feature (88)..(88): n is a, c, g, or t
  misc_feature (92)..(92): n is a, c, g, or t
  misc_feature (101)..(101): n is a, c, g, or t
aaggcatttaaaaggcgccagaaaattagaaaagggataccaaacttttgatataaagaaggtgntgaagaccgccntcatccnnganggcntagcatatnaaatttgcaaagctgccaaagcctcagacaagtgccaagcccatctttgtgtgctgtgtgtgcttgcatccaactgtgatgagcctatgtatgtcaagttggtggaggccctttgtgctgaacaccaaatcaacctaattaaggttgatgaccagaaactaggggaatcggtaggcctctgtaaaactgacagagaggggaaaccgtgtaaagtggttggttgaagttgtatagtagttacgaactatggcaaggagtctcaggccaaggatatcattgaagagtacttcaaatgcaagaaatgaacaagtaaatctttggcacacacacacacacacacacacacacacaaaagaaagaaaaaataacctcaaaaataaccaatctattgctgcctcaattcacagtcccctccctgctgccctcagacattctcctcaggctccacactgcagcccaggaaagaagcccttcaccaaacgaggccaaatatttctttgtgggcagtgttccttctgacatcactgaggaggaaatgaggaaactgtgagaaatatgggaaggcaatttcacagaaagagagtttaaataaattaacaaaaaggaaaaaaaaa

SEQ ID NO: 519824 - DNA, 767 bp, Homo sapiens
  misc_feature (117)..(117): n is a, c, g, or t
  misc_feature (129)..(129): n is a, c, g, or t
  misc_feature (136)..(137): n is a, c, g, or t
  misc_feature (140)..(140): n is a, c, g, or t
  misc_feature (144)..(144): n is a, c, g, or t
  misc_feature (153)..(153): n is a, c, g, or t
gaggcgaagtctcgggtgcattcaagatacggcttcactcgtaacccactgccatggccgaggaaggcagtgctgctgaaggtgtaatggacattaatactgttttacaggaggtgntgaagaccgccntcatccnnganggcntagcatatnaaatttgcaaagctgccaaagcctcagacaagtgccaagcccatctttgtgtgctgtgtgtgcttgcatccaactgtgatgagcctatgtatgtcaagttggtggaggccctttgtgctgaacaccaaatcaacctaattaaggttgatgaccagaaactaggggaatcggtaggcctctgtaaaactgacagagaggggaaaccgtgtaaagtggttggttgaagttgtatagtagttacgaactatggcaaggagtctcaggccaaggatatcattgaagagtacttcaaatgcaagaaatgaacaagtaaatctttggcacacacacacacacacacacacacacacaaaagaaagaaaaaataacctcaaaaataaccaatctattgctgcctcaattcacagtcccctccctgctgccctcagacattctcctcaggctccacactgcagcccaggaaagaagcccttcaccaaacgaggccaaatatttctttgtgggcagtgttccttctgacatcactgaggaggaaatgaggaaactgtgagaaatatgggaaggcaatttcacagaaagagagtttaaataaattaacaaaaaggaaaaaaaaa

SEQ ID NO: 519825 - DNA, 670 bp, Homo sapiens
agtggttactgaccccaggactgaccaccaggctctcacggaccgcatctgatgttaacctacctaccattgcgctgtgtagcagagatttcgcctctgcgctatgtgtgacattgttcatcccatgcaacatcaagggagctcactcagtgggtttaactgtgggggatgctggctcggaaagttctgcgcatgcgtgggaccattttcccgtgaacatcccattgggggcggtcatgcctgaattcgtgttgaacttcgtatcacgatgatccttggaagagtagttgaggagagacgacgagcaggctgccttgtatgaagtacggcatgagacccagggaggatattttcaggtgtgaatgtggactgctcccgcatcctgatttcactgttactcagcctgatgttgcagagctggtctgatggtgtacaggtgtgccctctgtgcctatgcagacgaatgctcctactgaagtactggagccgtctcaagatctgctcacggtagagcagttggtcatgcacgcgtcccacttgtgtcaggccattgtacatgggtagggagcaagcatgtgactggtcttacagctgttcttgtatgaggctcattaagcaggtagtgcaacaactggtcgagtgagattaattctaccatgcagtgttctaa

SEQ ID NO: 519826 - DNA, 134 bp, Homo sapiens
atgtcgggatcgctgagaatgtcctcctcagcctgaagacacctgatagttttcccccagccatctccaaacacgtgaagcccatgtggagaagatgcgctttatgtcaaggaaacgtgacaattacaatgaca

SEQ ID NO: 519827 - DNA, 190 bp, Homo sapiens
acaggagtagctggaaaatgcctgtagtacatagatactcgagaggctaaagcaggatgcttccttgagcccaggaggtcgaggcttgcggtgagctatgattacaccgctgtactctaacctggatgacagagggggaccctgtctctcagaaacaaaaacaaacacccatccatcccccatggacatc

SEQ ID NO: 519828 - DNA, 250 bp, Homo sapiens
tgagctaatagaaaggctaggacaaacctataatagtttatgctgtacagcataaactattacagcataaactattacagcataaactattacagcataaactattacagcataaactattacagcataaactattatagcataaactattacagcataaactattacagcataaactattacagcataaactattacagcataaactattacagcataaactattacagcataaactattacagcataa

SEQ ID NO: 519829 - DNA, 431 bp, Homo sapiens
ggtcgaccagtaatggcatttctgggttgaatggtctttctgttgttaggtctttgaggaattgccacactgcttttcacaatggttggactgatttacactcgtaccaacagtgtgtatgtgttgctttttctctgccacttcgccagtgcctattattttttgactttttgataatagccattctgagtgatgtgagatggtatctctacttgcattttttttttgtctctttgttttttgtttagatggactctcgctctgtcatccagactggagtgcagtagcgcaatcttggctcactgcaacctccatctcccgggctcaagtgatctgcctgcctctgcctcccaaagtgctgggattacaggtgtgagccactgtgcccggcccctctacctgcgtttttaataaaggattatacatgagtc

SEQ ID NO: 519830 - DNA, 174 bp, Homo sapiens
tgagtttcatgcaggtacgctcacccaccccgggacacatccagagaaatacctgtacgtagaatatggtggtgcccttgcttgtcacggtctggaaacaactcgaagggactgtgctggtgtagacggagacagaaactgttgaggagttcccattgtggcgcagtggttagc

SEQ ID NO: 519831 - DNA, 1245 bp, Homo sapiens
ttggtgtcctcccctgagtgtgtggtgtcgctctatgagatgtgtctctttgttgtcgttggcccacgttgtggtcacgacgccgaaggggtgttcctctaggggcctcccttggtgcacaggggcgtttttttgtctcgggactcctgcttgaggcccgagttcctccgcgtcccccttttgttggaacgccctctttgaattttggcgctgtgtacagcgcttgttgaaggccacctggggtgcttttctggaggcttccacgcgggtccccccccgtaaatgtgaattgtgttgaggttctcccgaaggatgcgcactgtttaagagtgatataaaattaggggttatcccacatgtcccgagtctgattggttaccctcgcgtggtgacctcaccctagccaccccaggttatttatatgccccttaaacttgggagggaaaacccttgggagaccccgtccataggtgaaaatgctgtaaagggtatgtaaatttgctaaacttggtgaagggaaccgacttgggttaggcgccgcccccccttttttggggtctctgttaaaaattacctcggggggccactaggttaaaagtgtgttagaaaaccctcccagtgagttggctatttatttgaaaatggtttgcccgcgtgaagaatgttggttatattttttatgtttatatttgaaaaatgttgtgaactcggagaaaggggggtaagggcggaaagcacacaataatttgagaaatttgtggaaaaccccctcgaacccctctttggtgataagaaattgtgagaattgttcacctcttaaatgtttttctcttataaggaatatataagagaggtttattataattgagaggtaagttataaattgggacccactaaccccctctggtggaactcggaggcacggtaaattattatgcctcgccacgcgaaacaaattatttctataagagaatgttttatagaaaatataagagtcctcgagaagttggtttaaattgcacatcccacttttctcgtaatttatatgtgagaatttataaactcgccacgtgaagttttgaatgaggttaatcttgtttaaaataagtgaaatgagtctgtagacctgtgatctccccccaacttaaaagtcaccacgtgaccttggagattgtgttcctttatggttgtagatgttggttaaccccttatatgccagaaaattaaggaattaccccgtgccca

SEQ ID NO: 519832 - DNA, 356 bp, Homo sapiens
caaaaaattttagaaatatctttttttaaagcccctgtaagataatttgaagctcttttagtgaaggattgttttaaataagagctctcagttcaagccaactactgttaggggctttaattgggacccccaattcagcatataaaggtcctaatcctgcccttaatccctttggaatattggttttataaatcatcaatcaacagtgttcccctatgaaagcatattcggtttttttcttttcaggtattccttcacggggggggcttaaggtctttccttcctcttctgccatttctctttccatgaattataattgccttttgaattcagaaattaaaacccctccggcccca

SEQ ID NO: 519833 - DNA, 962 bp, Homo sapiens
  misc_feature (342)..(342): n is a, c, g, or t
gaaaaagagagattcgaatcccgactgatcgttcagggatactcttgtccatgggcttaatgagggctggtgatgacctgtgaatctgaagccaaatatctggactctacaggctcaaggagatagattatcgtcgctgtgcagacatcacttctgcggatagtcctgggggctggcagtatgctggccgccgtggaggaacggcgcttagttgatgggtgacatagaccaagatgaccaagtcgacctgtgtgttttgcaatgcaagagtgacgatcatgaaaccattcccgtaacgtatgctcaggtctgtcgtatagagactcatctaggagatgtaanttacttgggatgagcggcgtcttggggagtgagagtactaagctttctcctccttctcttatatcgccttttcgcgatgatcatgagcgagacgagcgtgggcgatgctgatcaggggagtgtctgctgggcatatgggtgcctggccggcagtcatcctcatccagttctcttgcagccgagtaggttgtagtcgagaagaaggcatgggggactcaattgctgtccagcttctattaaaagcatggatggcagagtaaagatgtcaagtatgtatactgggtactttgatgagaaagccgattgagatgtgaggtggttggactcttttccagtcaacagacagaggtggggttgccactgcaaaaactccactgacgcagggcttaaggagcttcccgaatctcggagccagagccctgggccccgaggactgcgaagagctcagggcgaaatcagaagccgaacagggggcgctcttgcaccagaaggaagaagcgcccaaacaggaggtctctggagtatgacaggtgcacacgagaattgtgagcgcaaaaaactcccgggtcacaagagaaaaagaagacaccaacaacgtagtgacgccgcattcttcgtcc

SEQ ID NO: 519834 - DNA, 235 bp, Homo sapiens
agccaggctttcctgccttgtcaacaaagggggccagtccagttgacccccaagtttccttccagctttacattttttttggaacggggtctttttaaaaagcccaggtcgattttgaactcctggcttcaagtgatcctcaccccttagcctcctgagaagctgggattttctactttttaaaattgaattcccacccatattacaaagaaccaaaaaaacccttgtgcctgca

SEQ ID NO: 519835 - DNA, 119 bp, Homo sapiens
gaggattacaataaatggaggtcattgatctttcatcaaaaatcgcctagcttatgcttaggcttatggattcccggagtatcgatgaaaataatttgcgcatcatccgtcgtatagac

SEQ ID NO: 519836 - DNA, 617 bp, Homo sapiens
gtgtttacgccattgcagtccagcctgggcgacagagtgaaaccctgtctcaaaaaaaaagtaacatttctatatgatttatgggatcgacatgtccataatgttaatgaagcgcatagcagtcactagtaaattagcgagttatacattgtcttctatagcatcagaaattgtatatcatggccaggtgcacaaagtctcactcctgaaatccaagcactttgggaggctgaggtgggcggattgcttgaggtcgggagttcaagaacagcctggccaacatgatgaaaccccaggtctctactaaaaatatcattaacaattggtctagcgcatggtggctgcatgcctgtaattccacgcctactcgagagaggctgcaggcattgaggattgcttgaacccggtatggctgatgtgttgcagggagccaagattgtgccacgtgcactccgagctcgaggcgacgaacagagctcaggactgtctgaggaagaacttgtgtatcaggctgggcactagtggctcatacccgtaatcccagtcactttggggggcccaggctggtatcacttgagcccaggagttggagatcagcctgggcaacaaattgagac

SEQ ID NO: 519837 - DNA, 679 bp, Homo sapiens
gcgctctccagcccgcttggaacgctccccgcagcagcgtgcacccattggaatggccaacaggggacctgcatatggccatgagtcgcgggactgtgcagcagaagattgagaaaaatatgatgcagatctggaggcagatcctgatccagtggatcaccacccagtgccagaaaggatgtgggccggccccagactggacgcgagaacattccgaagaactggctcaatggatggcacggtgctatgtgagacttcattaatagcaactgattacacccttgaggggcaggccccaagtaaagaagatccaggcgctccatcatgagcctcacaagtcagatgtgatgcagatcctctcagatgcctgcaagcagctgagcgcatatgtgcattaacaccactggacatcttccaaagctgtggacctctggaaaggacagcaagcatggcctgtgctgaaagcggagcgctggatagaatctgcgtctgggcggggcagtagccacgagatcgatgggctcttgctatggggactcgccagcgtggctgccgtagagaccccaaggagagtcctcgggacttctcggataaccagatgcagaggtggaagaacgtgatcgggtgacagatgggcacaccggccgggttcacgctggactgactgctcaggatgcag

SEQ ID NO: 519838 - DNA, 114 bp, Homo sapiens
tcccaggtaactaactacctgactcctacccctcacaatcatggcaagccacgccacttatccagtgaaccactatcacgaaaaaaacttactacctgggttaggtctacctgg

SEQ ID NO: 519839 - DNA, 117 bp, Homo sapiens
ctctagaggatcttcatatgctttgggacggcgtggagtgttgtataatagctcaacaaaggctgatgtggtagtaggaggtgcaggcatagtgtcctattgagcttggccagctct

SEQ ID NO: 519840 - DNA, 331 bp, Homo sapiens
gaggcgcagtgtaatcccagctatcaggaggctgaggtgggaggatcactgagccctggagatcaacatctgtggtggatggaacattctataggtatcggttggtctagatgatttatactgttgctcaagtcttgtgtatccttactggttttctgacaaacggtcctattccttattgaaattggtgcgtcgcggtctccaactattatagtcgaactgtgtgactgggcacgcactgagttccatgtgaagtcctctagtcacagtgctctcggaactcctagtgcacagacactgcatagcgtggttgccattgggcccgcggaga

SEQ ID NO: 519841 - DNA, 929 bp, Homo sapiens
taattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcactaggctatgtcctcccatgaggccaaatatcattctgaggggcacagtaaattacaaacttactaattcggcaattccaatatacattggggacggaccatagctctccaagtgaatctcgttgagggagggcatactcagatagagagtcccacctctcacaacgattctattactctttcacttcatctgcccttcattattgcagccctaggcaaactcacctcctatgccttgcacgaaagggatcaaacaacccctaggaatcacctcccattccgataaaaatcaccttccacccttactacacaaatcaaagacgccctcggttacttctcttccttctctccttatgacataaacactattctcacagaactcgtaggaccagaaattataccctaggccaaccttaaaacctccccaataagccgagatattctatgctaaaaattcgacgcccttaaaataggggcctgcctataaatacacctactagaaatcctctcttccaagaagtaatttccaaacactatgccaggacccttactggggacacctccgaaccgtatattgcatc

SEQ ID NO: 519842 - DNA, 825 bp, Homo sapiens
gtcagaaagggaagaagggctttgtatcccccatccgaaggctggtgtaccccaaggccgggcgccgggcagactgtaggagcagtgtagagacgcggtccccgtgacactcgagtgcccctttatccccccgaatacctcatcgatccccagatactgctgtgtgattacctgggagaaagagggtcaagttcctggagccaccttatcctggtgatgagcttcgctcacgtgaagcccatccatggtcgggacgagctccatgcagctggcatagacaccggcaggcagcctgacaggagcatgagcgcgtgaagaaccacggcgggcgcaggagcagcatcctgagcacttgtcatgccacgaaagccgtgctgcatccaccttgggcagcgacagaccaaagaacgcatacaaatgactgacggatatccgcatactgacaccgagaatcaggccgggacggccaatccgcgtaacccttggaaagcgcacagaacggcgactgcgacacggtggcataaggtgccgtcacaggcacccggatcactggagctgtgagaaccccaggtggcccggcaccgcgacgatgagcaatgacgcaaaacacccagagcccgtggacaacctacgggaactagtcagaaaatccgacaggagacactcgacacaaggaccaagaaggagacgaacaccccagagacgacacgacgcgacaacgacgctgatacgacaaaccactccgcgacaagcacagagacagacaccaactaaacaaacaacgatgcagaagacacatggagaaacaaggacacgagaaaagag

SEQ ID NO: 519843 - DNA, 500 bp, Homo sapiens
ggaagatggcgacttctggcgcggcctcggcggagcttggtgatcggctggtgcatattcggcctcttactactggctatttgggcattctgctggatatatgtccgtaaataccaaagtcggcgggaaagtgaagtgtgtctccaccataacagcaattttttctctagcaatgtgcacttatcacatcagcacttctaccagtggatatatttgggtttcttacatgaaaactcaaaagtggtacatttaaggactgggctaatgctaagtgtcagcagacagattgaggacactggtattatagcggttactatagtgccttgtgtcccatgtgacagtgttcccaaataacaaaaattctacagagtgggaaacagtgaagtccctattggaacgaactgggaagtagtcatgggttaagctgcttggtcatttcctatcagttctctgcccttgatgggcatgtgggcagctataactttacaaagcctatggca

SEQ ID NO: 519844 - DNA, 851 bp, Homo sapiens
tcctctctcgtgctcctcgcggctcgctggctggccgacggttcctggtgacacctgcttgcttgtgccctgtcctggcggctcagtgcttctctgctgcgctcccggttctgctggacgggaagaatgggctggtgcctgtccctgtccctgtccccatctggaaccccaatgtctgctgcctgctgaccctgtctgcagtggctgatgattgatgctgctgtgactgcagctgtgcctgtgtggtgctgcccgctgcccctggctcgtgcttgccatgtgatgaagtggtcctgaactgtgctactggtgcttccacctgcactgtgggagaatgggcaagtttggggccaggtacatcctgtgctggtgtgagccctgtgctcgcctgtgccgagaatgtgcggtggcttgcttggctgtgggtgaccttggcttggtggatgtggtagaactggcgaaaacgtggagaatggatgacccaccagcaggtggtgatgcctgcatcctgcgcctgcactcaactgccgtgcgccttgcttggttggtcgacccctgagacggacagagcaagctgcatgaaagctcggctgtccaggtccgatgagtgagctgcttgcggcgcccagtgaaggctgccggggcaggccgagcctgccggccgcctgccggatgtgcatgggtggctgggcaacggaaaaatgagcctcgctgaggccgacaagagccaccggagcagcgcgagcttcggcttggctctgtaccatgaagaaggcccagtgggtatggttcagctgcacaggacagtcaagccagccgtcaccggcagtgacaaaaccggtgagataggc

SEQ ID NO: 519845 - DNA, 297 bp, Homo sapiens
acatgtcaagagaatcatcagtagtcagaatatttatcagaagtatgtcacttagtgtataagatagcaaaggtgagtctagtggtatgtagtttgtatactgtgacaacaaacatgtcaccccttttcactctgatttcaactcgatgtagttaatgccacattgcgtaacaagaaagctcttggagaaaagaagttgtatgagtttcatctctgcatccctgaaagtatctaatacatttagataacccttactaagcattgttattgaaacctaagaattccattgaaatattc

SEQ ID NO: 519846 - DNA, 1048 bp, Homo sapiens
agcaacaaggatgaagggaacctgagccaggcccgagacatcgcggcaccagcaagacaactggcaccagtaggacacgaacccgaaggccgttaagagtaggtacacacgagaaagtcaacccagaggcacaggagacccgcagaggatcaatgggggcttcagggaaccacagcagagccaggtacaatatcagcagggtggagaccacagctagagggcgacgaatccctgagcacggaggtccaaagccagctcaatcaacgtcctacggaaagggacttacaggttcgcgaagggcccccctgcatggtatggaacagccacacgtaaggctggtgaagagacaagtccgctggattgtgttcagtatcgatatgcttccttttccgtcaccctgaacattgtccagggtattgaaagtgccgagatcctgcatggctcgatgccgctaccggctgagggggatgcactttgagcatgactgtgtccctgcgcaaggcggtctgcccaaggaagcctgcatggagatctcatcgaccagggtgccagccccctgcccagcgatgtgccagctgtgcgacccagcccagcctgccagctggttctgcaccagatactgaagggtggcctcggggacatactgcctcaatgtgtctcgtggctgataccaacagcctggtcagtggtccagcaccacagcgttatcatgcctggatcaagaagcaggccttgggcaggttcccgctgatctgctggggcatcttcgctgccctgttgatgagctgtggtccttgcatctcgtgatatataggcgcaagactttatgaagcaagactatctctcgtacactccagttgcacacatagcagcagtcacctggctgcagatctaccaccgcatcctttatgctcttgtccaattggctgagaatagccccatctctcagtgggcagcaggtctgagtactctaatactatgctgcgattttcaacgagctgacagacacacctaacttctcgcgtttaccacgccacgttatctatcc

SEQ ID NO: 519847 - DNA, 1091 bp, Homo sapiens
aaggcgtggcacacccctggtggcctgctcctgcagaatgtgtgaatccgcctttttccgcggttgagctggatgttcgacctgttgtgccggctcgggacaaggggggggagtgtttgggtcgttttggtgctcccggacgaacccgtggggtgtccagagcccggtgtttgcccgtgagtcttgtgtgagcgcatcatctgtggtaaacgaggggggatttatgtgcccttcgggaccctgtgaggatggcgtaactggcacgaagttttggttagagcatggggtttagaccattaggaatctgggcacccttggaaaagaccgggatagcagcaatggttcagggcacacagagagattaccttgaactctgagcactggtgagcccgatgggacagagccatatttctcttctttccaaagccaatgggagaaatatcgcctgaagttctgtttttctcagcaagggacatccctgagaaaagagaaatgcgtcccctcgggggtaaggcctttataaatggccgccttcgcgggggcaaacccgttcttttaatggtcgaaaggctgtaagggaatgaaaatatagcctccacgttctcccccgttagcggcttcccacggctttatttaggaaagagggagaatttcccgccttaataaaattttggtgtcataaccacgtgttgttctcgcttcttccaaacactcgttctccctcgataaaagaagtgttatcacatgagcacaacacagtggcccgaaaacttcacttagcgatgtttaaatttgccccggtgcctcgtgggtgcctcgtggattcttgcttctgcctcccactttggcctctgtggaatattcctaatagccttgtggaagcaacgtgaatctctgtgaactcacacccctattcatacacctccctccctttttgaaaatcacctaataaaaaacttgctggttttgcggcttgtggggcactcactggagaacctcgctgacacagattgatatctgtggagccacagctcccacttttcaatttccatggcccattaaataaagcctgcactgcttgatgctcacca

SEQ ID NO: 519848 - DNA, 181 bp, Homo sapiens
  misc_feature (107)..(107): n is a, c, g, or t
  misc_feature (134)..(134): n is a, c, g, or t
  misc_feature (149)..(149): n is a, c, g, or t
  misc_feature (160)..(160): n is a, c, g, or t
tgaagagaaatttgccgggtaccctggtgtcccagcccctcagaaggccatcgtcgccccctgaatacacaatttctggatgccagtaattgaaagcagcaatccangcctcgaattgatgtgcctgccatganggcactttttggaanctgggccttgntcttaattcaacagcttttct

SEQ ID NO: 519849 - DNA, 375 bp, Homo sapiens
  misc_feature (9)..(9): n is a, c, g, or t
  misc_feature (57)..(57): n is a, c, g, or t
  misc_feature (66)..(66): n is a, c, g, or t
  misc_feature (104)..(104): n is a, c, g, or t
taccagatnaggttatggagaaacctatttgaagatagtccttgcctgttcatcatnccctaaatnccccatgaagggccagctttgccttttttagtaaaaanaaaaaaaaagaaaaaaaagtgaataaggctgggcacggtaggaggcccaaggtgggaggatcacttgaggtcaggagtttgagaccagccctggggaaagtggcaaaatcccgtccctacaaaaaatacaaaaattggccaggcacggtagctcccaggggtgggatcatagtagctaacacctgtaatcccagcactttgggaggccaaggcaggtggattacctgaggtcgggagttcgagaccagactgaccaacatggagaaaccct

SEQ ID NO: 519850 - DNA, 1013 bp, Homo sapiens
agcggctggttgctgcactgggctgactgcggccgctgacgcagcgtttccccccatccctgtttgcctgtgtgtcgtgtggatctgttcctagtataggcaacataagtgagatacgtgtgcttcccaccgtccccttcagtttcagagccaagaatgggtctagaatctggcatctttagctcatttcctttgataaattgtactatgcagagactgctcaggaaccgttcagatacgcagtagtaggactgcagatgtctaggtctgcggccacatcttggggacacactggactgttcccagtgtgcagggtacagcacgttcatgtgggagtgctaggggttaggcttctgagcttgaacgcgtgcgtgtgaacagagtgaaaaagtccttcagtaacccaagtcccagtctgtcctatggggagcacgtttgggggcggtcggcagcaggagcgatgggaaagaggccctcgccagtgtgatggcagtgtccaggttggcctgggtgcacccagacggattgtgcttagtatttggtctccatccgtcatcctgcgcttaacctaactgtggtctagttacaatgcctcagcgaagtcccacagagattctctctcctatccattccatgctgtcagcttctctgcttctgagataaggagcccttgggtgtaccagcaatgacttaagtttcaggcaatgaccatgcattatggtggtgttaatcgatacccagaagcttttcagatgagcctaacttacactctttcagtgtgtgcgttaagataccggaaccaaaagcacgctggcattttttaaacttgcttgggcagaatcccagctggacttttctacactgtacggaactggaacttccgatcacagttagcgcaattccggctatatgagccgaaaggtgagtctcaggagaattggaaaatgggaatgacctttaaataaaagaaaaccttcgttagtaacaacaaaaaatctcccacgggggaaccg

SEQ ID NO: 519851 - DNA, 188 bp, Homo sapiens
tcgcctccttatggcacgctggcttcatcccgcatatctgacgtgctgaacgtcctgtcggtggggccgcgcagcattgccttcaggagcaagtagcgatgggaatgtcttgatatcctgcaacacccggatttgctcgagtgcctcggccttcgtcgtcggaaccctcatggcgtaaaaagcaccga

SEQ ID NO: 519852 - DNA, 733 bp, Homo sapiens
  misc_feature (19)..(19): n is a, c, g, or t
  misc_feature (73)..(73): n is a, c, g, or t
  misc_feature (81)..(81): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (97)..(97): n is a, c, g, or t
  misc_feature (103)..(103): n is a, c, g, or t
  misc_feature (108)..(108): n is a, c, g, or t
  misc_feature (234)..(234): n is a, c, g, or t
  misc_feature (237)..(237): n is a, c, g, or t
  misc_feature (245)..(245): n is a, c, g, or t
  misc_feature (250)..(250): n is a, c, g, or t
  misc_feature (345)..(345): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (417)..(417): n is a, c, g, or t
  misc_feature (421)..(421): n is a, c, g, or t
  misc_feature (437)..(437): n is a, c, g, or t
  misc_feature (441)..(441): n is a, c, g, or t
  misc_feature (508)..(508): n is a, c, g, or t
  misc_feature (510)..(510): n is a, c, g, or t
  misc_feature (512)..(512): n is a, c, g, or t
  misc_feature (520)..(520): n is a, c, g, or t
  misc_feature (522)..(522): n is a, c, g, or t
  misc_feature (569)..(569): n is a, c, g, or t
  misc_feature (593)..(593): n is a, c, g, or t
  misc_feature (600)..(600): n is a, c, g, or t
  misc_feature (604)..(604): n is a, c, g, or t
  misc_feature (618)..(618): n is a, c, g, or t
  misc_feature (653)..(653): n is a, c, g, or t
  misc_feature (686)..(686): n is a, c, g, or t
tacatttttgagtagaggnttaaaggagtgacgaccctttctaaagtggggtctcccatcccggatccctaanactgtaanatctgcnanatanatnaaaaanaaaanaaaacaaaagcaaacatgaaacttatgacctgacttcactccacccttcatgcctgcattatgacagaaacacgtcccactgctcctacttatgtatgtacatccagagctccaaacctaagctgnggncccctccncccanccctacccacatccaccctacttcccaaaaacctgtagaagcccccacttagaaaaaaaggcagaaatacacatacacagaaacacatatctatntgcagctcctccatgtgaagcccctgaaanatananaccctggaactttcctctccttatgcacagatgggnaggntgccttcccctgtttntggngtcccccaatagccagaatcccttccgactggtcccttgccctgaatatttgggaacccccccccanananacccctgnanacacatgcacacacatgcacacacatgcacacacacacatacctgcngcccattctcttcccttgggaganaaaaggntgtnttgacccaaattcnggttccaccccagcttaggggcagtggcctaaggngctatttgggcaaggtccagtggaaatcctganggggctgtctcgtggggtgagggtagatagggagctccttagcctga

SEQ ID NO: 519853 - DNA, 585 bp, Homo sapiens
actcttttagcagttaaagagaatgaaatctgaaattcagtagataaaacaggtaatagattttgatgacagtttgcagcccttcgttcattcataaagtattactgtaatttggtgattaggagcctttatggatatacccgactgctgaaaaacattcatcttttatacagtaacaaacagaggtatgattgagcatagagtttaggcaagagaactgactactatggtctcttaatcacattgattctatttcgtggatacttccaaggaggaagggaatctggaaaacatgtttgtggataggtaatctttgttttcctcatttgaaagcaaatttaaatgcctttactttttccttaggtttttttttatgatttctacttaagtgttcttgacattttactgcacccttttaaataaccaacttagtaatttttactattagtaataagggtttttttctgagtggtgggattatgggtgattgtaatcttccttgggctttttggtattttcaaaattgtctgtgatgtacatttaatacttagaaatgcaataaaattcaaataaagtaaaaaaaaa

SEQ ID NO: 519854 - DNA, 137 bp, Homo sapiens
gagcgcaagtacgagctacaaacccacaaagcacctccaaggccacctccatagccactccaaggcactccatagcactccaaagcactacagccctccaccaaaaccacagctcacgccgcctccatagccccagc

SEQ ID NO: 519855 - DNA, 399 bp, Homo sapiens
gaccggcctcctgttcttcttgcttccttcagctcgtttctggcacaactggcagtgtgaagcattgcaaagaatgaccgggttaaggagacctgtcctgttccagaccgaggccttctggctgggtgcagtggctcaaacctgtaatcccagcaccttgggaggctgaggcaggtggatcacctgaggtcagaagttcaagatcagcctggccaacatggtgaaaccccatctctactaaaaataccaaaagtggccgggcatggtggcatgtgcctgtaatccctgctactcaggaggcgtggcaggagaattgcttgaatccaggaggtgaatgttgcagtgagctgagatcacgccaggaactccagcctgggtgacagagcgagactctgtctc

SEQ ID NO: 519856 - DNA, 434 bp, Homo sapiens
gccgacacacacacctgcagcagcagcggatgggaggatgggggtcaggagctcctggctgggctctgacccgggctgtccttcaaacgctgggtgtgatcccttccccaccaccactgcccagcctcagtctcccagtttgtataaaggggctggatgtatggagtctgaatgatccagctcgacagtctgattctgggcttccagacacgcagtcaccattcacacctacagttcacacacagagacacctactcactcacactcagatttaccttcacacacgctcaccattcacagccacagttcacacccacagacacctactcacacatatttaccctcacacatgctcaccattcacacccacacttcacactcacactgatacctactcagtcatgctcacacacactcacaccatttacacttac

SEQ ID NO: 519857 - DNA, 655 bp, Homo sapiens
  misc_feature (135)..(135): n is a, c, g, or t
  misc_feature (230)..(230): n is a, c, g, or t
  misc_feature (336)..(336): n is a, c, g, or t
  misc_feature (344)..(344): n is a, c, g, or t
  misc_feature (353)..(353): n is a, c, g, or t
  misc_feature (368)..(368): n is a, c, g, or t
  misc_feature (389)..(389): n is a, c, g, or t
  misc_feature (414)..(414): n is a, c, g, or t
  misc_feature (417)..(417): n is a, c, g, or t
  misc_feature (465)..(465): n is a, c, g, or t
  misc_feature (475)..(475): n is a, c, g, or t
  misc_feature (521)..(521): n is a, c, g, or t
  misc_feature (599)..(599): n is a, c, g, or t
gagccgtgagttcggtatgcaagagcggaagaaacgcggctggtaccccggaagcagtcgctgcaacttccgggaggtgcttgtgtgcctggtgcgggagctacggggcccaggattgtgttaaagtagtgcttntaccaacatgtcccgtggttccagcgccggtttggaccgccacattaccattttttcacccgagggtcggctctaccacagtagaaatatgcttntaaggctattaaccaggggtggccttacaatcaagtagctgtcagagggaaagactgtgccagtaattgtgtcaccaccagaagaaaagtaccctgaacaaaattnatgggatnccagcacangtgactcactttatncaagataacttgaaaacatgngttgtgtgatgaccggaatgacagntgnacagcagatcccaggtacagagggcacgctatgaggcagctaacgtgngaaatacaangtatggctatgagattcctgtggacatgcttgtgtaaaagaatggncgatatttctcaggtctacacacagaatgctgaaatgaggcctctgtggttgttgtatgattaattgtatagatgaangagcaaggccctcaggtatataaggtgtgatcctgcagggttaacttacttgttgg

SEQ ID NO: 519858 - DNA, 285 bp, Homo sapiens
  misc_feature (15)..(15): n is a, c, g, or t
  misc_feature (42)..(42): n is a, c, g, or t
  misc_feature (64)..(64): n is a, c, g, or t
  misc_feature (69)..(69): n is a, c, g, or t
  misc_feature (79)..(79): n is a, c, g, or t
  misc_feature (81)..(81): n is a, c, g, or t
  misc_feature (88)..(88): n is a, c, g, or t
  misc_feature (92)..(92): n is a, c, g, or t
  misc_feature (107)..(107): n is a, c, g, or t
  misc_feature (122)..(122): n is a, c, g, or t
  misc_feature (124)..(124): n is a, c, g, or t
  misc_feature (128)..(128): n is a, c, g, or t
  misc_feature (142)..(142): n is a, c, g, or t
  misc_feature (152)..(152): n is a, c, g, or t
  misc_feature (164)..(164): n is a, c, g, or t
  misc_feature (180)..(180): n is a, c, g, or t
  misc_feature (185)..(185): n is a, c, g, or t
  misc_feature (187)..(187): n is a, c, g, or t
  misc_feature (191)..(191): n is a, c, g, or t
  misc_feature (198)..(198): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (231)..(231): n is a, c, g, or t
  misc_feature (237)..(237): n is a, c, g, or t
  misc_feature (239)..(239): n is a, c, g, or t
  misc_feature (247)..(247): n is a, c, g, or t
  misc_feature (249)..(249): n is a, c, g, or t
  misc_feature (269)..(269): n is a, c, g, or t
  misc_feature (279)..(279): n is a, c, g, or t
aagaatgttaatgtnaatcatgtcagtggactagcacatggnagtcgcttggaacccactcacnccaanccagtgaccntntgtgggntggnggctcttctcccccnccaacggaacccctntntgcnccaaccttccccanagctccggancgccctctcctnacttccaggttttggngcaanancttncaggaancccgcacccagcttccntntgnccttcagttcnctttgncncccttggngnaagctgtttttctttaactnaaaataaccnaaatgc

SEQ ID NO: 519859 - DNA, 255 bp, Homo sapiens
agaggatcccctccggcaccacggaggataggatagaaatactagctgaaatcgtgaacaagttcataggtgtcagactagaacattccacagttaatatacgaagattactgccagagttactatcagagctatacgaaaatcctgcacattatcctggagactaggaaatgtcgaactctcattttgaataacccaggacatcacccctgatactgagctgctagatactgggggcttgttacatagccccct

SEQ ID NO: 519860 - DNA, 696 bp, Homo sapiens
tcttctgccttgagatgctgttaatctgtaaccctagccccaaccctgtgctcgcagaaacatgtgctgtgttgactcaaggtttaatgggtttagggctgtgcaggacgtgctgtgttaaaatgtgtttgcaggcagtgtgcttggtgaaagccatcgccattctccagtcttgagtacccagggacacgatgcactgcggaaggccgcagggacctctgcccaagaaagcctgggtgttgtccaaggtttcccccgactgagacagcctgagatatggcctcgtgacaagggaaaaacctgaccatcctccagcccaacacccgtaaagggtctgtgctgaggaggattagtgaaagaggaaggcctctttgcagttgagataggaggaaagcatctacctcctgctcctccctgggaatggaatgtctcggggtaaaacccgattgtgcattctatttactgagatacgagaaaactgccttatggctggaggtgagacatgctggcggcaataccggtcttttactgcctgagaatgttgggtaaagtctgacataaatctgggctacgtccacattccagctccatacctttcccttaacctatttattacccagagacctttggttacatgttttcctggtgacccttttcccaccatttccctatagtccttgcaaattccccttactt

SEQ ID NO: 519861 - DNA, 695 bp, Homo sapiens
agcggggcgtcgcatcgtggcgagcaggaggcaggagcgggacgcgcaggggagccgggaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacgcctccggcacccacaggccctgaggctccagtgcccacaggcagagagggcgactgagtccagcccaggctgagccctgcccagctgtactccgcagacacccacgcaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaaggacacagcagcagtcaggtgcatgcttgggaccgcgacaggacaggctgccgcaccccaggcccccagaggccaagtctgtttgcctcca

SEQ ID NO: 519862 - DNA, 778 bp, Homo sapiens
tcctcgtgcggaagttgggcaacctgttgctagtctgtcgttggtgacagcgaggcttcccggctcggtgtggtagcagccccggcgtgccccgcgggctgaagaggcggcgggtatgcggcccgtggacgcggacgaggcgcgggagccccggaggagccgggcagcccgtgagccccggccccggccggccggaaacctggcctccctgtgagcgtgagcgcgcccgggcgcactggcgggcccgaggaagctgctggagatccagagcctgctcgacgccatcaagagtgaggtggaggcagaggagcggggcgcccgggccccaagcaccccgcccgcgtgcggaggctgaggagcggtgtggctcggtgtgcgccgaagcagagaggaaggctgcggaggcggcgcggatgggcaggcgggatcgttggaagctgcaccagcggatcgccggcttgcgagttgttggtgaggccggggaggccggcgggtctggagcggagcgcgggcgggagtgtcccgccgtgaaggcgctgggtaggcaggaatggggagcgcagaagccgtgccacgctcctcccgcggagttggttcattcttttttcataggtggccaacttgacgaattgtgttcacctgataaggagtcgtggctgcttggacaggctcaaaccaagaagagctttcgtttgtctccctgtttttctgctgcgttttctccatttagccactcgatttcagtaccatcctggcggatgacttcagctttaagatc

SEQ ID NO: 519863 - DNA, 256 bp, Homo sapiens
cctggcgatgatacaatacgattacatatcttcgatgacaaatgccactgaaacactccacgctacctggtcaaaagcaggcgttaagttcaactgatgtgtgaagacagagtgtcagtgaagatcctgagtggtgtgggcaacaactgtgctcctccatcccatgtgcagcacccgaccatgcatctaccaacatgctggcacatgcctggacgattgttcttgcacttgtccactatacctgcaaatgtgcagg

SEQ ID NO: 519864 - DNA, 188 bp, Homo sapiens
atgtatgctgataactactattaatgcctgtgtatacacggtgctactgtattcccaccgttcccaggtgtacaaggcagagggccgggacagctattcctactacagtcatagttcaccccactaagaaaattcagacaaggtagagccgagagacaacgtacgagccgagagacccggtagagccg

SEQ ID NO: 519865 - DNA, 542 bp, Homo sapiens
cacggggtagaacgtccacccggtgtcaacgcccccagccagaatcgacgtgagtgtgatgaccgccccggtcgtgaagacataccagctcaacaggttcaatttggggaaggcgagatctttcgccccgatcatcagcggtaggacgaagttcccgagcacggtcgggatgaccgggatcaggaagaaccacaccatcacgatcccgtgcgcggtgaacagcttgttgtataactcggccgtgaccagtgccccgcggggcgtaatcaggttcagccgaacgaccgtcgccgccgccccgccgacgaagaaaaagagcgtgaccgtaaccatatacaggatcgcgatccgcttatggtcggttgtgaacagccacgaccgccagccgtgcgggtcggtcaggtagttcgggacggcatcgtccatcggtggagcggccgacgggacggattcgagggcggtactcatttctttggaccctctcccttcggcaactccgtcggtgccccgaccggcgggggggcggcgttgttcgggaccgg

SEQ ID NO: 519866 - DNA, 114 bp, Homo sapiens
gcatatacctaaaaacgatattgctagctgtatagtaattctatgtttttacttttgcaataatgttgaggacgcagtatccttttctcattattcactatctttctctggcat

SEQ ID NO: 519867 - DNA, 378 bp, Homo sapiens
gagagctcaacagtggtttggctttgggaagtgtggagtgaggtcgaggaaggcaggagagtgagagtgaccctgccattgcagaggagccagtcccagctgctctgtcatcacactgggcaagtctcagccttgggacagactctagtgtggggagcacaccactgttggtctttgatactgactctgtccactgcactgtgcttaggaccctagaatgtcccacccgccatgtcctccctgggcttggaggggccacgatatggctgccaccaactcagcttctcctgctatggctaaaagagtccttcaggtgtgggaagagactcttctccacatcactgtgctcttgtgagcaaccttgatggcccagcccct

SEQ ID NO: 519868 - DNA, 325 bp, Homo sapiens
tttcacagggtgaatggtagtaaagatcagtctgaagcaacatttaacaaaagttgctttctagtggctagatttcttgtactataaaacagaggcatttaggtgaggtctactgaatggaaacagccaaggatgaagatggaaagcgctggttattgcacttaatatatcagtcttcctctctttcaataagccagcacctactgagcatctaccatgtgcccagccatgggaatacgatgatgaacaacattagtcctcaccttcacagaacttccactctatgattttaccttccaaaattttgggtcacactccaaggatt

SEQ ID NO: 519869 - DNA, 642 bp, Homo sapiens
tgtgccaccacacccagctaattttttaatgtttgcagagatggggtctccctatgttgcccaggctgctcttgaattcctatgctcaagtgatccccccgctttggcctcccgaagtgctgctgggatcacaggtgtgagccactgcgcctggtcttttttttttttctgagatggagttttgctcttattgcccaggctggcagtacagtagtgcgatgcttggctcacggcaacctccacctcccgagttcaagtgattctcctgcctcagcctcccaagtagctgggattacaggcgcgcaccactacgaccggctatttttggtacactgggtttcacctgtgggtcaggctggtctcgaactcctgatgtcaggtgatccgcctgcctcggcttcccaaagtgtggggattacaggcatgagccactgtgcccaaccagtctttcttttttttttggagacgggagttttggctctggccacccaggctggagtgcaggggctctatcggcagctcactgcagcctccacctcccgggttcaagcgattctcccgcctcagcctcctgagtagctgggactacgggtgtgcgccaccatgatgggctaatttggttggcattttaagtagagatgg

SEQ ID NO: 519870 - DNA, 123 bp, Homo sapiens
tttctaatattctttttgattatttctaatttattaatttaaattgtcatttttctataatgtctagtatattctgtttctttcatttaaatatttatttttgatttttgaaaatgaaaaaaa

SEQ ID NO: 519871 - DNA, 641 bp, Homo sapiens
  misc_feature (528)..(529): n is a, c, g, or t
  misc_feature (551)..(551): n is a, c, g, or t
agcgggagactgaatgaaagatgagcttctgcctttatatccttctctcctgctacccaactcattgtggtgaacgaacaagacatagacgcgggtggcagactgcactatatgcttaggactgagaatgcaactgtcagaagcacagcatgtgaccttgttagagatgcttgctcgggactgcgataaagtgaacgaggcgaaactgagaaaaaaactaggatgacatccgcttccactaggacaacagtgcaagtgtcatgttctctagtgcttctgagtaccgagcaaggacttggtcccagcccccagctccagggatggatcttgcattgtttaagcccagtcccagtgacttctaacccaatggacctaagaccctgcccttggacgattggggaaacacggtgttggaaccggcttctatcttctggcaacagacatggacttactttactcgtgacgccatactttcccccgcaaaacttgcaccatcgcggacaaaaccctgggctttccctgcaacanncaactggacaaacagccctgcnactttacgaacacctgttctcccttctggcccctcccactcgacgaaccgctggcacactctgtacattgcttaaggcccccctctactg

SEQ ID NO: 519872 - DNA, 638 bp, Homo sapiens
gatcgattagcagaagaaaggcatactcgatgggcaagaacggagaaaggcagcgtacagaagaacgcaggataagcatactatacgagaacaaagaagaggacggagccagcagaagggcagaagaacaaatgctacaaagagcggcgagagacgacgacgagcgcgtccgaagcgacgccaaaacgcgcggacatgagctacgagagtagtgcagggagccgggtgacacgacagcttagaactgaaacgtggacaagggacacaacaaccgcccagcaggggacgtctgggaaccttgaatcgacacgaggaagcggccccgtagacgacgggaaaggatgaagcaaaagacctttgagcgaactaggttttccggcatgcccccccaggcaaacaagtgacccctcgttcgccctacggaggggacgggcctacgtcacgcatctatgcacgtacaagcgccagaacccatgcggaacgcacaattgccgggaatgctcctggaatgcgcccaacgccatgtttaccttggacatggcgtgagccatgcacaaccggcatggaggcccgccccgggccccgcagaagcctaaggccaaacaccaccgggacaacagccctgcgggcacacgaaa

SEQ ID NO: 519873 - DNA, 931 bp, Homo sapiens
gacccacgcgtcgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggaggaatcacttgaacccagaaggcagaggtagcagtgagccaagatggtgccactgcactccagcctgggcgacagagggtgactcctcacacaaaaagaaaaataggctaaaatatgattgtaccactggcactccagccctggcgtgacagagtgagaccctgtctctaacaccacctcacctccacgaacaaccacggccacaaccaagaatgtccgcatgtccagccgttaccttccaagggagtggctttggctacacagaagaacccgctggcatactcgtaaaacaagaaggttccccaaaggatgggaacaggaagcaggccccttacatccaggcagggagaccatccggcgacggggcctgaagggactagcacaggccacaaacccttcctggaccaatcagggcccctgggcaagcaaataacagacattcgcagaaggggaagcgacttctcccaagtggcatctggagggcaagtaactgagcctggtcccccacgaaagaggcattgggccgggaacatccaaggaagaactcacggcccaggcgttgtggcactggtgcgacggacacgaccaagcagacccagatagaaggcacatcggaatcaagctcccccagg

SEQ ID NO: 519874 - DNA, 288 bp, Homo sapiens
aagcagttgtgtgtgtgtgtgtgtgttgtgcgcccgcaatttcgattctttattctgcagtgtgtatacacattgcgtgtgtataagtggaattccactgaattgttctgcaccctttatctgtgtgaactgattacctgtaaaatgatgcttcatatcttattactgatcccttcatcaccactggttatgctcgactatttcattgcttagaatattacaccttcactttatacagcttccagtttattcatagtcttgtgctattttaaacttctcatatctagg

SEQ ID NO: 519875 - DNA, 682 bp, Homo sapiens
  misc_feature (190)..(190): n is a, c, g, or t
  misc_feature (283)..(283): n is a, c, g, or t
  misc_feature (380)..(380): n is a, c, g, or t
  misc_feature (449)..(450): n is a, c, g, or t
  misc_feature (464)..(464): n is a, c, g, or t
  misc_feature (545)..(545): n is a, c, g, or t
  misc_feature (573)..(573): n is a, c, g, or t
  misc_feature (624)..(624): n is a, c, g, or t
  misc_feature (626)..(627): n is a, c, g, or t
  misc_feature (639)..(639): n is a, c, g, or t
  misc_feature (642)..(642): n is a, c, g, or t
ggagttccaaagggtgggatggggaggagggggtggtcagagagaaccaccaaatctgacttttacatttggtctcagaatttaggttcctgccctgttggttttttttttttttttttaaacagttttcaaaagttcttaaaggcaaaagtgaatttctgtggattttactggtcccagcttttaggtnctttaaaacactaacaggactacatagaggctttttcagcattacgggtgtcgtctccgtgccagatgtggcaagatcaccattagcaaagtngaaattacttttgaaagccattagacttacagggtgatgcaagcatctaagagagaggttaatcacactatagaggcataaggtggtatcaggtttncatttttctaatggtttaaacgggtgttttataccaggtgttggcaagtaatgggggtgtagcttgagnntggttaaaggtggnttgggggagggacttcgtggtaagggtttggctgtaaaaaatgtttccaactccgctgaaatgtggctgaaaagcatggtngctgggtaccagttcaacaatccggggntgctcattctggcctactttactctcccattgaagcaggttagcgttgaangnnggtatggaaaangcntgatgcctgttcaatcctttgggtccattcctatcccctc

SEQ ID NO: 519876 - DNA, 115 bp, Homo sapiens
agaagttacaagtagcaccattaacctctccttacatcacatattgaagttagacttacatagcagtttgagtcctgaacatttactgagtgcaattgaaacttctaaaactagg

SEQ ID NO: 519877 - DNA, 123 bp, Homo sapiens
tgcctttccatatagcctggagggttccttaatggcaggaaactgtccaccctagtagtctcaagggctattcctgcatggggattcttgccaaataccagccaacatgactggacaatggca

SEQ ID NO: 519878 - DNA, 814 bp, Homo sapiens
  misc_feature (293)..(293): n is a, c, g, or t
gaatgaacgagtggatacgtgtactcaggatgacctgcttgggctagattgtctgtgattgagggtttgcctgcgagtgcctcattatcactgtgatacaaaagtttcagccgagtctggtatactatgtggatgtcactgataagtatcgcatcagagtctgttaggcaactgcccaataagtcgatgtctccaattgagaagctacaatatcattgtacacctatagagcaacattacatttggctctcgaatattcttacatcttgtaaagtttatgctaaagctcaaanaagagagttccaggcagcaaccatgatagagagcgtaggagctcagccgttaggtgtacttgtgattgatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacattatttcatagtaaaaggaaaccaattgttgcagatttcttttccttgtgaggaaatacatggcctttgatgcctctggcgtctactgcatttcccagtctgtctgctcgagaagccagaatgtgttgttaacatt

SEQ ID NO: 519879 - DNA, 804 bp, Homo sapiens
  misc_feature (265)..(265): n is a, c, g, or t
cggaggcagagaccgaggctgcaccggcagtaggctgcggggcggacgcgcgggccggcgcagccatggtgaagattagcttccagcccgccgtggctggcatcaagggcgacaaggctgacaagggcgtcggcgtcggcccctgcgccggcctctggtcaccgagatcctgcttgacgcctggcgtagggaggagcagcccccacgaacgatcgatccagagagggggacgctcagtgggcggcgctgtgctacctgtcgatgnggcatggtctgtgctgctaatgggacctacgatgttcggcctcgtgatctacactctacagatagcttgctttcttgacacaggctgggcccgagataaacttcttccggctgtggtgtgctgtatgaggactccctgtcgctcccaggatccggactcagatggcagctggaagcaggatgtgaaaatctacctcgacgagaagtactgagcgcagtcaacgtgcctgtgcccctagtttggctggcgggtgaccgctgcagacatcatccatagacttccagcggggtctgactgcgtaccatgagtagtctccctggagcaagtgctagtgtcagtcgaactcaacaccagccattgtgctgccccctcgcaagcttctgggagctcctcatgaacgtgaacgagggggacctacctgccgcagagcgtacatcatccaggaggagatggtggtcacggagcatgtcagtgacaaggaggccctggggtccttcatctagcatctgtgcaacgggaaagacacctaccggctccgg

SEQ ID NO: 519880 - DNA, 229 bp, Homo sapiens
ccactacgaatatagatcgaagaatatcaactatatatacatatatacataaaatacataaatattcataaatatattacacctaatatataaatctatatatacataaatatgtatataaatatatcaaatatgtacacgaaatctatacataaatataaatatgtatacataaatataaatatatatacacacataaatgaaaggtattaccctgggtagtcacaga

SEQ ID NO: 519881 - DNA, 137 bp, Homo sapiens
accgatgttgtctttggttatactacagcgatggctattgaggcgtatcctgcggcatgggggtccgggttgaggtcttggtgagtgttttagtggggttcgcgatggcggccggattggtgctgccggtgaactct

SEQ ID NO: 519882 - DNA, 316 bp, Homo sapiens
tgacttcttagttatgttatttctctttatatatcattcacctcccttggtttagcctgtattcataggtattgtactcctcttgtgcctattgtgaataggattgcattcttgatttggctgtcagcttgacattgttggtgtatagaaatgcttctgatttttgtaccccgaagctttactgatgttgtttaacagttctaaaagcttttgggcagactatggagtattctaggtttaaactcatatcatctgtgaagagagatagtttacttcctctcttcctatatggatgccttttatttccttgcctgat

SEQ ID NO: 519883 - DNA, 249 bp, Homo sapiens
ggtcttgatctcttgaccttgtgatccgcccacctcagctttcccagaagtggctggggatttacagggcattgagccacttgccgcccaggcccataaatggaggatttttgccggttccagcatttcttatccttacttattacgagcacaattttggggagaaggaggagttacagatttttttttcgtgagaggtctctgagcacatgatagtggagctctcttagagacatacagtgactctac

SEQ ID NO: 519884 - DNA, 261 bp, Homo sapiens
agcaggtcaggtccagaagacgagacttacacacgtacggcaatgattttatataatggtgctaagatagggccgggcgcagtggctcacgcctgtcatcccaacacttggggaggccaaggcaggtggatcacgaggtcaggagtccgagaccagcctggccaacatggtgaacaccctctctttactaataatacaaaaattcagccaggtgtggtggtgtgtgcctgtagtcccagctacttgcggaatgtatcgtta

SEQ ID NO: 519885 - DNA, 246 bp, Homo sapiens
  misc_feature (3)..(3): n is a, c, g, or t
ggngataccgcccatgaggcactaagctctaacagctgcagactgcaacagaacacattcagggatgtaatgatgcccaagcagtatctctcttctgtgcagatctaaaactcccaaggcacgtgtgttagagatattgacctgaggggcacggcctctcttccggacttgtagttctccctgaagcttctcaatcaatgggacctcaaaggtgaatgtgtacccagttcctgaccgtgcctctgc

SEQ ID NO: 519886 - DNA, 711 bp, Homo sapiens
tggggccaggcgcgttttctcacgcctgtaatggcaccacgttatgggaagctcaagggcagggtgttatctacgttcgagggtcagggagttccgagagcagtcatggctaacatgcgataaccctgtctctactaagaatacaaaaattagctgggcgaggtagggcacgcctgtaattccaggtacttgctaaactgaggtgtaagaactgcttggacccagaaggcgtaggatggagtgaactgcgattaccggactggactagagcgttctagacagacagagaatgtggcttaggcgccggttattatacactgcgattggtagagacctcatctttgggagtttgtccaacggttttcttgcttcgagctcacgaatcctgcggggttaccgctgggtggcttgctcaggtcgagttcgtgattgtaggactgcagtccgttggccgtcgcaggccaaccccgtcagccgagaaatgcggggtgattctccaggatactatgctgaacagtcaatccccttgcgcgcccagcttccgtccacggtagctttcgcacggcctcgggcatctgcatacatctctcgatctcctctgggctggacgtggccaccttcttgatccgtccaacgcttgcaccatctgcttacaactctgctttgccgtgctctaaccgcttctacgcgcgtcgcaccttctctcgcttc

SEQ ID NO: 519887 - DNA, 290 bp, Homo sapiens
attggatacgcggatagggcgtgctatagagtgtaaatacggtggcctatttcaaagattgttaggggaattaattctaggacgatgggatgaaactgtggttttgctccacagatttcagagcattgacgtagtataccccggacgtgtagcggtgaaagtggtttggcttagacgtccgggaattgcatctgtttgcaagcctaatgtggggacagctcatgagtgtcagacgtctttgtgatgtaattattatacgaatggggccctcatccgtgttattcaaatgg

SEQ ID NO: 519888 - DNA, 267 bp, Homo sapiens
cgacaccctcggtcggagagctcaccactaccatctacacctcactaccctcatctatacctcaccagctacacctcaaccacacacctccatctagacctcaccagctccatctagacattaccacctccatctaaacctcaccgagcaacatctaaacctcatcaacctcaactatacctcaccagccacacctgaaccacacagctccatctaaacctcaataactccatttagacctcaacaaatccatctagacctcacctc

SEQ ID NO: 519889 - DNA, 813 bp, Homo sapiens
caacagagcagttatggccaggcgtctcgaggggcgtggtggtcacacatgacaatcaccagagcatactaccggagacacatggccgaaaacaggatgtgtataggagtacaggaaaccagtcggaatgtctaatccagtttaaagatcaactcgacaacatgatgcgtctccccaccatactatgtgagcctggttttatcactatagatgtgggagatgtgtgtgcacatttgcgttcatgagcctgttttgcctccaagatgtctattggactctgttactctttacaagtcttatctacacattggcgtttagtattgcagaaaaacttaagagtttccctgttgctttgtgtaccaggtggtctagaggagataacttaaacattttagaactattaacaggtaaagtactgaaatgggtacaacttaatggaaagacaagaatgttgtcttcgtaactctgacattataccttgtttgtacccgccagcgggaacttcattgcaggccgtgtgtcaccctgaccacgtctatctctgggggtcgcacgttgcgggcagagcgcaaaggcatacaccagaaaaacgctgtccgtgtggtatggtctctttccaacttcatgtaccagcgtaaacgattcaacagtggaacacacgtttcagacttgggctaccatttgtaatcttttttggagattaagtgtctaaacttaacttacatggttttaccaggacgtaaacgtaccataaatggcttttttccagcttatcatttgggcttctgttaagtggagtattcacttgtggcc

SEQ ID NO: 519890 - DNA, 194 bp, Homo sapiens
ggggggttttgttttcccgggggtttggtttttgggttttttttttttccccccccccttttccccctttttttggggggaatggggggaagggggacccgggggggggggggggggttttgtttttttttttagccccttccccgggggggggatttttttttaaaatggggcctgaaaaaaggggtttttga

SEQ ID NO: 519891 - DNA, 141 bp, Homo sapiens
acagtctgctaaagtggatccgtgggcttggtggatagccacacgaaagaacgaaattgcagttgtgtgagggtagattatctcccggtcgattgatgcctatgtgtgatagtttgttacgccactgaatgcttatgccca

SEQ ID NO: 519892 - DNA, 107 bp, Homo sapiens
aaccgaaacttctccttcactgactttatgcatcctgaagagttagaatttatgaaggaaattgtggttttggaaaccctggaggacatcgacaagaacggggagcc

SEQ ID NO: 519893 - DNA, 501 bp, Homo sapiens
gccgttctgctcctgcgctgtatctgctgcttccctcctgctgtgaagcctcgtgctgcctttgctggctgtgctgcactgcgaccgtgtccgtgtggagctgtcgtggggctcacgtgacttcccttcctacaggcgtccgagctgggcacagctgaacgagaacgtcctcaagcctgcgcaggagaaggtaacgggcagctccgggtggttgtgcctggagcccttcactccaggtgacgtgcgtgtgtcaggggtgtatagggggatagtttgtccagcagctgagactcagtgaggccaagcctcagaacccacctctccagcacaggcgtcctcctcgggcctgggctcctcttggatcccccagctggtccttcccctggctagggctcccttgcagtgcccgcagaccaagaaccccagccacactccgatactctgcatacccactaaggtggcccaaacccaaccccagccacctcgatctgcctaatccca

SEQ ID NO: 519894 - DNA, 921 bp, Homo sapiens
  misc_feature (503)..(503): n is a, c, g, or t
  misc_feature (628)..(628): n is a, c, g, or t
cgggtgtcgaatgtttatatctctcctgctgggagagggttgttgtctccccccgacacactgttgttctgcggggtgtgtgaaacacaagagggccacccaacagtgtgggggtttgtgtgtgccgcacgacacagaacactcctgttggggggcgcaccaatttgtgtgatatgaaaagacctgtgttgccgcggagagagacgctgtggttagaaaagagaggaaaaagaagacatagagagaggcgccgctctcgacacgatctcgggtgagggggcgggcccccacacacacacaggaggctctctgcccgcacagagaggggctctctcacagagagggcgcccccccctacataaggagagtgagggcttgtgaaaagtccctctttatttctctctgcacagagaagtgaacacactgagatggtgtggagatatgcccgcacagagagagagatctatgaaagagttctataccggggcaccacatggggtctnccacacaagagggggcgccccccacagagaatctgtagtctcgacataatacttggcacacaccacgggtgttgtgatagcgcaccacaaagggggaggcagaattctacaaaaatgtgttgggnagaacacccgagaggccgagggaggattttaggccaccaataacacttgaaccttaaggcacgccacggaagttccgccgttccactttagggcacacttgccgcgagctttgtccagaggcctctttatgggctcaagaattccccagaagggagattcaaggaggccctatataacccctaaaacaaggggccccctataattcttttccccttttttaatctctttgtctccaaaaggtttacccaattttggggggcctccaatggggccaataaagggggccccagga

SEQ ID NO: 519895 - DNA, 163 bp, Homo sapiens
  misc_feature (70)..(70): n is a, c, g, or t
atgactttttttccaagtcatatctgcctgcaaaacacattgttaacaaagcacatcctgcacggccctnaatgcattcatctttgattcaatacagcacatgtttctgtgagcacggattggggcaaagttacggtaatagcatctctcactgtggggaagg

SEQ ID NO: 519896 - DNA, 796 bp, Homo sapiens
gcagagacccagcttgccgagcggccgccgctgccgctgtcgccgccgccgccgccaccgcgccatggttcctggcctgctggccaccctcctgcctgtccatgtggccccgtcctgtctctgtgcccctgtgtgacccctgtggtcccctgccatgcccctgtgcccctggaccctgtgcaccagtgtctggagaaaatgcgttggagtgcatagttggcctgacgttgacgacgccaacggacccttgacacggagaacggacacggacgaacgggtggacggacgtagacggcaagagccgggacaaggacggcgagacagacgcaggacaggtgggtgcgacgagcagggacgcgacagacagcgtgcggctagacgggaggggcaaacgacaggacaacggcaagaccttggccagcacgcgacatgcgcaagacacgagaacgagcacaagacatagacagcgcgatgcacaggacaacgaaccggagtgcacgagcacagcgacagaacgcgaagacggagcgcactgacaatgaagcagagagctctccgcacggccgtgcgcagacagacacggcaatgcccgggacagaagcgacagacgcaatggaccgcaacgaaggactccaccagcaacaagggacccaccaacagaggacgacgaaagaacaaacagagggacgaaaaatacgagccaaggccctgaaagacggcgaagaggaccagaaacacagaagccacacgcgagtgggaaggaggaccagaggacgcgcacgacgtgggagaacga

SEQ ID NO: 519897 - DNA, 477 bp, Homo sapiens
gcggaaagtggtagtggtgcgtgtcctgcaggctggaagtcggatcggctacattcgtatctgtcggaatgcaagggtccggagtgaccgacgagatgcaccgttacgagtgtgatgccagggttaaggagggagtagaagtgacggagcatcggttcttcatccgcgccagcatcaggcactctgatctgatcacaaaggaagcctccttcgaatacctgcagaacgagggtgagcggctgctcctggaggccatggactagctgaaggtggcgtacaataacaccagcgtgcgcaccgactgcaaccacatcttcctcaacttcgtgcccactgtcatcatggaccccttcaagatcgaggagtccgtgagctacatggttatgcgctaaaggaagacggatgtggaaaactccgtgtgctacaggctgaggtcaagatcaaaatccggcagaacacaacggcagtgccgttccc

SEQ ID NO: 519898 - DNA, 351 bp, Homo sapiens
caataaataaaatggactctgatgaaacggcataacagccggcaggacacctggggccagctgggttttactctagaagttgcactgatcgtcccaccccacatgtcattccaccccacgttcttccttcaccaacatgcagtttctttccttccttgccagccaaatagatagacagatggaaaaggcaggcgcggccttcgttgtcagtatttctttgatgtgaaaggggcagcacagtcatttaaacttgatccaacctcttggcttcttacaaagttaaacagctcaaagaagtaaaataagaaggcaatgctggtggaatgtacagtgcatatgggctgcacccgg

SEQ ID NO: 519899 - DNA, 1267 bp, Homo sapiens
  misc_feature (256)..(256): n is a, c, g, or t
ggacaagacaagctatccagcagaatgtttcagagaaagttacagtggagcgtgggcgtttacgcagactcctaatgtgagtctggaacctaaacctgacagtgtctcatgaagtcttctggtcaatgtactgacggcatagggatttccacaagagagaagcttggcaggcaaaagattcccatcagtgatacgctatagtgctgtgcagatctcgacgggagctgcgggcaacacggattaacacgacgatccntactagagtcacacaaatgtgcttcctagtaatcagtcaaaatgccgagagatgatgcaaaccagcagatgctaagacataagccagttggcatgcacatgtgaaaactaaatacaacgagtccatggaagacatgcataggttcgagatcccaggtcttacttcatgctgacgttactactggaatttaatacctaggggtggatcaagctcgccttcgatggcagacggtgacaagcgctgacttaatgggctaattcgatgctggaagtattcaatcaatcctaagtccaagagaatgttccaccagtggtgaccagggcagctattgaaattatagaaggtaacagaaacatgaatattacccccttagaccctggagaataatctacgttaaccccaagatggaacaatccaaaaaaaatcctgggatatcgccttgtattgatagtaaattagtgtggacaggggtgggagtacgaaaggaaattgcaggcgcaataggaaaggccggtggggcgaaaaacgatctaaattcgggtaatccaatttagtgtggcaaggttcaaaggtaagtggtgttgcacctaatggtgggaaggggccatgcggtaaataataatgagaggcggtatatactttccctggtataagttatccaaagcgtgtggggaaagtttaagcaactaatggggagaatacgtaaaaaatctggcgggtcgcgctagagcccaaggcccaacggatcaccaccatccgcagaaaagacgcgaaaccacgggagccagaaaaacagcggagaaaaacaagagaaaagagaagggacacaaaccggcggccacaacaaacacagctagcaaagggctcaaaagtacaaaagcgaaccgggccacaagaggatgacaaccatggtggtgcgcattacacaaagacgaacagggacaacgtctgtgaagcgagcgacagacacaacacaacgacgcaaaacaagaccacaaggagaagctcaga

SEQ ID NO: 519900 - DNA, 136 bp, Homo sapiens
agcggacctctgttggtactcctccctcggcttccaaaatgttgggattacaggcgggagcaccatgccgtgctgtaaccctaattattagataatttgctgtggaatggattctaatattcaataatagaagttg

SEQ ID NO: 519901 - DNA, 406 bp, Homo sapiens
ggcgagctatgatgactggcggaggaaggtcctctatctgccgagaccttctttcagctacgccaagtagcatcgtgcaagtggatggtaagatagggctgttccgaggtactgagtcacccgtgctgatgtccaatgcctcgtctctactgtgactcgaggaactatgaagaaggtttccctccagatcagatagagcaggtttccaagcaaggatgatatgaagacttccctgaaagaaagtagtgaagttgaccgtcctacgagatgatgatgcagtgtgtgtcccgcatgtgggcccaacccctgtcatgtcatctcaatgcgctgcatggtccagttagtgggacgggaggccaagtacagtggtgtgctgagctccattgggaagattttcaaagaggaa

SEQ ID NO: 519902 - DNA, 1121 bp, Homo sapiens
gccttgtccttgtgaaacagcctcggtggggaattcagttcgtactctcctctcctctcttcttgttcgaacgatggtgcgggactgaaatgcagtacgagtggtgtccaggctagttcactaggatacacagtgcgtggggtgctccgagcacctccgagaagagagtgcttggcttcttcacatcttctgctcgactgaatctcgactatacagtttgcatctggagagaagagctagaaagataacatatcgcttgtgacggtgacaccccggttctggctgttgcgtcccatagtccacagtgtcggcacatagatggtaattgtgaggaattcttgtagtgtttgtgcctcttaatacgattcttggacaagaggaatcagattctcttgaaggaggcatggatgcaagtggcttgagtgaacaatgcgcatagaagactacaggcattgtcctcttgcaagccgtggatcacacaaattgatgaaaacagaatagaagctttctcgatgtcatctttgaagtaatcgtctccttgtgttgaccctggtattctaggaattgtccagtttacactagaatcgtgtctgttccagatgaagcgttatgtagaacagggcagtttaattagacagagtttaggttataagactttacgatggttgccaacagagtagttggtgaacattttggaagaagttgaggttgagaacgtaaactttatgggtaagcttagctttgagttattccacatcataacttgcatttggtgtggggccttcgtgattaaccaagatttgagggtgtcactaagttctttggcttacaatcaagtcatttgcatcgtgttcgtaattcacaagtatgttgtgatttgagaattgggttaaaatggctgtggtactggctgtcaactcgaaagtaagggggttatgcagtatttggaaattgggtggcatagttgttgcactactgactgcttgggtctaacaaaggcagaggtttgaattttgggggcctgtgaaaaacatgtcagatttaatgtaaggtctataaaagattgagcgagggaaaaacaacaattttggggggcgatggtcttgtgaaagttgtgaaaa

SEQ ID NO: 519903 - DNA, 259 bp, Homo sapiens
aaaaaaagggggccgaaaaggtttcccacatgaaaagggggaaaagaggccaaaccaaaaaaaggaagtaagtccctcaaaaaggaacccaagggttaaaatttaaagatcccgggcgaaaagtggggggaaattggaagggaaaaaaaatttaaacaagaaaaaaagaaagccaagatttcgccccaagtttaaaaaagaacacacaaaaagaaaaaatgggaaccccccaaggaaccggccggaaaaaccgggggga

SEQ ID NO: 519904 - DNA, 987 bp, Homo sapiens
atatgccactaaaggatgatacggagtgtgaagattctgaattatagacacagtagattatccagaagttttctttctctgctctctcgtgactagtagattcaagcaataacaagatagatcgctccattcatggtagtagctgcgaagagcgctagatgatggatgtacattgttcttatgtctactatctttttgtggcgctagactactgttctagtcgtgtgtggcgacgaggtgtcttacagtatctcttgctgtaacactatcttggttctcattaatgtctgcatctcactggtaacaacgatgcacttgctatctcctgataatcatcttacccgtcttctaagcttgggaaaagttgaacgtaatattctctctttgattatttcacacacattctgtttttgccgtattggtctcggagccaaatcatcacattattaactggttggcgctggacatgtatacgtggcagtacggggttccgcagttgttgggccttcgttcatattaagatagtgtgtaacaagagtaaataggctatatcattagtgtttttgtgtctattaaaagtctttagagtggatgagttattcagtctcaatacatatcagcttatacaggtgtagtgggacttggtagcagtatcctcagtgtactccgtccatttttttgctgtaatgacatgtccttcaattagtgttctctttgtgtgggactttttcaactctgttggatggttgcttttacaaacttcctttatttctaagggttccacagattctgtttctttgtttataatagcccggactacgagtgcaatgcataagtctttgcttcgaggatgtcttaaccaaagtttccttacgcaaaaaactgcttggggcccatcggggcatgggggggggtttaataggcctggtattcccaaagacttgggggaggccggggggggggcagatcaccagggcgcggggctgc

SEQ ID NO: 519905 - DNA, 172 bp, Homo sapiens
gagacagggtttccctgcattgcattgcccaggctcatctcaaactcctgggctcaagtgatccttgatccgcctcggcctcccaaagtgctgagattataggcatgagccaccacacccagcctacaaactctatttcttgaattttaagccacccttctgtcgtcttctc

SEQ ID NO: 519906 - DNA, 861 bp, Homo sapiens
agatcgagcaaccctctaaaagcagtttagagtggtaaaaaaaaaaaaaaaacacaccaaacgctcgcagccacaaaagggatgaaatttcttcgggaaatcctccgggttctcccggttactggatccgtctggctccctaagagtccttcgtggaagctttttattcctaagaggagaaaatcagtcaccgggcgaaatcggtggctggattacaggagctggggcatgggaattggggagactggactggctatgaatttggctaaacttaaaagcaagctgggttctctggggatataaataagcatgggactgggaggaaacagctggccaatatggcaaggggactggggtgccaggttcataccttggtgggtagactggggcaacgcgagaagatatttacagctctgccaaagaaggtggagggccgaactgggagatgtagtatttagtaaataatggtgggtgtagtctatacatcagatttgtttggtacacaaagatctcagatgtgaacaagactttgaagttaatgtacttgcccatttgtggactacaagggtttcttcctgcatgagaggaataacctggcatattggaatggggttcggcgtgactttcggccttttagggttatgtcacgcagttgtgggggggtttcataaacttgcagatgactggggctaaaatagggcgtcaacactgggtgcccattcgacggtctcaaatcagacgttggcctcggccggagggccgggggcggttcagggacagttccttctataacaggaggctcggtgggaaaaacagttgtgtaaggacccctcatagcgaccggattaaggacgacaataa

SEQ ID NO: 519907 - DNA, 427 bp, Homo sapiens
  misc_feature (240)..(240): n is a, c, g, or t
actcagttataccatggttggtcaggctggtccagacctcctgactctcacacaccgccagactcggtcacccagagcgcggagatagcaggcgatgaaccaccgtgcccagcactgtatataaactagctttaacttaaatatgggcctcctacctgctggaagtcacaggcgtggcttactcaggataagtcccagcacaacaatcgggacgtgtcggactgcccatcgtaaaacaancaaggggcttccaagagctgagagtcgctgattgtggcagatctgagtctgcagtgaagccttctgtcaggcagaccagcctgaggcctgagaagggagagcagagccaggtcacagcctggtcagggccattaactcatgtcagagaagtggaaggtggggcctgagcccaatcagggagcggtgg

SEQ ID NO: 519908 - DNA, 217 bp, Homo sapiens
aacatgtctgtagtgatctagcggatccctgattgcatttcgaccatggaagggcagtatgtattttcttactaaacctgttgcagaccaatactcttgtcaaatacaatttcacaaatcattgactagaaaaagacataaaatataagccagacttttatgacagcccaaaaattactgtatcaaattgctataaaaatgtctaaatgcaatcggg

SEQ ID NO: 519909 - DNA, 157 bp, Homo sapiens
tcctggcggcctccatctacacaataagcaacactcgcaaacatctcccaggtgcagcaagcagccagcacattgcaagctaggcaattcagcaggcagcaggcccgtggaagcagctcaatggcactcaccctccaaccagcacatggggcacagg

SEQ ID NO: 519910 - DNA, 825 bp, Homo sapiens
aggtcaggtctcggccgagtgtgcagagtatacgttgctgtgtcggagacactagtccccgacaccgagacagccagccctctcccctgcctcgcggcgggagagcgtgtcggcctggcctggcctggctgtgggcttctgctgcaacactccgctcgcctcccctttccccgcgcatgccgtcctgcccctgccagtggccccggccctggatcttccctggagcccgcgagcctccgtctgtccgtcggtgttcggcccgctagcctgcctgtggctttaaacaatgcccccatgttcacggcgcgcatttcatcgtttcgctatggtttttggacgatatgtccaaatgcgagatgggaaaacaggtgggcagaaaagtgtgtacgccgattggagatgggccgaaggatagcctggtattgaccggcctgccctgagccccccctgccgggggccccctttgtaagcggccgcattgatgtcccgtggggtgctcccccgggtctctgtcgtgccctcgggatatccgcggctttcccggaacatctttggggccaaccggttatccgtgcccgcctgcgcccacggaaaagtgtgttacacccccccgccgaggaaattattggtaatagtttggccactgatgcacggtattagaaaatcggcccttttccacaccctacacccaaaaagcgcctaaccagccgggtcgcacgtgagctgcagaaccacgcgtggaccactttttcccccgtgaaaccccgaacttttgggaaacgccacaacaaggcaaaaagcccagctgccggggagcgctatccc

SEQ ID NO: 519911 - DNA, 116 bp, Homo sapiens
gttgcgcggcgacctagaggaccccttctttacatttgtaggacttctctctatgataaatgctttgtgttgggttttatgtgaaagcatttatcatagagagtctccgtcgaact

SEQ ID NO: 519912 - DNA, 897 bp, Homo sapiens
gaagctaagagaagggcggaacatcattgggctgcagatgggcaccaacaagtttgccagccagcagggatgaaggcctatggcacccggcgccacctctacgaccccaagctggcacagaccagcctctcgaccaggcgaccatcagcctgcagatgggcaccaacaaaggagccagccaggctgcatgactggcgccaggaccaagcggcagatcttcgagccggggctgggcatggagcactgcgaaacgctcaatgtcaggcctgcagatgggcaagcaacaagggcgcctcgcagcggggcatgacgggtgtatgggctgccacgcagggtctacgaccccaagtactgtctgactcccgagtaccagagctgtgtgaagcctgccaaaaaccacagggcacaaaaatactacaattcggcctaggggccacaagggcctttcctgttttcccccccagggaagggtgtggtgtcttggttgacccaagcaaggccagcagacccgtctcctggattggattcttccagcccttgtagaattcaactctacagggttaaggagtgggagagagcagatggcggggggcccatgtgggggaagggacctccgtcgtagtgtacagggtccacatagagcggtggtccaacagggccaatggaggagtggaaacgtatcaggtgtccccaatcctcaaagtggtaccccagaaaaaagtcccggagaaagccagaggacagttggtggccaccatcggtgggaagcatgttgcataccgggaagcgtgtggcgcgaacttgtggtagaggggggagagggaattttatcgggacgaagggagctaaaaaaaaaaagtgcgggcagaaaagaggagaaatacgaagcaaccggag

SEQ ID NO: 519913 - DNA, 1026 bp, Homo sapiens
gctgacaaaggagcggaggagcagtcgcagctgctttccgaggaagccggtgttgccgagatggccaaacatgcttatggagtattcttcaacatgacatctacagcaacaagtccacacacatcagcatttgcagcactgtcaacaaacagaaactgcagcaagggggcattcagtgccaatgcatcaacacaaaaagacaaccagagttagtggcacaggaaatcttcctgtactcgtgtaccccacggagctcatcgttttatgcagaatgatcagtcaaacacataagccacgtgtagacaactgtacaactccctatgcagacttagcctataaagcttcaaagctttccgtgatacatacgtcccaaactacagctatggtcgctccggcttgactgcatgcatggtgccaggtacaacagcctcagacgttgtagctggcatactcgtcgattccggcacatacgacgactgttccgcatcctgatacacctactgcgtgtaatagaccacacacttccgatctaccaaagttatccgacgcaacagccacaaggaagggacttaggagacagcaacacggagggctcggtcggatacactctaacgtccccaatcaaggcaaaacagaaaccacccaccacgcgcccaccgcaggcaccacccacagcattacccaggacacaatccaacatgagaacagcccaatcaccaagagaccaggcacggacacaacacccagcgactacacccacgcaagcgccaatacccacacgacaacccgttacaaccacagcgccctcaccaaaatcaaaccatcaccaggcacaggacaccaccactgggcccacgcaccaactccatgccaactgagcagccccgacccaccacaacccaccaacacgccacagcccccccctcacaaaccatggccacacacacaccacatggccaccgaacaccccacaccacaacccccgcaaccggctaccacacaacaacaccagcagcacacgaagcc

SEQ ID NO: 519914 - DNA, 119 bp, Homo sapiens
cttcttattgatgggggtggtctaggaccagtagataaaaaatccttaaatgttcaagtctctcatataaaatggcatattatttgcacataacccatatgtatcactcatataccacc

SEQ ID NO: 519915 - DNA, 112 bp, Homo sapiens
agtgctgacctctagcaggttcacccctcttcagctagtgtaccagcactaatctctgagtaagctgaacgtatgagactggacacccatgtgagtatgtgttatcaatgta

SEQ ID NO: 519916 - DNA, 103 bp, Homo sapiens
ccggtaatgatatatgaggatccagttttctcgacatcttttccagcattcgttatcgtcagtattttttgtgttttagccattctgacacttgcatccagag

SEQ ID NO: 519917 - DNA, 258 bp, Homo sapiens
  misc_feature (42)..(42): n is a, c, g, or t
  misc_feature (44)..(44): n is a, c, g, or t
  misc_feature (46)..(46): n is a, c, g, or t
  misc_feature (57)..(57): n is a, c, g, or t
  misc_feature (78)..(79): n is a, c, g, or t
  misc_feature (84)..(84): n is a, c, g, or t
  misc_feature (109)..(109): n is a, c, g, or t
  misc_feature (174)..(175): n is a, c, g, or t
cgcatggatctcctcattagtgattctgagtacaagcatgancngntgtgacatgtngacttagcatggtgcttccanngtagntgtggtggtcactcagagccttgcngacagcagccagcaccttctcggtcacatactggcagcgctccaagtcatggtccccatcatggnnggatctcacggctccacgactgggcacgactgccattcctgctggcagactagtgccgattgggccaagcgggcggagatcct

SEQ ID NO: 519918 - DNA, 408 bp, Homo sapiens
  misc_feature (19)..(20): n is a, c, g, or t
  misc_feature (49)..(50): n is a, c, g, or t
tagaatttgttgttgattnngattttgtattgaagttaattgttttttnnggtattaatgtgttagggttgagtgttttgggatttttttagaggttggtaagaattagttgttttgttttgtgggtttgttagggttggaaagtttaagttgtaggatttagtttttttttttagttgatgtttttggttagaatattgtgggttgttatttgttttgagttggaagtggtttgtatttatgtttgtaaatgtatttatttttaatttatgtaaggttttttttgtatgtaatttttgattttttgaagagatgataataaattttggttttttattgttatgtgagaatattaggttttagtaatatgttattgtgtaaggaaaaataaaagtgttgttgtaatta

SEQ ID NO: 519919 - DNA, 267 bp, Homo sapiens
tgacacccattcgagattgtcctggatcaacattcgaggtcgtaaacccttatggtggatatggactctagaaataggatggcgcggttatccctagggtaactggttccgtgggtcaagtaatgggatcaatggagtatagtagttcgcttggacgggtgaagtcttagcatgtacggctcggaggtggggctcggctcggaggtcgccccaaccgaaatttttaatggcagggttgggtagttaaggaccggggggttggtaggg

SEQ ID NO: 519920 - DNA, 247 bp, Homo sapiens
tatatgtcgtgttgtagataccgtgttgtatatgccgtgctgtagatgccgttttgtacacgccgtgttgtacatgctgtgttgtaaacgacgtgttgtagatgccgtgttgtacatgcattgttgtacacgacgtgttgtagatgctgttgtacacgacgtgtcgtagatgccgtgttgtatatgccgtgttgtagatgccgtgttggtcgacgcggccgcgaatttagtagtagtaggcggccgc

SEQ ID NO: 519921 - DNA, 408 bp, Homo sapiens
  misc_feature (38)..(38): n is a, c, g, or t
  misc_feature (56)..(56): n is a, c, g, or t
  misc_feature (103)..(103): n is a, c, g, or t
  misc_feature (138)..(138): n is a, c, g, or t
  misc_feature (152)..(152): n is a, c, g, or t
  misc_feature (177)..(177): n is a, c, g, or t
cgcccggtgctgcctctctgatcagctctggaagaaanatggttatcatcttggcncctggaagaatgccgaccaagctgtggcttgtgttttatttgtggantgcaattgaaattttcaggtactctttctactgcngacgtgcattgacnggattggaaggtgctcactggcttngttacactctgtggatcccttatatccactgggatgtttggtggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagacggcgctatgg

SEQ ID NO: 519922 - DNA, 285 bp, Homo sapiens
  misc_feature (41)..(41): n is a, c, g, or t
  misc_feature (50)..(50): n is a, c, g, or t
  misc_feature (259)..(259): n is a, c, g, or t
attcggcacaggggtggacgctgggacgctttgtagctccnccccgcttnccgacccccgccgccgtcgccgccatgacggggctagcactgctctactccggggtcttcgtggccttctgggctgcgcgctggccgtgggagtctgctacaccatttttgatttgggcttccgctttgatgtggcatggttcctgacggagacttcgcccttcatgtggtccaacctgggcattggcctagctatctccctgtctgtngttggggcagcctggggcatctatat

SEQ ID NO: 519923 - DNA, 467 bp, Homo sapiens
tggccccatccaggcaagaacaagagaaagctgcctcagccaatgcggtgctcacacctgtaatccagcactttgggaggccgaggcaggtggattgcttgagcccagaagttcaagaccagcctgggcaacatagccagaccctgtctttacaaaaaatttttttaaaaattagggcagaggccaagcacagtgactcatgcctgtaatcccagcactttgggggaccgagatggcagatcacctaaggtcaggagttcaagaccaggctggccaacgtggtgaactccccgtctctactaaaaatacaaaaattagccaagtgtgttggtgcatgcctctagtcccagctactcaggaggctaaggtaggagaatcacttgaacctgagaggtggaggttgcagtgagccgagatcatgccactgcactccagcctcagtgacagagactctgtctcaaaaaaaa

SEQ ID NO: 519924 - DNA, 138 bp, Homo sapiens
  misc_feature (111)..(111): n is a, c, g, or t
  misc_feature (130)..(130): n is a, c, g, or t
ccacactctatttcttcatggtatacaaagtataccagtaacaattaaatgatattgtaattcatgaagtataagcgagcacttccctcatattatgtaggagaattcctngatgcataatatagcactngcaataag

SEQ ID NO: 519925 - DNA, 693 bp, Homo sapiens
aggagaggaggcatgaatcatgccctaatgtgcactatatatgaactactttggtcagaaggcagcgacgggtaaggatggcttcctctcacagcgcttcttaggctatccatttaccaaggaattctaatctctttctctcacttcaccaggaaaggagggagtttaagatatagaactgggcatgctagcctcgtttttaccttttgcggatttgccataactgcagagaaccgatgttgtggactcttgccagttacattgtgaaccttgcagtgaaagttctttgcctgtgcacagggagatctgtgcttgtgcagaactgcccatgccttagaaagcaggtctgtctaattctaagttcaatatctggtggctatgggtggcataaacttagagtacatcctctaacctagcctttatcagcagttcacttaaaatattgaatctacatctgtctgagtctaaaggggtcagaggtcaggagaggaaagggacactattcatgactcccttaaactttaacaaagactagtgcagaatatatgtcgaagtcagcatgagatctattaaaaaccacatgtgggaattttatgccaaattgtacaggtttttataaatcttggaaaattctatagaaaatcgagtagtgaacattacaaggccccaggtacaccattggtcacgaaattt

SEQ ID NO: 519926 - DNA, 736 bp, Homo sapiens
cccacgcgtccggagggaatgtatatgtcttggtagaccaggaggccttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtattttttttttttttttagttggaaagtgtgtaagcttggatttaaaccaagtttacttcagtagtgttaatgatgtagtaaaaatatttatggaagagggtgaattcgagtatttaagggttataccgtggccatttttttccttaaagcatattcttgggcatctaacgtgccaggtgccatgggtcaaaacttattttttaaatcgctggtacatttcttattaaactaaggtggcttaattttaagagtattagtgtgtggccatcatataggtgtttaaaaagtgtttaatgggccaatgggatgggtaactattatttatttttaaagtgaaagtggtaacagaatggcgttcggattcacacaaattggtgtatcaaacggtgttccttatcctcttttctgatgtagcataaaattgtgtcccggttggagttataactggccagtagatgaccagtcacaagtgaaccacttctcagtggccaatcttggctcatattaaaaaccatttacaaatacc

SEQ ID NO: 519927 - DNA, 212 bp, Homo sapiens
  misc_feature (146)..(146): n is a, c, g, or t
ttcgacggtgtctggaatgggacaggtagggggctcataagcactgttggataaaggcataataatgagactgaagtctacccatatgtgcttctttttctctatagagctaggctggactcaatccatacatgagatttttttanaacataatgaatcttgatgtgatcagccacacagtaaacattgcagttaaattttcttatttgaga

SEQ ID NO: 519928 - DNA, 242 bp, Homo sapiens
tgttatatctgcatacaatgcatacagtggactgggtcctgaaagtgtccttcagctgggactgacagttaatcatgtcaggagcaaatcatccctcagcacaaggtcccaaagcaggcctggggcccatatggcccactccctgatcacctcgcctaggggccatggaacaccaagctggagatgaaacacaaaacatccacttcttaccacccgtatgctccccatccacagatcttctt

SEQ ID NO: 519929 - DNA, 93 bp, Homo sapiens
acatacgcatttattgctctatctatgtgtttgtgtcatatatttatttgtttgctctttctgctgacactaatacgttgtgatgtagagatt

SEQ ID NO: 519930 - DNA, 745 bp, Homo sapiens
  misc_feature (255)..(255): n is a, c, g, or t
aggaaccaggcgcgtggaacactgaggctcgagggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatangatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagatttgaggcctccaatatctctatagttgtcctgctagtgatgatcatccgttgtcgtgtcgctcgctgccttgacaactatccgcgtcgtgggaagcggaccagcgaagaaagaaggaactgtgcgagttttacatgaagaaatacgccaagtcatctgtgggagagacggtgtatggaggatctgatgagctctcagacgacatcacccagcagcagatgctcccaggagtcaaggatcccatctgtggactgtcactgtacgatgggggaggaacgggccacgccattccttgatgcgcaagttcttgcctcccgtcacagaacgcccctggatcag

SEQ ID NO: 519931 - DNA, 285 bp, Homo sapiens
  misc_feature (13)..(13): n is a, c, g, or t
  misc_feature (129)..(129): n is a, c, g, or t
gaatgatggccgnatgtggtggctaacacctgtaatcccagcactttgggaggctcaggtgggagaattgcttgaggccaggagtttgagaccagctggggcagcatcatgagagcctgtctctacagnaaaaattttgaaagattggctgagtgtggtcacacatgcctgtggtcccaactgtttgggaggctgaggagagagaatcgcttgagtccgggagtttgaggctgcagtgagctataatcttgtactgtactctattctgggtgagatcctgtcttt

SEQ ID NO: 519932 - DNA, 1091 bp, Homo sapiens
  misc_feature (239)..(239): n is a, c, g, or t
  misc_feature (532)..(532): n is a, c, g, or t
  misc_feature (536)..(536): n is a, c, g, or t
  misc_feature (551)..(551): n is a, c, g, or t
  misc_feature (616)..(617): n is a, c, g, or t
  misc_feature (644)..(644): n is a, c, g, or t
  misc_feature (655)..(655): n is a, c, g, or t
gccgccgtgaatataaaaaccaccaacaattggaaaacctttcggaagtaccgcgttccattccgttcgtacccgcgaattcgtccattatggccgtcgcattttgtgaagagacgaagactgagcggttgtggccgcgttgccgacctccagcagcagtcggcttctctacgcagaacccgggagtaggagactcagaatcgaatctcttctccctccccttcttgtgagattttttngatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttttcgaagtatggcaaaattggtgggctgctctgttcataagggctttgccttcgttcagtatgttaatgagagaaatgcccgggctgctgtagcaggagaggatggcagaatgattgctggccaggttttnagantattaacctggctgncagagccaacaagtgaaccgaggaacaacgcaggtgtgaaacgatctgcagcggagatgtacggnncctctttgacttggactatgactttcnacgggactatnatgataggatgtacaggttaacccagcacgtgtacctcctcctcctcctattgctcgggctgtagttgccctccaaacgtcaggcgtgtatcaggaaacacttccacgaagggccaaagtggtttcaatatctaaagagtggacaggggcgatcttccaacgcctggacaggttgccacgagaatgacccgttcagggcaatttacgaacgagggggccagataaaacgcacaggggatcctctccggaaaagacctggaaacatctggaggccgcgcgaccagcgaagatgacgaagggagcgcccaaagggccacaacaccggagaacagggacaccggcaagcacgcaggcggcgacacccgcgcgacggcccccgccacaaaaagggagcgcacaggcggacaaacggggcacggcccgagggcacagtaaa

SEQ ID NO: 519933 - DNA, 117 bp, Homo sapiens
agtcaacatccggggtcagtccactctggggccagtccaacatccgggggtggtcttcaaatacaggaaaaaggctaaatatatttttctttaaaaatatttttaaaccataaaaat

SEQ ID NO: 519934 - DNA, 273 bp, Homo sapiens
  misc_feature (215)..(215): n is a, c, g, or t
  misc_feature (249)..(249): n is a, c, g, or t
  misc_feature (266)..(266): n is a, c, g, or t
tagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttggggtgtgggtgggcacatgcctgttaatcccagccacttngggagggtgaagggcacaagatttggtttgaacngggggaagcagaggttncagttag

SEQ ID NO: 519935 - DNA, 202 bp, Homo sapiens
gagtacccatgattctttgcagtttaatttgctttgatgttggacagttcttaaaccaagggctgtggtctccctatttttttttgagacggagtctcactctgttgccaggctggtgtgcagtcacacgatcacagatcactgcaacctctgcctcccgggttcaaccgattctcctgcctcagcctcccaagtagctggg

SEQ ID NO: 519936 - DNA, 465 bp, Homo sapiens
aagcagtggtatcaacgcagagtgcccattacggccggggtgacgggggagggggaaaaaaaaaaaaaaaaaaaaaaaaaaatttgtgggccgccggcgcccgagaagaaggttttcaaagccccattcgcggtggggcgccggcggcgccccaggtaggtaacggtgagccgctgggcgccaaacggcgggtggtaccataaggagaagatcaccgggggcacatggcgcctaagcgtcgttgggagttttcttcaccaaataaaaaaaacaaccgcgccgcggcgggacaacacagggtcgggtgtctttggacacaaatttctcaaagagagggcgacgtccaggagcggcacactagcggggggcttcatataccacgacggcgggtgcgtcccaaaaggaggagcgcccagagaatatttaaaatatttaacccgccccgcgcccgcggtggaaaaacac

SEQ ID NO: 519937 - DNA, 611 bp, Homo sapiens
ttcgtgtaaaaagcgcttttgtcccccggttgtttgttatcagcatgttttgttggcgcccgttgtttgcaccccggtagtcgtggtagggctcgtttgttcccgcgggggtgcgttgttgacacatcacgggtggggtggtggttatctacaatagcggggagagttttctctggcttgggcgctggggcgacaggggggctctttccccaccccgtgttttgttgagggtgttgtcccgtgagccgagaactgcgctaaacggcaggggtgttcgctgtgtggtactcttgcccacccgaggtccccccttttttttgtttcccacacacttacggggggtgtcgcccaacccaaaccgccctacatagtcccccgcagagtattcacaaaggaatatcaacctctaaagccccgtgccccacaagcgatatccccctgaaacgacattggcgccacgtaataaacccacacttctacctctttgtccactccctataacactccatcccccctggatgttttatgaagttttatatttcgcccacgggctactttttttaaaaaccccggcccccgcaaaccaaaaaaatttacagcccaacaagaca

SEQ ID NO: 519938 - DNA, 262 bp, Homo sapiens
caacactccacaagccgggttttagcccacaattaccagatcaaaaccaacgcgggcaggccctctccggccccactcgaagtgcggcaacaggaaacgcttggggactctagataacctcggcccgaacccacgccccccggcgcggagacaacccattcgaacggccgccctatcaacttgcgagtggaggcgccggccctaccaagatgaccacgcgagacggggaaccacagctcgattccggacagctagcctgaca

SEQ ID NO: 519939 - DNA, 544 bp, Homo sapiens
  misc_feature (461)..(461): n is a, c, g, or t
atgaggctatgtagaacaatgactgactatataattcgggcagcgtcatccttcttcagtgtccaagcaccacgtatctatttgatagaaaatactcaaatataattaatgtaccagttcactttatttatttctattttatttgagataagagtttcactcttgtagcccagtgaggctggagtgcaatggcatgatctcggctcaccacaacttccacctcccgggttcaagcgattctcctgcctcagtctcccctgtagctgggattacaggcatgcgccaccatgcccagttaattctgtagagacagagttctccagcagagacagggtttctccatgtaagtcaggctggtctcgaatcccagcctcaggtgatccagccagcttggcctcccaaaatgctgggattacaagcatgagccatcgggcccggccaagaatttttatacatacatnatccagcaggtatcagccttatttcctgtcctaacacaagaaagagcacttgacagacaggtgcagcgtaaaaagggtaccga

SEQ ID NO: 519940 - DNA, 590 bp, Homo sapiens
gctcgactcggcaccggtgtgcatcatggtccgggccctgtgccgcctcccgcggagcggcgtctggctgctcctggcccatcagctcttacatgaccacgtgtcctgcacaggaggctaagctagcggtgccctcctccgggagctctggctcacccagttccaggtagacatggaggccgtctggggagacgctgtggtgtgactggggacagagaccatcaggagctacagggcacgctggcctgactgcacctggtcgacatggcgtgagaagctgggctggtctctggtcccaatgcaggagagtggacaggttcttcctgtgcagtgcactggcctgctacttacacgagagctgcgcccatgctcaggcagggccgtgacggagacccagccctggatagatagtacctactacgcccttcatcgtgtggtaccccatcacaggtgagcctggtggtgacggcactgtgtgagtctaggcagagcaagcgcactgagggcattgtgtaggcggggccaggctgccgcgggtgcacccaggctgcagggtgaggcaggaggcctgggtaggggcagttctggag

SEQ ID NO: 519941 - DNA, 1527 bp, Homo sapiens
  misc_feature (923)..(923): n is a, c, g, or t
  misc_feature (969)..(969): n is a, c, g, or t
  misc_feature (983)..(983): n is a, c, g, or t
acgggctatagtgctctgtatgactgtaggattattgtagagtaccggcttggcacgacgaagctgtttatgtggctagttctggtcgctggaaatagtaagtgcctggcgcagcagacagaggtggtgctgaactgctgagtagaagctggtggagcacaaccctttttgacccagaaacaaccacccagttctgtggtttttcctcccgggggaaattaatttcaaaacgtggggagtgttcctaccctggggagaggcctttatcccctcttgccatgagatgatgttttgaccccaccggtggggggaaaagctgtagaagcccgcctggaagtcctgtttttaggaagggctacatactgggcgcacacattcgctttgtcgacagggggaaaatgaccctgtttatagcccccaccaatacccgtattggaatgtgaaagaaccgcctttaaataagtgtattaccacgaccgtcctaatcccccacttaaccttgtttttaaagagaaattcttttttaccggggtgacaaatccactctcagcatgaccccctccccccttggggaataaatcccgcagattttaaatttctgtctctcaaaaccccttcggtcctccaccaaaaaccagattggtgatatttaggagcgtcccattgtgtgggaccggtgaaaaggtgcccatgcccagagataggccaaagtgtgttgtgaaaatgttgttgcgatgcgcttgttaaagaaagtgtagagcttggtgggatatttcgttggtgagaacttttgggagggacatttgcttcccgccgagcgccccccaattctcagaatggcccctggatgaacaccacgcctattagcgctctccggtataagagttggtgtgtcttctcttatgccccatctcttagaatgnggttttttatataaactaccacgccctaaaacacacatctctttantatggtctctatangaatataaaaggagaacctattatgttggccccaacaataattttgtgtgccccctctctggagccttttatagttaaggcgctttgtggtataaaatgttgaggagaaacacctttttgtgtatagagaaattatatctcgatatatatagatgagaattttgttgataatgcgcttttccttgaaatgagtggtgtgatataggtggagatatggccccatacaccacagagtgttacaccacgcgttatagtgtaatattttacacataacatcttaagagagatataaaccataataccagtggtgttcttaagtttagtggataaataggagtacctgttgaaggtgtaaccataaatagtggtttaataatattgtttggaataataaatttatagtgattttccaaatagtggctggatttattttgaccatctaataatctgaatagtttttgtgatccagttagtttgtgtttcatagacttccattcataaactttaaaaaacttttaataaaatattttccttcccttttcca

SEQ ID NO: 519942 - DNA, 501 bp, Homo sapiens
  misc_feature (46)..(46): n is a, c, g, or t
  misc_feature (68)..(68): n is a, c, g, or t
  misc_feature (121)..(122): n is a, c, g, or t
  misc_feature (132)..(132): n is a, c, g, or t
  misc_feature (138)..(138): n is a, c, g, or t
  misc_feature (145)..(145): n is a, c, g, or t
  misc_feature (147)..(147): n is a, c, g, or t
  misc_feature (155)..(155): n is a, c, g, or t
  misc_feature (167)..(167): n is a, c, g, or t
  misc_feature (173)..(173): n is a, c, g, or t
  misc_feature (262)..(262): n is a, c, g, or t
  misc_feature (328)..(328): n is a, c, g, or t
  misc_feature (387)..(387): n is a, c, g, or t
  misc_feature (409)..(409): n is a, c, g, or t
ggggcttacgctccttttattttctgtttaggacaggacggggganagactgggacataagcgctgtnatacattagcggttttggggggcatcaattttgcgaggggggggctgggggcnnaaggtgtttncgggtncggggcngnggtggtgngctgtctgtagncgctcncagggctttgcggtggtactcagcagaagccactttgtaatcactggcagtaaagagagatgcagaattctttgccagatattttaggnaatcatgcaaatagcccaacaataatgcaaggcttttctcatcaaggggcgtataggccaacattnctccaattcttacaaataatctcagtaggtgtggtgctccataaacctgggacattggngcatcagggtgagcccagaggntttcagcatactggggcctctcaaatttgtagagcagctgagtgccccacatcacattgaaatattcttttattcctgccacaacttcattt

SEQ ID NO: 519943 - DNA, 983 bp, Homo sapiens
aacaagtcctttgccgagcacgcttccccagcgatctatcctgctatctgatgttgctctgatacggactcaccggagcttcttcatccagtccccgtgaaccgaacctaccgatagcgctcctctcgtccgtacttaccttcatttccaatcgctcacttctagacatagtaactaccggatcctccactatagtctcacaagcagaccagaagcaagtacatatttcggccgcacgtaaggccattcatttttacttgactcttaggagcggatcctcccttcagttctagtcctcgcaagtcagcgtagcgacacaacggagttacagcatagccccgtttatacacatcgatctggaacaagttgcgatcctgtactattcttcacgatatcaactcctaatcctattacctaattatctccgctattttgagtagactatagtactacacatattgggccttaactttcttcaccaatctcaatgaaggagagggatcatgctgagaaagctgcatgaagcatgcttgaatatcaaacagaaggttggccggagatccttccgttcacgatatcaagaaaaccagactgtgatgactggcagagcgggcctgagtgcaatggcagtgtgcagttacattcggaaaaaaatgtgcctccagtcactactggaactgcacaaactgtccactgagcgaaatgagccccattggtgtgacttcattgagacacattacctgcatgagcaggtgaaagcccaagggaattggggtgaccaacgtgaccaaatttgcgcaaagatggggagcgcccgaatcttggctttggcggacttatctcttttgacaggcaccccctgggacgacagtgctactgacaggctaaggctcgggctaatttcccatagcgtggggtgacttccctggtccaatgccgtgctgcatgttgggtttcctttacctttctattagtggtcccga

SEQ ID NO: 519944 - DNA, 126 bp, Homo sapiens
caagcaccagcctgaactagttttatcctttgaagcagcccttaccatctcacgcgcccttctcttcctcagcagtcccgggcctagacagagggcgtgagatggtaagggctggcttcaaaggat

SEQ ID NO: 519945 - DNA, 517 bp, Homo sapiens
ggcctaaacttagtagttaaaattcaattcatgccttcgaacccaatgttatccatagattccaggcattgtataaaagacacattgtgtaactccctgttatgtttcactctgaccaccagtgcatgaaaccccggtcacgtatcccgtagattgttcaatcaatcaggaccctttcatatgaaatctttagtgttgtgagcccttaaaaggaacagaaattgtgcactcgaggagctcagattttaaggcagtagctcgccgatgctcccagatgaataaagcccttccttttacaactcggtgtctgggaggttttgtctccggctcatcctgctacactatctctacaaaaaaaatttaaattcgcctggcatggtggtgtgcacctctagtcccaggtacttgagagggtcagaggatcgcttgagcccaagggtttgagtctgcagtgacctatgattgtgccgctgcaattcagcttgagcaacacagtgagaccctgtcttcaagaata

SEQ ID NO: 519946 - DNA, 423 bp, Homo sapiens
gcgcgggacgacctgtggcgcactgaacattgcctccaaatgccccaagtgctgacaatgaccgtgtacttcgcctgagaagtgtgagctccctgtgggaagtgactgtgcacaagttctgcctcaatgtgcgagcgctgcagcaatgactgctgactgccctggtggtccactgcctgagcatgactggtgaatgcctgttctgccacaagccagtgctacggccacccatgtatcggacccaaatggtgagctcctggctgccctctgggccttgccctgtggaccttgctgggagcgggctgtgggcgcttgtgcgctagtgggatggggctgtggggcgtacccttgtgcccggccaggttgtgattcccactgcaccaggaaggtccccttagccagccctttggaacaaggccttat

SEQ ID NO: 519947 - DNA, 318 bp, Homo sapiens
aatttctaaaaaaacttttttttggccgggtttccccctttttggggaaaggtttaggggtggccaggtcccaatggtttttttccccggaggccctccaaattaggatttttggaggaaaccggaaaaaaacttttttttcccttcccagtctttctccgggaaaattctatggctttgttcccttaaccctggtttgaaaccaccgtttttgggaaaggtggaaaattttgtggaatgggggattttttttaaagggaacccctttcatggggtttttcttgcccctttggaaaaaaaccctgttttttttttgga

SEQ ID NO: 519948 - DNA, 677 bp, Homo sapiens
cgggagtgcgggcggggagcgctggcgcgagctcgctgcctacgagctgagacgatgctgctgtccctggtgctccacacgtactccatgcgctacctgttgccctgcgttgtgctcctgggctcggagcccagctacgtgttggcctggggggtcttgcggtttggtctccggcttcctgtccgcccgtttctaccgtgcgctcgtacgatcgtgtcatgtacttgcgtctaccagagcatggtgctcttcttcttctataattctccgtgttccagtgtgagccgtctccgcagctcgcctggtctctggtgttccattctgagctcccgggggcgcggacgcttctccgtgtcgcccgcagctggcgagggtcacccggccggcctcggcggatccagctcggatgaagctcgtgccgcttccccgacgttcctctccgcatgcttcctgccgttctgccgagatcgctctctaggaagctgtggctgcgtcgtcctgaggctacgagtgggacccgccgcccctttccccggccctcgcctgggtctgatgctgcttagcaaagtgggtgcagatgcacgttttaaataatagggcacgcgtttagcaagtttctggcctttggtccaaagaggtggtcatgttggaacagatcggagacgtctacactccga

SEQ ID NO: 519949 - DNA, 327 bp, Homo sapiens
tcaggctcggtacccgactgcatcgtgcgcatgtacaaggaaggaggagctgacttcgctcaatggcgattgtgtgccgtgaagattgaggaacgacaacccctcagccctcgccatcatggaaaatgccaaatgttctggcccgtcatgccagtatctgaccatcctacgaatggcattgtgcccactcgtggaggcctgatatcctccctgatggggaccatgacttgaagcgctgccagttatgtgaccgagatcgtgctggttgctgtctaccagcgttctgagtgaccgccatcactctacctggacggctcgccttcctga

SEQ ID NO: 519950 - DNA, 410 bp, Homo sapiens
aaataacgggagcccctctgtaccaggctgcccaagatagtgctgcccgtattcccggtggtcgtagcctcggcgctgcccgcccacatagccttggccccggcttcggttctgccggttacgctcgttacggtcgtttcggcgatttgtccgcattctcggaggggggcagaagcgttccttgcctcctccttgtacttcgtgacaatgggctgagcttcctccttctcgagctccccatatgtcacctcatccatatagtcgcatttctcaggcaaagagaagttggctttcatctccagcatcatagattcaggcacatcatctccctctacttccttcctcatctccagcctcttcttccactcttcctcattagggacaaccaccaccagtacaacctgccggtg

SEQ ID NO: 519951 - DNA, 172 bp, Homo sapiens
tgtacctgggccggcatccccgcacgacgaggtctctaggtttcatttagacctggaacccagtgggtaaggctgtctgtttctgggtgtcagagacccagtattaggaagtgctttgtcatcactcaccaaagccatattcttcccacggctgcccgtcttgcgggggctg

SEQ ID NO: 519952 - DNA, 201 bp, Homo sapiens
ttctagaggatccctggcaggtgtactccgtgtagcttgagcatttggtgtggtggtttttgtggtggttttctgagaaagttggtgagacttctgtagttggaacatttactggtggtaggtttctgaactgcttggtgggacctttggaagttagagattttcctctgcattcaggtggtgagtacaacctgccggtgg

SEQ ID NO: 519953 - DNA, 385 bp, Homo sapiens
  misc_feature (114)..(114): n is a, c, g, or t
  misc_feature (312)..(312): n is a, c, g, or t
  misc_feature (318)..(318): n is a, c, g, or t
ataaaagaaccagcccaggtgggtggctggtagcacctgttccgaaagattctggacatgctaaactttctaggcgttgatttataaaataggcatcatccaccgggtgtggtngctcatggctgtcatcccagcactttgggaggccgaggcgggtggatcacttgaggtcgggagttcgagaccagcctggccaacatggtgaaaccccatctctactaaaaatagaaaaattagccgggcgtggttgcgggtgctgtaattccagctactcgggaggctgaggcaggagaatcacttgaacctggggangcggangttgcagtgagccaagatcacaccatcacactgcagcctggggagacagagcgagattcattttcaa

SEQ ID NO: 519954 - DNA, 264 bp, Homo sapiens
tagggataagcaatcttagagcgacagctataatcactgcgcccgctcataaggggatggacatggctaggtttatagatatgttgggtggtatggtgtaaataagtgaggcagagagtccgaggatggttagttagtggcactaaacactgattacgagatacttcttaaccacaacggcacaactaacaaccctatatccccaatactcagttattatctgaaaccactcagcctactcgtacacacctttactcgtacaca

SEQ ID NO: 519955 - DNA, 425 bp, Homo sapiens
  misc_feature (152)..(152): n is a, c, g, or t
  misc_feature (209)..(209): n is a, c, g, or t
  misc_feature (228)..(228): n is a, c, g, or t
  misc_feature (248)..(248): n is a, c, g, or t
  misc_feature (344)..(344): n is a, c, g, or t
ccagtgagcctcccgcctccctctcccaaagcgctgggcctacaggcaggagcactccgcccagccaagacttcaccgttgactgctttggaggcccaaacccatgcaagcgtccgttccaaagttcagtgtccacccttaaatgaacaatncagcaggtaaaattacccccgaaaaaaatcccttggaccacccataaatgacagtgnctttttcaatatggactcntcatagccagttttcctttngaagttggaactgatcacccttttgtcatctgtaccagatcagtagttggcttgtgttacattttgtgtgtgtgtgtgcgtgttttaaaccagtgncatataaattgtatgttcaaatgtaagtaactttaaagttggacttatctcttcacagttaatcaagcctcacgtaatttc

SEQ ID NO: 519956 - DNA, 572 bp, Homo sapiens
  misc_feature (22)..(22): n is a, c, g, or t
  misc_feature (353)..(353): n is a, c, g, or t
gcccttgcccacaatagtccanaatggtagaatattaagcccctcaaatcagcatggcctgctaaagcaggtttaaggtctttgagttagaaaattacaaggtcccacaagtggtattatgcttgctggagatttgtgaaatggtggaaaagaaacattcccacccaaggtgtgagaactgccttatggatgcgctggtggggcctctctgttaactacaacccaaagtgtagttcccaaaattccttaaaaaaaaaaagacccctgaattgggtccaatggtggaaatggaggggggattggagggggcctttttttacccccaaacaaagggttttcccttttttattaantggggcaggaaggcccaagcagggtttctcccccaaaaatttcaaaaaggccgttggggaaaaataaaaaaaaaggggggttgaaaaccccttaaccccccggttctgggtttcggttgccaaaaaaaaaaagggtttttgccggccttggcccccccccccaaaaatttttttttttttttttaaaaaaaaaccttttggcctttccttttctgggga

SEQ ID NO: 519957 - DNA, 589 bp, Homo sapiens
  misc_feature (204)..(204): n is a, c, g, or t
ccggctctgaacttagggtcgtgggctcatttagagcttatgtaagcaaattgaatttcctattacaaacacactccataacttaagacagcaagtgcaatttttataatgagcagttttcaggcatatgtcgttaaactacaaggctcacttcaggtcatcagcaacctaggaagagcatcttataagtaaagactgtagttngccaagttcagacctaacaccttgctcccaacagtctctctgtttataatcttttactggaattataaatattctctgttccagtggttcttagagtggatgcaccaagctcagggtgtttgcagagatatccctcggtgagtgggaaggaaatgtgaggatttccactttgtatctcatgaatagtaaatagtaatagttcaagtccagattaatgcttcctccctcatgcaagatgtaagatgtgatggggctccccagtagggataggagtgcctcacttgtttttactcatttttattttcagcagcctaagttcttggctctgaacttaggcctggctctgaacttaggcctggctctgctgcataggctgctcccaaac

SEQ ID NO: 519958 - DNA, 218 bp, Homo sapiens
catagtgacatcccgtccccaccaaaaatacacaaatgagccaggcgcgatgcctgtaatcccagctactcgggaggctgaggcaggagaattgattgaaccaggcaggcggcattagcagtgagctgatagcaacactgccctccagtctgggcaacagagcgagagtctgtctcaaaaataaataacttttctccaaaagtatatgggaggatgag

SEQ ID NO: 519959 - DNA, 388 bp, Homo sapiens
cggcacgaggatcggtttgccgggcaccccgcgtgaaaatgttctgcggctcgccgtgctggtgaaacaatcgggattggatggcgttgtttgttcatctcttgaagtggccgatctgcgccaaaaccagggtgcggatttttgtctggtgacaccgggcattcgtccgcaaggggcgttgtgcgacgatcaaaagcgcatcatgacgccttatgatgccatccgtgctggatcggattatctcgtgataggacggcccattaccgcatcagaagaccccaagggtgttttgcttgcaatagaagcggaaatcgaagctgcgcttgctgtttgacctcatgtaaagtcatgctacgctgccctcggtcaaagaaagcgatggcggccg

SEQ ID NO: 519960 - DNA, 179 bp, Homo sapiens
catagtcagaaaaaacgaaagtatataaagaatgaagtggaagagtggtgtgtctccgagccagcccagcatggacgggattttagactgccatcgcgaatgagtggctgcatcggtttgcttggagtgagtgtctacctggacctggagcaacatctgaatgaattgatgctggacga

SEQ ID NO: 519961 - DNA, 657 bp, Homo sapiens
cagccgcatagatattaccggacaagaatgattaacatcttgggtggttttacagaggaaggcgcaatatttcatcacactggtcagattggtgtgcactttcaaacttataaactgttggccaggtgcggtggctcatgcctgtaatcccagcactttgggaggccgaggcaggcggatcacgaggtcaagagctcgagactatcctagccaacatggtgaaaccccatctctactaaaaatacaaaaattagctgggtgtggtggcacacgcctgtagtcccagctgctcgggagggctgaggcaggaaaatcccttgaaccagtgaggcagaggttgcagtgagccgggatcttgccattgccctccagcctgcgcaacacgagcgagactccgtctcaaaaaaagaaatgagaccaaggtaaggacttggaatagttgaggtgtctcacatgctatagagcccagagttcctgctttactttttttaaaggaatggaattgttgctcctgtggctgtttctgggattttattagatgatatctgtaacgttcatattacttagtacttggaaacatagtaagtactcaataatgattagagcggagaccctgatcatcttcggaaatatctatgctgctggggtaccgagctc

SEQ ID NO: 519962 - DNA, 234 bp, Homo sapiens
ttgtctgggtttgtgttgaagaaacctctgacaacccaactttacaaagacacaatgccattaaaagacatgaagcatgatctagttgaaagtgaatgactacaagctcattcttgagatatttcaaaggcattgagggtcatcatttttaccaaccctgtggaactgcaaattctggagtccatgccaccattgtcttttctggggaatacaacaacctcatgagaattttta

SEQ ID NO: 519963 - DNA, 489 bp, Homo sapiens
cacactgcaatagcgataatgtactaccgacagtcttagagagcagttcttagaggtctgctggtgcttctcttgacaaagcacacttttttttggtttcccccgagaaggagcttgctctgtgcccagagtcggagtgcaagggcatgatctcggctcattgcaacctctgcctcctgggtccaagcaatcctcctgcctcagcctcccaagtagctgggattacaggtacccaccaccacgcccagttaattttaggtattataagtagagacagggttccctacacgtgggccgacagttaggcttagaactcctagcctcaagtgagccacccgcctttgcctcccaaagtcctggaataacaggcgtgagctaccgtgcccagctgttattaccatttaaaaaacgttaagagaaagacgattatgcaccagaacctgtatgtagcctgcaaagctaaaaagtgttactctcgggcttggacgt

SEQ ID NO: 519964 - DNA, 330 bp, Homo sapiens
ttggcgcaagtcggtctgtatactcactgtgcttatgttgatctcatccatctggcctcccaaagtgccgggattactggtgtgagccaacatacctggcccgtcttgggtttttatggagccttcattacatggcaggactgacaaccatgtagaaatgtgattgggcaaaaagaacacgggtctaaacccagcaagacctgcccgttcagacttttcctagcctctctgtgcagcatttcttcctttagggggctggggcaggacctgctctgaaatgaaggtcttttgacccacaatcggattagagtcccgccttgggcaggagaa

SEQ ID NO: 519965 - DNA, 1033 bp, Homo sapiens
ttaaagtgagtgtcctataaatgtcatatatatggtgaaggatactcagtgtggtggaatagctcaggaagcaaaggtacatcagaatgtggtcttgggctaggtgtactgtagtctacctttgattttggcatgaaaaagccaccacgtgaggaatggacactaagccagcattacagtacgacagtgtggcaagcatggagtgtctcgtctgtgcgtcctacaatgctgaacagctagccaaaggacctgaagcatgagtggaaagatcgttgcttcatgaaaagagttcatagatcacagcttaagcatgtgtggcctgtgctgtgactaggatggtatatacgtgtgtcatttctcttcgactgggagcaagactagcccgacgatgagctcaccaactaggtactccgaagagatctagagtcagagtgtgaacgctgttgcagatgctcacaagatgagcgaatcgacaacagcccatgtctcctatgcagttacgcacgatcgtggtctggtgcaacagcagtagatagaatggcaaactcatagcggcaggtgggctataacagagaggacatgtcttccgaaccgagtcgaaatgctgtaatccaacatacacgctcatctggtccttgacttgtttccaatgagaacaccaggaagccgacttcaacacctgggtggtagtcatgaggcaacggcaatgtgcgcaagggggctcaacagtgcacccaaagacaccgtaatgggcgcaaacggttcagtgttcacacattccttacgcgggaatcccgtgccccaactaggaaacagcgagatcaaacgcatagtgctaccacagtcacacaacgcagtatagcatgtttagagctaagggcaaaagcagcaaacagctgatctacggctgaaaagaggaagcggtacgaaaaagcacgaaacaagcaccgtctacataagagtgccagtagcagccatcaccacttactcgtctgccgtcctttcgttcacgccataactgcgtatgtgtgga

SEQ ID NO: 519966 - DNA, 271 bp, Homo sapiens
ctggcgagcttcattttctctgaatgattgtgtgttctgcctttggatacatgggtaagaagtcaggcctcagctgcctgagggttgcggtttgcggagcgcatgcctgcccatcccctgcctggttgcagggaagcttctctaacgtgcagctggtccagttcttttgtgccatctttctccagcgtttcaggatagccctcattcttttgtgttgctccagctcaatgactaaagggaattgaagaagttgcccagctctccaaggggg

SEQ ID NO: 519967 - DNA, 240 bp, Homo sapiens
cgggacctgcccccagccccccagcctggtttttccccttaagctttggggccctggatggggtaacattcccttttgtttgtccctgggctggccatgaagtgaggagatgggtttttaaaaagaattccctatttttttggccaaaaatcccggttatatattaatgtgaaataaaccctggttgccccccgatttgtttgctgaaaatgtgaaatagtaaaaatgaaataactggga

SEQ ID NO: 519968 - DNA, 1591 bp, Homo sapiens
  misc_feature (24)..(24): n is a, c, g, or t
  misc_feature (62)..(62): n is a, c, g, or t
  misc_feature (276)..(276): n is a, c, g, or t
  misc_feature (805)..(805): n is a, c, g, or t
  misc_feature (966)..(966): n is a, c, g, or t
  misc_feature (1066)..(1066): n is a, c, g, or t
  misc_feature (1083)..(1083): n is a, c, g, or t
  misc_feature (1090)..(1090): n is a, c, g, or t
  misc_feature (1130)..(1130): n is a, c, g, or t
  misc_feature (1143)..(1143): n is a, c, g, or t
  misc_feature (1175)..(1175): n is a, c, g, or t
atgaccccaatacgcaaaactaancccctaataaaattaattaaccatctcattcatcgganctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaaatattcttntatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccanatcaagcccgaatgatatttcctattcgcctacacaattctccgatccgtccctaacagactaggaggcgtccttgccctattactatccatcctcatcctagcaataatccccatctccatatatccaaacacacaaagcataatatttcgcccactaangccatcactttattgactcctagccgcagactcctcattctaacctgaatcgcgaggacaaccagtaagctacccttttaccatcattgacaagagcatncgactatactcacaacnatctaantctaataccactatctcctaattgaaaccaaatactcaantggcctaaaaaanaaaaaaaaaaaaaaaaaaactgtggcccgttngcccaatggacttgaatttggcaagcttagcatggcgccgattggagctcatttggccaattgccctatgggggcggattacattaatgggccgcggttaaaacgggtgcttgaaaacctgtggtaaccaattaaacgcttgggaaaaacctttttgcattggggaaaacgcagagccccccggggctttccaaattggccctcaggggaaggaaattggcgctatattggaaaagcggataaatttaaaaccttttttcacaagggcaaggggaactttttaagaaaactttttggggggccctggacccccccaaatttttgggggcgacaaaacgcccccattcccccctccctattcggcggccacccccctaggaagcgccctcatgggcgtggcaccccccctttggccg

SEQ ID NO: 519969 - DNA, 111 bp, Homo sapiens
tacctgggaccccgctgtacagttgctgccagcagcctgctggtagttccatgctccatagcgtatattaaatgcctggatacctgcaactggtactggctggtgtgggat

SEQ ID NO: 519970 - DNA, 1578 bp, Homo sapiens
  misc_feature (263)..(263): n is a, c, g, or t
  misc_feature (792)..(792): n is a, c, g, or t
  misc_feature (953)..(953): n is a, c, g, or t
  misc_feature (1053)..(1053): n is a, c, g, or t
  misc_feature (1070)..(1070): n is a, c, g, or t
  misc_feature (1077)..(1077): n is a, c, g, or t
  misc_feature (1117)..(1117): n is a, c, g, or t
  misc_feature (1130)..(1130): n is a, c, g, or t
  misc_feature (1162)..(1162): n is a, c, g, or t
actagttctagaatctgcagagcaggtcagctccattttgtattcttcggggagtctccatctcaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaaatattcttntatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccanatcaagcccgaatgatatttcctattcgcctacacaattctccgatccgtccctaacagactaggaggcgtccttgccctattactatccatcctcatcctagcaataatccccatctccatatatccaaacacacaaagcataatatttcgcccactaangccatcactttattgactcctagccgcagactcctcattctaacctgaatcgcgaggacaaccagtaagctacccttttaccatcattgacaagagcatncgactatactcacaacnatctaantctaataccactatctcctaattgaaaccaaatactcaantggcctaaaaaanaaaaaaaaaaaaaaaaaaactgtggcccgttngcccaatggacttgaatttggcaagcttagcatggcgccgattggagctcatttggccaattgccctatgggggcggattacattaatgggccgcggttaaaacgggtgcttgaaaacctgtggtaaccaattaaacgcttgggaaaaacctttttgcattggggaaaacgcagagccccccggggctttccaaattggccctcaggggaaggaaattggcgctatattggaaaagcggataaatttaaaaccttttttcacaagggcaaggggaactttttaagaaaactttttggggggccctggacccccccaaatttttgggggcgacaaaacgcccccattcccccctccctattcggcggccacccccctaggaagcgccctcatgggcgtggcaccccccctttggccg

SEQ ID NO: 519971 - DNA, 533 bp, Homo sapiens
gccgggcgcggtgctcacgccgtgtaatcccagtctcagggaggcaaagaggcgggaggatagctggagctccaggagtcgagacctgcctggcaatatagcgagaccccgggttcctccaggaacaaacggacaaaacatacaaacccaaagtgcacgaacacacaccacacacacacacaaaaacaaaactgttggtgggggccgcgctgccgcctgaggaagaaaagtttttaacaaacccactgttgtgtggggcggcggcgccacccccgaagtgatgtatagaggcgaacacggtggtccaatcagctgttgtgcccagaagacaaactccgtggtcacagcgagacaagactggcgtggattttcaccacaccacaaaagaaacaacccgcgcgcggcgacacacggagcgtggttgttgggaacacacctccaaagtgggcaatacgagagacccacagacgtggctcacacaacacagggcgcccccaccggacgtcgaaaaaaaattacccccgcggggtgcg

SEQ ID NO: 519972 - DNA, 151 bp, Homo sapiens
cccgacggagagacacgggtcttcgagcaggagttacgagcggcgacagcgtggggggagaacaagaaagctcagctggtggtgagtgcacacgacgtggatcgcatcgagacgggtagtctatcgtggccgggcctgtgtcgtaaaatgg

SEQ ID NO: 519973 - DNA, 206 bp, Homo sapiens
  misc_feature (76)..(76): n is a, c, g, or t
aaaaaaagggaattggagccttcccccgcccaaaaagtttttttttgacccccgggggggaatttttgggttttantggccccaaggggaataggcctttttccttttttttggggggccccttggtttgtttaaacccgtttcccaacccgggttaactggggggtataacccttttgggcccctaagggttccccccaccttta

SEQ ID NO: 519974 - DNA, 1064 bp, Homo sapiens
  misc_feature (278)..(278): n is a, c, g, or t
  misc_feature (439)..(439): n is a, c, g, or t
  misc_feature (539)..(539): n is a, c, g, or t
  misc_feature (556)..(556): n is a, c, g, or t
  misc_feature (563)..(563): n is a, c, g, or t
  misc_feature (603)..(603): n is a, c, g, or t
  misc_feature (616)..(616): n is a, c, g, or t
  misc_feature (648)..(648): n is a, c, g, or t
ggtgtagggcagtgctgctgtcttctgctggtctgactccttgagtatccccagtctcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccanatcaagcccgaatgatatttcctattcgcctacacaattctccgatccgtccctaacagactaggaggcgtccttgccctattactatccatcctcatcctagcaataatccccatctccatatatccaaacacacaaagcataatatttcgcccactaangccatcactttattgactcctagccgcagactcctcattctaacctgaatcgcgaggacaaccagtaagctacccttttaccatcattgacaagagcatncgactatactcacaacnatctaantctaataccactatctcctaattgaaaccaaatactcaantggcctaaaaaanaaaaaaaaaaaaaaaaaaactgtggcccgttngcccaatggacttgaatttggcaagcttagcatggcgccgattggagctcatttggccaattgccctatgggggcggattacattaatgggccgcggttaaaacgggtgcttgaaaacctgtggtaaccaattaaacgcttgggaaaaacctttttgcattggggaaaacgcagagccccccggggctttccaaattggccctcaggggaaggaaattggcgctatattggaaaagcggataaatttaaaaccttttttcacaagggcaaggggaactttttaagaaaactttttggggggccctggacccccccaaatttttgggggcgacaaaacgcccccattcccccctccctattcggcggccacccccctaggaagcgccctcatgggcgtggcaccccccctttggccg

SEQ ID NO: 519975 - DNA, 1591 bp, Homo sapiens
  misc_feature (276)..(276): n is a, c, g, or t
  misc_feature (805)..(805): n is a, c, g, or t
  misc_feature (966)..(966): n is a, c, g, or t
  misc_feature (1066)..(1066): n is a, c, g, or t
  misc_feature (1083)..(1083): n is a, c, g, or t
  misc_feature (1090)..(1090): n is a, c, g, or t
  misc_feature (1130)..(1130): n is a, c, g, or t
  misc_feature (1143)..(1143): n is a, c, g, or t
  misc_feature (1175)..(1175): n is a, c, g, or t
gggatcggcatacgcgggatgaccatacgcaaataccctataaattagttaacactcatccatcgactcccaccatcaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaaatattcttntatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcagcactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccanatcaagcccgaatgatatttcctattcgcctacacaattctccgatccgtccctaacagactaggaggcgtccttgccctattactatccatcctcatcctagcaataatccccatctccatatatccaaacacacaaagcataatatttcgcccactaangccatcactttattgactcctagccgcagactcctcattctaacctgaatcgcgaggacaaccagtaagctacccttttaccatcattgacaagagcatncgactatactcacaacnatctaantctaataccactatctcctaattgaaaccaaatactcaantggcctaaaaaanaaaaaaaaaaaaaaaaaaactgtggcccgttngcccaatggacttgaatttggcaagcttagcatggcgccgattggagctcatttggccaattgccctatgggggcggattacattaatgggccgcggttaaaacgggtgcttgaaaacctgtggtaaccaattaaacgcttgggaaaaacctttttgcattggggaaaacgcagagccccccggggctttccaaattggccctcaggggaaggaaattggcgctatattggaaaagcggataaatttaaaaccttttttcacaagggcaaggggaactttttaagaaaactttttggggggccctggacccccccaaatttttgggggcgacaaaacgcccccattcccccctccctattcggcggccacccccctaggaagcgccctcatgggcgtggcaccccccctttggccg

SEQ ID NO: 519976 - DNA, 106 bp, Homo sapiens
  misc_feature (60)..(60): n is a, c, g, or t
taggggagatgaggtcttgctatgttgcccaggctggtctcaaactcctgaggacctgcngtcctggtgttttagcctcccaagatgctgggattgttgttgtgag

SEQ ID NO: 519977 - DNA, 378 bp, Homo sapiens
  misc_feature (2)..(2): n is a, c, g, or t
gnttcgactgatatacaaaacatgtctgcaaacgtgcctgatactagccaagttttgttgattcccacaataaaaatgtactggcattctatttgtattgcagcttgaaaattcaaatggaaatagcctgatgtatgtataccagaagaaaactttaaatacaatttaaaattaaaaataaattttgttttgttaattcacattaataaaacaattatcttaaaattggcatgatttcctgtttgatcttccagtttcatgttttagactcagcaaactctatcttctatagagttgattacttataatttcatagagccaagattcttgagaacacatcactgaaaatgaaatttgaattgtacgttttttggtcga

SEQ ID NO: 519978 - DNA, 1072 bp, Homo sapiens
agcggttcgagtggtactttcctgcttggcaaatgagggtactgacgttctgatccttgtgttacaaaccagaactggggtctgctcacctgacgctagtaacagtcacaacagtctacgattgcatgcgttgtttgctagcgaagatgactaggatgggcatattatttgctagggtgccaagcacaggacagctgggaagctcactactttaagatcctctagcctctcttagacggttacactcaatggcgtttcttagcatggaaagtgacgctaaatctctcagaacaattctagtaagttacatggccaagacttacaacattcatgcaccactggacggttatatcacgtggtgctttggctgtaatacaatgactagaagtaccctttggcatagtagacgtgggcttgtcaccagagctcatcaagcataggcattcccagaagacattgcgtccttgcattatggcaacgtctcggctctccacgcgaaaagcaagtgcgctctacgtacattgagacaaactatgcgtggtcttgcatgcaaaacaaaacgggaaactcgttgtaaacaggtcattggcgatctttaccgcgggaaccttgaaacatgtgtcccgcacaaggggagcgccactttaagtgaacagcgacacatcttctaggaaatgcaggagatgcaagcttgggcaaggaacaacgaatgatttccacgacgcgcattccaagggtcttacgggcccccttttattcattgacggcgctccttggagataccgccacgccttgcacctgagcgattctcttgccaacctattgtgtgggagacgcgcccaagaattgtctcgtcgaagaaccaaccggaatccttcccaaggtggtggttattgcattcctcttcagcaaagatcgtccacaattgcctattcacaaatttatactttaacatttcggcgcaacaacccggtagccgattactttggatcaaataaccctgaaatcctttcctttaaggggacctgcgttaggctcctttacacaagccccatctcatctaacacctttc

SEQ ID NO: 519979 - DNA, 171 bp, Homo sapiens
cacgaggggacatcgggcccgggaagctgtaccaacaaagcaaggggcccggtgccccccagtatccagcgggaactcatggtgagcaggtgggggtgccacagagactgcctgggggttctggacatgggggagggaactctgggctactctattgggggcacctacctg

SEQ ID NO: 519980 - DNA, 763 bp, Homo sapiens
  misc_feature (10)..(10): n is a, c, g, or t
  misc_feature (251)..(251): n is a, c, g, or t
  misc_feature (310)..(310): n is a, c, g, or t
ttcttgggtntctgttttaacacccatgtttggagggcagaagcacaatcatggttcacagcagcctcgacctcctgggctcaagtgatcctcccacctcagcctcttaagtaggcgggactacagacatgggccagcgcaccaagccaactttttacatgttttgaagagattggttcttactatgcttgcccaagctaagtttgaactcgtgggttgaagtggatcttcctgcctcgcgctcccccagngatcaccttgggggtgccagtaactgtccctacccaacatacgacaaggagtagcggtnaagtgagatggtggtaggtccagccgagtgccctggcaggtcgcatcctgttttattgcgccttcccctcccggttcttccccctcttcgtcgccttcctcctgctatcctttcttctttccctgccattagtttttccttctcccagctctgccccctcccggttctttttcctgcgcttgtctcataccatcccccccctgagacgtaaccttctttcggctaggttcggtcccggcctcgcctcctctcttttcattgcctatctctcaccatctcgccacactcccgctttcgatatgctatgctcggcgcagtacttgtgtctttattcctccctccttcctcccccgtagtcaggccgttcccctctgtactatcgagtaatggtttattgtaattacgcgttgtctcgaacccgggccgcggttccttttttgtttgttccactct

SEQ ID NO: 519981 - DNA, 1013 bp, Homo sapiens
  misc_feature (138)..(138): n is a, c, g, or t
  misc_feature (209)..(209): n is a, c, g, or t
  misc_feature (221)..(221): n is a, c, g, or t
  misc_feature (230)..(232): n is a, c, g, or t
  misc_feature (234)..(234): n is a, c, g, or t
gggctgatgggagcaggcatcgcccaagtctccgtggctaaggggctaaagactatacttaacagatgccaccctcactgcgctcagaccgaggacagcaacaagtgttcaaaggattgaatgacaaagtgaagaagnaagctctaacatcatttgaaagggattccatcttcagcaacttgactgggcagcttgattaccaaggtttngaaaaggccganatggtgatnnnanctgtgtctgaggaccttcagtcttacagcacagagtgctaaagcgcaagtcacaagcggaagattccagcatcactgatatcttgtgcacaataacacatctgactctcccaaatcagtgcaaactcgcctgcctgtcagccacacagcacctgagaacggtgatctggcatgcaactactatctactcccgtggacaagatgcagctcgctggcagattatcaacgaacgagaaaacttaccaaaggacaccacgtgacttcagcctgtagcagtaggtctcaagcaggggaaggtcatcattgatggttacgcgatggacctggcctctctatactaccaggtgtcttgcgacccatgatgtctgaagtcctcccgaatactcccaggaaggcagttgaaccgaagacgctggaataaccttgaaccacaacagacttaggacctctaccctgcataggtgcccgccacaaatagagtcgaactacacattagagagatggactgtcgacgaacacactgtcgcagagacacatcactccaaaacactctgatagaactccatatcagtagaaacttcacaaaatgcactgctacacacatcaaaacccaccagtccactcacactagcacctaaaaattcgccatccagcatactaatttattcatcaatcattactaaccacttaccatccctcccacagtaataattaacaacaacatctaatctacacacattctcactctctctacgacaaatcaaaaccatagatccatat

SEQ ID NO: 519982 - DNA, 732 bp, Homo sapiens
agctacttgggaggctgaggaaggagaattgcttgaacctgggtgacagagcaagactccgtctcagaaaaaaaaaaaaaaaagaagagttagagtaacccaagcggacaagcctgctcttgcccacttgccatgtgatgccctctgccacgtgaggatgcagcaagaaggcctccacccttccctgcagggcttggaaagacccatgaggacacaagggagaataaaaggaagcagccctgattgccatggctgggtcagggtcaggaggctaggactgctttatgtccctgctataatggacttatgggttttttaagattttttaaaatagattaactatagctcctagagctgactctactgataactttaccctggactccctccctgattttgaccttagtttgtgtggcgggcggggggatgagaggctgcggtccaaatggaatgcagtttgcctgtcctctatcagcatcaatgcatcacctttcccccgatttttacctcatgatatatttatgcatttaacgcatgtttattgagtgactgcaagcagcaaaatgcacgtaaaaagcaattttttttcttttttctttgtcctttcaactcctctctctggatttgccttgtccctgcacttgagatgaaagctaaccaataccacggattttctagccactctgagccattaaataaagaggctctttaaaacaaacaaacaaaaaaaaa

SEQ ID NO: 519983 - DNA, 121 bp, Homo sapiens
tctaagggatcccagactgtcgacaggttggtagatgcctgatagtaactattatgagtcctatctatgacttgaatatggcagaaggctacgtattatttatgatagtcaatttctgtgt

SEQ ID NO: 519984 - DNA, 1365 bp, Homo sapiens
ctatgcctaaagaaactgaagccagactgaagttttgcaccctaaaaaaggaacagcatggtttgagttacttgagcaaatgttggtggtccacgttaagacatatttttaaaacttcccaaaagctgtcgattcattaacacattgtagtcattttcaccatttccatctttggggggcaaatcccaagctcatggtgtacggctattgcaagtccagaacagtccatcactctggtgcttgttcaccatagcacagtcttcaacatggatcaccatcatacggtcacacatatttcccaatacactcaccagccgtttcaaacacaaaggcatggcttccacacatcagccacaggtcgaggccgagcaaacagggcgtcacactcgtcatctatggcacaaggttcaactacaatatgaaaccaccaacttccgtccgtgcccatttggccacatgccccagcgggggcaatcggcatcacagccaaacttggtcccacagccacctaggcacgaatctccccctcaaaaggcgcttctggcggcttccaccttcatggcgtcacaacacaaattccaaaaaccaattgtccacccaccccatcacacttttagttgtgggcccacgtcacaacaacacaggccccgttcttccacatcgtgtttacacattcactatcgcaaatttaaggaacacttccgtagatattggccattgggcccacattctaccacggcccctacacgtggcatgccccccgtcacgcacaacacagctgggcttccaacgtagcggggccgcacacccctcaccaacagacacagacgcaccacgtgccgccacaccacagcgaacagcaccaacgacccacacacagaacccacacccacacaccctacacagccagcacaacacaccacactactcaaacgagcaagcagaggaacaccgagtgcctagatcacagcaccgccggcaccacttcaggaagacagaccacaacaccaacaaaaacgcaccagttgtgagtctgaatcaaaccaccgcactaaacagcaagctccaaccaagcaagagcgcgggcaccacacaacacaaaaacagactggagtcgaggccaccactctacgccaccacaccgcggactcgcgatccgcacacagacacaaagcaaccactcacatgagacgacgcagacctagagcacacaccaccgaaccgccaaagacgaataacccaacgacggacgctacatcggaggcccaacacaacgacagactacgtaccccacaagtacgacaccaccatcagcagtaccgcaccaacaacacacacaagcaagatacactatagtcagaacaa

SEQ ID NO: 519985 - DNA, 443 bp, Homo sapiens
  misc_feature (138)..(138): n is a, c, g, or t
  misc_feature (209)..(209): n is a, c, g, or t
  misc_feature (221)..(221): n is a, c, g, or t
  misc_feature (230)..(232): n is a, c, g, or t
  misc_feature (234)..(234): n is a, c, g, or t
gggctgatgggagcaggcatcgcccaagtctccgtggctaaggggctaaagactatacttaacagatgccaccctcactgcgctcagaccgaggacagcaacaagtgttcaaaggattgaatgacaaagtgaagaagnaagctctaacatcatttgaaagggattccatcttcagcaacttgactgggcagcttgattaccaaggtttngaaaaggccganatggtgatnnnanctgtgtctgaggaccatactttcaggcacagtgtggatggatgcccatagcaggcgagtgatgttgcagatcgctgatcctttgccaagtaacacatcggctccccaatcacgggcactcgcctgctcgtctagcgatagacctgagtagagctgatttgcatgctagatacttttctcccgtggacaagatacgcaggcagagagctt

SEQ ID NO: 519986 - DNA, 187 bp, Homo sapiens
ggaccccgagacatcctgcctgctccccatatcctgcttctggctgcgcaggatggcgctggccctgcggatggctgccatgcgcaaggtcggggcggtacttgtctatgcggactcatgtgtctagatagctgctgagcgtggcgcgagcaatcttgttagatggtggtccgcacataaggaggtg

SEQ ID NO: 519987 - DNA, 924 bp, Homo sapiens
  misc_feature (632)..(632): n is a, c, g, or t
gatgatttatcggtctaataacgacaatgcgtagtgtccgagtgtttttccggtcaagcagggtagtgaacacgcgaagaattacatgcatgcaggctttattttaaatgccgatacacattactctgttcaagctgcgttgagactgttataacctgggcttgctactatgaccttcgtaagaaactggctccacgaagaagtaatcaacacctgacaactctttgatgattcacatcaggttggaacctactgtaccactaatctgcatcaaggtggtctctttctgctctactagtgcagtgtttacgtcagttcttagttggcaataggttttccagttcgtagttctataagtcgtgtcttcatgctgaagaatctggtccaaagcatgtagtcattagtccaagcacttaaaaagtggcgctctagccacgtattgaagttctgtgtctacacttgtggtggcctacgaatgcggtgatcaagaagcgctccagtctttttaacagatgggcataggaagaccggcaaaacattttcctatacaggtgcaattagattttcaagatgtactttgctgcctgtggttccttaacacaatcttttgtactttacacgtgtacgggtgncacttgagcagatactgtgagggtcattcgtgtatggtgctagtttcaagtaagtgctaggtttaggcccttgctacacttttgccacataactttttacaacagtacttcttttattgcacagttcacgagaatctcagtatatactgtctatgttgtgcgtgtccttaaacttccaagtcttacttagtctcttggagattgttgaacgcagcttgtctaggaacggggattgggactagaattcttaaaatttcatttgggacccctggggaatgatagttggggaaga

SEQ ID NO: 519988 - DNA, 119 bp, Homo sapiens
ttacagaccacctttcacaaaacgaaatgctatgactgtactcttgatatctcgaactcgtcaaaaatatatcctcagtacaccagttgccaaagctcttgctgtctctaagagaaaga

SEQ ID NO: 519989 - DNA, 145 bp, Homo sapiens
cacagaaacacacaaaacacaaacaaacaaaccaccaaaacaaacaacaacaaacacagccaaaaaaacaacacaaaccacgccacacacacaaaacaaaaacaagatagaatagaactactattagggcgctaggggttttttc

SEQ ID NO: 519990 - DNA, 1576 bp, Homo sapiens
  misc_feature (1576)..(1576): n is a, c, g, or t
ttgtcgcgacggagccgggcctcttcgaccgtcttgagacggggctggcgagaagggcccctcacggagattgccaatgggcgtctaaccgcggcagccaggccccgtcatctacgatgagaccgcacggaaccacggcatggacgcatagactgacaggacggcacgaacacgcatgacgacgaccgaagaagggcactaccgaccaggaggacatgacacagaaaacacgagacaccatccgcacgtacacaacgagcaagcaggcaagggactcctacgagcacatggacgctcacgatgctacacaccctacatgacgcaccgagaggaaagcccacactccacaccgcacgcaaacaccatgcagacaagacactcatacacgcaccccaagggacagcacatcgcgaacgccagcaagcacatgcgcacgcacggcccaccaccgaccagcaggcagacgcagctgacacccagaaacgcgagagcataggacaacagaccatggaatacgagccagatgagcaatagatccgacacacggcgaaacacccaaagaataagaccaacaacagaaccacgccacacgcaagccgaagccacacgaacaccacccacagcaacacaaaccaaccatgaacaaacaagaacatacacctacaaaggtccatcaacaccggcacaaaggcggactaaaaaacaccaccacagacgcgacactggcctccaccccccgaacgacgaccacaagagagacaccacacagcccccacactgccaacacaagccaaccacaccaacacacgcggagccccacacacgcgatgcacgcgacggaccgcagggtcgctggtgaacccccaactaccgagacaccacacaaccatacaaagaacacccacagacacgtaccgaccacgcacacacggcagttgcgaacgagaccacgaaagaggacacgcggccgcagtgcccgcacacaagccccgcacgaccagcccccctgacacgcaacacaaaccagaagacaccaactgccacacccccgacagacaccacgaccgccaccccccccccacggcacagctagcgcgcccacgaccacccaagcgcccacaccgaaccacaccaccaccgcaccccaccccccgccacaactccgaccccagcaccaagagcacggacacacggcgcgcaagacaccataccacgcccaccgacgacacaaaccgaagaacaacaccccgaacacaacccacaacaaacacgcccgcactccccaccgcgcccaccccccccacacaccgcccagacgaaaggagcacacgacccaacacacgacgacgacacaaccacaaccgaagaccaagccaacgagccaccgccagccacgaccaaacccaacgcgaactagaaggggcgcaacaccacccagacgacaaaaacgaagccacacataagcagcacagcgcaagccgcaaccatacctacaaccacataaccacatagcaacaccccaacgccaaacacaaggacggaccgaaccagactatcacagacaaacagaaaatcn

SEQ ID NO: 519991 - DNA, 555 bp, Homo sapiens
tttgaggagctattttcttttaaaaatttaaacttttgtttttgtcctttttttttgagacaagttctcactctgttgcccaggctggagtgtagtggcacgatatctgctcaagggttcaaccaattctcctgcttcagcctcccgagtagctgggattacgggcgtgtgccatcacgcctggctaacttttttgtatttttagcagagatgggttttcaccatgttggccaggctggtctcgaactcctggcctcaagtgatccgcccatctcggcctttcaaagtgctgggattacaggcatgagccaccgcccccggccaataagctttttttcttaaaaagtactcagaagacttttctatccattcattctgttaacgcgcgtcagtgtgaagagaccaccaaacaggctttgggtgagcaataaagcttttaatcacgtgggtgtaggccgacttagttcgaaaaaggagtcagcaaagggagataggggtgaggcagtctttataggattcgggtaggtagtggaaacttacagttacagggggttt

SEQ ID NO: 519992 - DNA, 365 bp, Homo sapiens
cagttgcatgtgctccgtggtgttgagaagtatcgtattatctcctaaacagagtgaagacccgtatcaaagggcggctgatggtttaaaggaagtatgtacatggagtctaatcgagacatgcatgagttacatctcgttatgagccttagtagtgtgggataaccattctcaagcacagctggacgtgcacagcttgtcaagtatgctttctcaggcacgggtaggtaaagagtctggagaaatgggttctctccatgcccaatgacaaagcaagacggtcctaggtttgaggttaagagcaggtcccattgccgggcggtatccgcagctcacagctgagtttagcagtggaatcgagtgga

SEQ ID NO: 519993 - DNA, 230 bp, Homo sapiens
gacattgatggctgctgactgcttagggtggtggttgctgaaggttgggtgacagtggtaatttcagtgattttggtttggttttgtttctttaagagacagggtctcattctgtcactcagggtggagtgcagtggtacgatcatagttcactgcagccttgacttcccgggctcaagcaatccttctgcctcagtctttccagtagctaggaatatcaagaatcggca

SEQ ID NO: 519994 - DNA, 383 bp, Homo sapiens
  misc_feature (221)..(221): n is a, c, g, or t
  misc_feature (321)..(321): n is a, c, g, or t
  misc_feature (332)..(332): n is a, c, g, or t
ggtgtctcgctctgttgcccaggctggagtgcagtggtgccttggctcactgcaacctctgcctcccgggttcatgtgattctcctgcctcagcctcctgagtagctggtattatgggtgcgcaccaccacacctagctaatttttgtatttttagtagatacagggtttcaccgtgttagtcaggatggtcttgaactcctgaccttatgatccacccgnctcggcctcccaaaatgctgggattacaggtgtgagccactgcacctagcctatttatttatttttaattagagatgggatttcgccatattgcccaggntggtctccaantcctgggcacaagcgatctacctgttttcaggcttcccaaaagtgctagga

SEQ ID NO: 519995 - DNA, 725 bp, Homo sapiens
  misc_feature (266)..(266): n is a, c, g, or t
  misc_feature (524)..(524): n is a, c, g, or t
tttttttttctgaaacatattctcaccctgttcgcctaggaaactttattactttcccagtttatcggtgaggaaactgaggctttgaaaggccaactgagcctgtagggtggaggggcattatgacactgtgcccctgtgacatgtgtaggggtgtggaggctgtgccctctctcaccacctgtgtgtgtgtgacgcttgacgccacagccctcgtgtgcatctctaagagcgcgtgttcctttctcccaccacctctctctgtnggagaaatgtgtgagattgtgcggaataccacaacctctcacttaagggatgtgttgtggccagggatgtgtctcatcgaccccacatgtgcccacagtgtgatctcttctcacctatatgtgtgcgtccgaggccgtggagtgggtgtgggcataccgtgcttctccacttctcttctcctccgtggctatatttttacttatctctctctccaccgaggccaccctcttctgtgtctctctctcttataccatatnattttaagtctcacacgccgtgtgctctatatatgtgtggctctatatgtgtgtgcctgtgtaactctcccacatctctccccccaacatatgaaatctcttataaccccagaactctcatctcgcgtgtgcgcccgcgcctcaaatatatagaataggggtgccctcaggataaaatataggcgtgagggggggtattaa

SEQ ID NO: 519996 - DNA, 176 bp, Homo sapiens
gtatacctgacatagctctaggtcacagaccccacagtaggagggacgcataacattcattcatagttacgcctgtttaattctcaacttaccctttagttcggtcctgcaaaactaaaccactgagaaaaaaaatatcaggctgggcgcggtggctcatgcctgcaatcccagca

SEQ ID NO: 519997 - DNA, 590 bp, Homo sapiens
  misc_feature (9)..(9): n is a, c, g, or t
tcgtgccgntattttgaaaatgttctgtttgcaatcagatgcaagaacccaaagttagaaatcaggtttaaattgtgcattttttaaacagcattatctacaaattggaagaacacgaggaatttttcccagcatttcaggcatttactaatgatctacttgaaatcttagaatggctctttgcttttagaagaggagatgaagcttggtatgaaaataagggaatgagtcaatgaaaacttgataagaagaataagtgaaagaagtatctaattagaatatatagcctactgaacataaaggaagttttgtgaccagtcttatgtgcagtggggaagcaagggagacaatgagtgagcttgctttaggcttgtcctcatgtttaaaaagatcacagcaagtgaaaatgtaatttgaaagttaaacttgagatgaggtatgaaactgtataagtgtgttgtctgatatcctgaagagcctggtttcatagaataatatgattcttgctttgggattgctattaacttaagcagtgatgttctcatcattcataaatatttggcacattaataaacatattttaataggga

SEQ ID NO: 519998 - DNA, 626 bp, Homo sapiens
  misc_feature (9)..(9): n is a, c, g, or t
  misc_feature (285)..(285): n is a, c, g, or t
  misc_feature (325)..(325): n is a, c, g, or t
  misc_feature (328)..(328): n is a, c, g, or t
tcgtgccgntattttgaaaatgttctgtttgcaatcagatgcaagaacccaaagttagaaatcaggtttaaattgtgcattttttaaacagcattatctacaaattggaagaacacgaggaatttttcccagcatttcaggcatttactaatgatctacttgaaatcttaggtaagatctctggtggtgatggtgaaattttgagtcttaaaatgtcagtgcatttaagaaaagggtgttccttggtcactggattagtatttttacctagtggttggaaaccantaacagttctggaaacacattccttacaagcagttagagnttntttggattagtccatagaacagaaacacagacccttaacagcaataggaactacctttgttggaggaccttttcatgagagatggcatcattctgtccatgcctagtttaaccctggctctgtcattgctaatgagaaatattcttaggatttatgatcttaaaaggccctcctccctcctttttttttcttaagatacccactttattcaaaaatttttaaatattccaaatatatttcccctttgttttttgagggaacataaagtcttaaattctgggggaaaggaaaaaagaaa

SEQ ID NO: 519999 - DNA, 705 bp, Homo sapiens
ggacgcgctgggccatactgcgcccatagcggccgcgagtggcgctgcttggcctggcttggctctccagagggctgtgctcccacccggtctgcgcagtgccgtgacgcggccgtcttcgttgtggcttctgcttagcaccctggtgcacaggctcctgtcgatggtcatcctaggtgacctgtgtccaatcgccctaccacagtggtgatccttcttccagccgtgtgaccctgcccttgtaccttacctagaatgacctcgaagctccgcgacgtaaccacatctgtcatcatggaagtacaagtctttctgccgggaccgcatcgcctgatgccattctccccggccagcgtctacaaccagcttcaatgcccagcttggcagcctgggaacccaggctacaaccccatacgttgagtgccaggacatgcgtgctgcacctgtcagggtcgtgtggcaccaagcagggcaacgctgtgaccctgggagattactaccaggccggaggattaccatcaccggaaatgcttgacctgacctttgaccagacggcgtggggggacaagtggtgtgtattactgctccgtggtctcagcccaggacctccaggggaaacaatgaggcctacgcagagctcatcgtccttgtgtattgccgtcggcaaaagcagccaactcaggtgtacccagacatttatgaccg

SEQ ID NO: 520000 - DNA, 1048 bp, Homo sapiens
  misc_feature (568)..(568): n is a, c, g, or t
tgcccctcatttacataaatataatactagctgtaaactgtctcatcttctaggataggacatatgtatggatcggctcactacgctcatatgcctccctatcatatgcctagaaggaatgacatactgatctgcatgtctattatagctacatctcataaccctcaagacccattccctcttagccgaatattgtgcctattgccatactagtcgttggcggtctgcggaaggcatcgggctgggcctaagcgcctactaagatctacaatctccagagcagcagtagtggcctagacgtacgtatcgataatcgtacatctacttgccaacttgctagaagactaattgcgttcaccgaaacaaagttgatatgtactactcaactgagtattagactatcgcccacagagaagagcacaattagaatttctgaaactcgaaaaaacaaagtccaacgcacaggagggccctcaagtagagttagtcaatcagtgccacttcataacataatatgtgtatgtacaacccaaggaatgcattcgagagtatatccgtaattttaggncatgtgtccaccccggaaggcttttatgaccctcccgagaaaccccgcgtaagacaaggcgccgcccgatccttaaaggtacgtaaagactaaccgtggacgtccataaaccccatcaaacgacatcgatgggcaaaggccagacggccacgttttagtccaagatggagacccacataatcgacggaaagaagaaaactcataccgtcgtctaataacttaattcctccacataagaaaatcctccagttaaatcacgttaacaattgcaacaggccaaccagggaaagctaagtgcagtcatcgtctaataattcgttacttcacggaagagccagccatatattaccccaaacttggggaatactcaattcagccccggatggaggcaaaccagacacagaaagcgcctgaaacgccagggcaacaaacatcactaatgacaaaacacataagaaggggccagtctgcacctaagtc

SEQ ID NO: 520001 - DNA, 100 bp, Homo sapiens
acacttaagtacgacaagcatactaactggctacatatactaactaaagtaaattagacatgtcaagttaataccactacccaaaataccagagatccaa

SEQ ID NO: 520002 - DNA, 114 bp, Homo sapiens
gactctcaggatctctttatccccaacacgtaaccttcctgatcatgcatatttattttgagaattgaatgttttttggccaggtgcagtggctcacgccctgtaatcccagca

SEQ ID NO: 520003 - DNA, 366 bp, Homo sapiens
  misc_feature (70)..(70): n is a, c, g, or t
  misc_feature (79)..(79): n is a, c, g, or t
  misc_feature (275)..(275): n is a, c, g, or t
  misc_feature (352)..(352): n is a, c, g, or t
tgtcacccaggctgaagtggagtggtgccaccatggctcactgcagcctcaacccccaggctcagatgancctccctanactgccttctgttttctgagtaggtggctgggactacgggcatgcaccaccatgacggggtaatttttttttttttttaattttcaataccagcctggccaatatggtaaaaccccatctctactaaaactacaaaaattagccaggcatggtggcgcacgcctgtagtcccagctactcgggaggctgaggcagnagaatcacttgaacccgggaggtggaggttacagtgagccaagatcgcgccactacactccagcctgggtgacagantgagactctgtctc

SEQ ID NO: 520004 - DNA, 287 bp, Homo sapiens
agattattggggctgttcatattatgattcagaatcattttctattgtggtattataggttggttaaaatgatggcccttttgatgggttttgttgtgttttgtgaacaagtcgttactgtgtccattattggaatggaaatatccccactggatcatgaggggggatttttattttatgggtcccccaggattaccttttgacctggaatcaattaagaaaattttttgaaatttaatggatagggcctttatttatactccattaatttttttccaaaaaaaaaa

SEQ ID NO: 520005 - DNA, 186 bp, Homo sapiens
gttgggtttttgagttttaccccccactagttcccactgaattttgtaacttcctgggttggcatcctctgttccaattcggcccttgctttgtgtcatttcagtcatttgacttaaaaagtgcccttcaaaaggaccctgttcactgcggcacttttcaatgaattaaaatttatttttgtttta

SEQ ID NO: 520006 - DNA, 118 bp, Homo sapiens
  misc_feature (13)..(13): n is a, c, g, or t
ggtagatagtgtnggatacaaggtcctactaagatgacaaaagaagagttaaatgccctcaagtcgagaagcgatcccaggaagcattggaagcggagtgaggaagggaaaggaagaa

SEQ ID NO: 520007 - DNA, 462 bp, Homo sapiens
  misc_feature (17)..(17): n is a, c, g, or t
  misc_feature (240)..(240): n is a, c, g, or t
  misc_feature (406)..(406): n is a, c, g, or t
cccactcggtttttccnacgggaacaatgtgggcagggcgtgagcggctcgtgcacgcggaccgggcgttacctcctgccgatctcctctgccgcaggaactggatgttgttgcgctgtcggccagctcggggtactgctccaccgagagtacgtagtacccgtcgtagccctgcaccttgccggcgctcagcactgccgcttctcgccctccgtccagaggcgcgcgccctcctcgccngttcggcaacgctgctgctcgcgcgcccaggcccggagcgagcgctgtcgcgcctgctccaggatgcgcgccttctcctcgtccagggtcatgccgtagcgcacgtgcacgccagcgcgccgaactgcatctccacgtccgcgaacctgcgcgtcctgccgttcancaccgtggtggactgcgacaccgtcacgttgatgccgttctccagcgttgcggcgc

SEQ ID NO: 520008 - DNA, 1103 bp, Homo sapiens
gggaacgccttctgggagatgaggacacctaaggctgggtagacgtttttaccagctgaaggacattgagggtacatcctaagtttctatcatcaaggtagttctgttaggctatttcatatattcatgcccaaattagtggtttgagagccgtgcacttacctgaggatggcgaccattcaaatgtctaccatatgtcaaggaacggtaacacaagtgacgtgacgacacggaacgactgtgagcggacgtacactatacgactgaagactgctcctctctaggggggcaagggctcctctgttgcaagcctagcatttctgggcaagaatgcatgccctgtagtgatcaggttgtccagttttgtacggaggagccagaacttctgatttctagggtaaatatctactgatttttacatgctgatcccttattcatctttttcacagtaatccagatcccaaatatgggctccgttgatgagctgtctcttaacttcccattggtcttttcaggccagtgcttaatgggatccttcactacagcactcaggctcccattgctccaagacagccactccactgaggctctctctaggaattgacgtggttcatttacttgagtcatcgaagacggcttactctgactaccacaaaggaatttggcgcgacagtacacacaagaattagagccaagagactatgagcggcctacatcctccttaacactgactgcatactgctactatttcaacttgactcgcgcctaattaccatccacatcttcggaccatacccgactcacacgtctgcactccacacgaaatcaaacctcaataccttcctctccccccccaccacttcttcacatacatcaaaacacataaatcgtcgtaacagtccagtcaccggtacaaataagctccccgctccaaattacaagactcttacccacaagcaaaagataaacaacaatctacaacaatcactacaacgtctcaattctatacacacttcttttcatcaatcttcaaaatagtaataaactctagtaaaatctcagaaacacactaatcacccagtaaacgtacctcaaattcatcc

SEQ ID NO: 520009 - DNA, 175 bp, Homo sapiens
ccgctgatggcctcaggtggaaacaggctgcggtgggtggggatgagggactcacacagcattcctggaccggtagctcagaaattggacccatcgagtcctgacttctggatcgcggggctggggcaggttggtcctgtcgcttgtcttttacctacttggtctctcggatgtt

SEQ ID NO: 520010 - DNA, 493 bp, Homo sapiens
  misc_feature (112)..(112): n is a, c, g, or t
  misc_feature (126)..(126): n is a, c, g, or t
  misc_feature (128)..(128): n is a, c, g, or t
  misc_feature (133)..(133): n is a, c, g, or t
  misc_feature (140)..(140): n is a, c, g, or t
  misc_feature (290)..(290): n is a, c, g, or t
  misc_feature (328)..(328): n is a, c, g, or t
  misc_feature (348)..(348): n is a, c, g, or t
  misc_feature (357)..(357): n is a, c, g, or t
  misc_feature (359)..(359): n is a, c, g, or t
  misc_feature (364)..(364): n is a, c, g, or t
  misc_feature (385)..(385): n is a, c, g, or t
  misc_feature (391)..(391): n is a, c, g, or t
  misc_feature (415)..(415): n is a, c, g, or t
  misc_feature (440)..(440): n is a, c, g, or t
  misc_feature (449)..(449): n is a, c, g, or t
  misc_feature (460)..(460): n is a, c, g, or t
  misc_feature (472)..(472): n is a, c, g, or t
  misc_feature (475)..(475): n is a, c, g, or t
aggaggcctgtgatccagctccctgcctagcatccatgacctgttggatgttacctccaatcagtttcctgtcctacctcctctttggcttgacctatatgcctttaggggngcctttcttctttntnggggngcccttntctaaccccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtntggcctggggtcgggtgaaggagggcccaggtcagttntggggtcccagtgacctgcnttgccattntnctggngccgctgctgctccctgtttntggagntggatgttccccagctggcagttnagctgcctgagccaatgtgtctgtntttggtaantgagtgaaccntaataaaggggnacntttggcaaaaaaaaaaaa

SEQ ID NO: 520011 - DNA, 515 bp, Homo sapiens
  misc_feature (293)..(293): n is a, c, g, or t
  misc_feature (296)..(296): n is a, c, g, or t
  misc_feature (317)..(317): n is a, c, g, or t
  misc_feature (322)..(322): n is a, c, g, or t
  misc_feature (348)..(348): n is a, c, g, or t
  misc_feature (363)..(363): n is a, c, g, or t
ttattcgtgttgcactacacgtcaatgtctttcaaaacagtacttgaaagatactgactaggtcaggcgtggtggcgcacgcctataatcccagcactttgggaggcagagacggacgtatcgcttgagctcaggagttccagaccagcctgggcgacatactgagactctgtcttgtataattaaattaaaatttaaaaaaagaagagataaagacccgtgtttaaaatttttaaaaaaggggggaaagtgtaatgcaaaatgtggactatgccagctatgattgggaaaantantttttcatacagcattatctntaganttgtattagcagcatactggtcatangcgttttgctttccncaaatatgatgtggtaagctactttaaagtgtggtggggctttcttccgcatggctccttgaggggttgagtcccaatttatccaattaatttgggtttagttttgatatggataagggagaccagcttcattcatggtgcaacacgaataa

SEQ ID NO: 520012 - DNA, 255 bp, Homo sapiens
tatgtgctgaggtactctcgaggattcagtgctactccacaaaagaaagcggatagtggattccgaggcaggtgcagaaatgaggagcgcggagtgaccggtcagtggggagggggattctttcttggagtgaacgggaacgttctgaaatgaggtcgtgatgactcaacaccatgggcctgtacacttgaaaagggtgaaattggatgatatgagaacttcatctcaataaagcttgtttgtggaggtagcact

SEQ ID NO: 520013 - DNA, 278 bp, Homo sapiens
tcggccctggtgagtcaggtctgggggaaacgacgatgatgttggtcaaagggtaaaaacttgcagttataaaatgagtaagttggctggatgtggtggctcacgcctgtaatcccagcactttggggggatgaggcgggtggatcacgaggtcaggagttcaagaccagcctggccaatatggtgaaaccccgtctctactaaaaatacaaaaagtagccaggtatggtggtgggcacctgtaatcccagctacatgggagacctgagcaagccagg

SEQ ID NO: 520014 - DNA, 310 bp, Homo sapiens
agcaactcaattccaatctgtacaacctaaatagtagttacagtcctctattgtacaacatagttacactacatacacaaatatacaatacagccaaacaaccttccatggtaagatagcgggaggtacccagctaactatcaccatttagtcactactcatagtaaagtagtcataccatagttagagaagaaagaggcacagtactaatcgtactatatgaattttcggtgacagttgtcaaatttgtacagtgaaatctgtaccccctcattttagtctttttaccctcctttcaagttcctcctgg

SEQ ID NO: 520015 - DNA, 150 bp, Homo sapiens
aagtcgagaagccagctgcctgtgaggtgtgtagcttgcacatccagccaagatgccacgtcttgctcacggaaccatcacatactcataacctagaagttttaccatgtaaaatataccatcacgctcatctgtgagttacttgctatt

SEQ ID NO: 520016 - DNA, 297 bp, Homo sapiens
gaggatccccgctctgcgtgagtaagacagacagttgcggtgggtgtcatcaaagcagtggacaagaaggccgctggagctggcaagagtcaccaatgtctgcccagtcaagctcagagaggctaaattgaatattatccctaaatacctgccaccccacatcttaatcgagtggtggaagaacgtgtctcagcaacgtgtttgtttcaagtgggccatttaacgtttagatagtaacaagactggttaatagataacaatgcatcgaaaaaacctatcagaaggaaagcgagaatg

SEQ ID NO: 520017 - DNA, 210 bp, Homo sapiens
ggattctatgtttaccatgtgaccttctgcagcactaaagatatttggaatatcaatcatgatgaggcaatttctgtataaaacgagccttgaaatggaacattgttgttgagatcaaatctccctcactcctcatcaaaaaatggtccacgttgcaataaaatgattgtgagcataattacataaataaacaaaataataacatacagg

SEQ ID NO: 520018 - DNA, 83 bp, Homo sapiens
  misc_feature (5)..(5): n is a, c, g, or t
  misc_feature (35)..(35): n is a, c, g, or t
agagncaacaaaggtctactgatgtgagaacattnggccccagcaacacgtcattgtgtaaggaaaaataaaagtgctgccgt

SEQ ID NO: 520019 - DNA, 912 bp, Homo sapiens
tggcactgggcgttggagctgagcctgatcgcgagcagcaggcgtcagtcacttccaggtcgtgggggcactcaggtccagcagaccacctgacctcatgcccctatggacagcgacctctcatgaggatgaggacctgcagctggccatggcactacagccatgtcagagctggaggcagctgggaagaaacgccgcgagatgtgttcttgcgctggatgccgtggttccagaatcgctgcaacagaatccaaagcagagacacgacgccatatacacacacacatgacgctgagagagggggacaccatccaatattcataccacaccatcacaccgagtgacatgcagtgtcgaacgaccggaggacctgggagtggcggggctgagaaggcccagagagtgagacaggtagagccaagaaagactacaaagcacatgtaggcacaacacctacataccactatgaggaaagataaaggagaggactaggcatacactagagagagaacctaacaaaaaaacacacaacgagctagacgcagtagtgaccacagggacatccaaattaaaccgttggaaattacgaaaatacagcccggacactcaggacagcgcggaacgcagacgaggaaggaacaatgaggatgacacgagacacgccatgagagaccacaaacaaataggagaaacaacacacaatggacaagcacacgaacgccaccaaggggccaccggcgcgatagggagccagcacacacgaccagcggaaagcagaaaaatgagcacgagacaacacccaagagaacggcacgcaaacataggacaagaagaccctcaaccaacaggaatacaggcgaccactagacacaagcgggccagtcaagacacgcaaataaacaaccagcacga

SEQ ID NO: 520020 - DNA, 1015 bp, Homo sapiens
ggagaggctctctacctggtgagggtttgctggggaacgatggatgtatccctgcgcctggccactggttgcatgtgcctgctggactgtgcttggagctggctgggccttacatgcagctcggagttgctggagtggccaggagccgtgacggggtgctgctttgacctgcgagatggtggctgctgccgcctgtgggaagcctgtgtcctggtgcccatgtcctggtgggtagagaggaagtggagcacatgatccagaagaaccaatgtctcttcagcaacaaccagtgtaaaggttttgcttgctgccttgcttatctctctgagtcccagaacgctggcacattaaccagagcaaaaaacattgcccaacacacagctgacagagataccctagcaatccaatggaatggagaccattacacagggggaaaccgaagaagctagactcagatcagctggaaagggctacccctgcaagacattgtaccgatacgttgctgaactccatagaacagtaccaatgctcatgtcagcggcttcaaaacacaacgaacccagtcaccaagcaacaagtggcatcatcccttgtggccagattccaactgcaaagggcaacccattcagaaagactcaagcacttggaagactagagtgtgattctggccaggatcccatatttgggccagacatgagccagcttaccgtgactgctcagcccttgggtccctcttggtcgttgtctcaccaggaaagtacacggtgcctgaggcaggattgggccacagacagcctctcaattagggtcccggggcttaaatttcacctccgttggtggctccccctttctggcaacgggaggtccttggacggtcaatgaccagcggcacgcgcagggcgtatcggcaagcacctcgggcggacatggaggggatcgacagaatagcgaccggatgccatactcccagacaccacaaaccgtctcttgacgcgttacagctgtcacggccact

SEQ ID NO: 520021 - DNA, 954 bp, Homo sapiens
tcgtgaaaactacccctaaaagccaaaatgggaaaggaaaagacacataacaacataagacgacaaaaacacaaaaaacaaacaaaaccaccacaacaaaccaacaaaacaacaaaaacaaaaacaacaacaaaaaaaccaaaaaaaaaaaacaaaaaacacaacaaaaaaaaaacaccaacaaaaaaccaaaacaagaataaaactagaaagcaaagcgagaagcagaaataaacaccagagtgataaactaccaatgtggaaatttgtgatggaccaggcaaggtacaaaataaacaaacataaaaaaagccccatagacacaagaagacaaaagacaaaaacatagactaacagtggacatacacagaacaaacgagagctaaaccaaaaaaagaaagcaagcgatttatataggaaaagaatgtagtcgaagtaaacgaccaatgaagaggacagacccgagaagcataacccattacaagctaaacacacagaggtagtgaaacaagtaataaagtacgggagagaagcgagaagaaggagatccagcgtagagccacccaacagccgaaagagagaaagcgggaaagaagagagggaaggtcatgcgacgatacgatttaagaagagagagaggctacgaggcccgagacaaggagcagaaagaccagaacaaaagaaaaaaccacaacaaaaaccccaaaacaacaaaccaatacaccaaaaaaaaaaacccctaaaaaaaacaaccaaaaaccccgcaaaaaaacaaacaaaccacgcgccaaaccaaacaaaccgaagccaggcggccggaactacaccttgtggggttgtgcttgtcttgttggcggtgggtgggttcttccgttggggtgcttgtgtctgcgggggggagagcgggtgcgccgtggaggagcgggcgggcgggcgggcaagacgggacgggtg

SEQ ID NO: 520022 - DNA, 195 bp, Homo sapiens
aatgggagcaagcatgtgtattatgtgcgagtactatactggaatctatacacatgagaatcattcattcattgtgcctccttcaaagaaccctcaaaatcctactgaactgtattacactgttaaagattatgtgcaccatcccacgtatatttgtggcattttatgactacccagcataggccccggtaggca

SEQ ID NO: 520023 - DNA, 145 bp, Homo sapiens
aactgaacggaggaggaatgtcctataagataccatatgacagacaggaacccacttagagtggcacacaaatcttgacttccagctggaacagtacatctatcacaggccacgtgatggcatctatatcataaatcacaagagg

SEQ ID NO: 520024 - DNA, 985 bp, Homo sapiens
tccattggcatttaactttatatttattttggcttaaaaaatgcatatccggtccacgcaaaaggtgcaaaggacaaaaaccaggggttaaccttgggctgattgaaaaatctcaagccagggagtgacatttcatagttctcagtgaacaaccataaaactaggagaaaattagaaaagtcacagcgtggttaccacagagcacgcccaatttcacagcgtgtcctcctctatgaggaccttgggctaggggtgaagagaaagcctgtgtgaaacacgaggggccctcttaggtggactggcgcttacagtgtggcagaatcttcttcttttctacccaatcttcttataattttctcttcgagatctcagggctaccgtcgctctccacaaagagcctccaactcaagagaggcggtgtttcaacaaagaagaggtccccagaattctagtcgccaatatatacccccagaaatttccctctattctcctctttgtggggatacaaatattcaccgcccatatattatataccagccttaaaaagtttcccctcatatagcgaggggggcggcggtctttcgcccgtggaccaagggggcaaagaggggcaccgcgcggatggaacaccctatacaaacggcgcccaatatgtgtgacaacataagacactcccataagggggggcgggggcaccaaaagacagccggagcgccaccgcctcctatacccccgtggacagcccaaaacaacacacgggggcacccccgccggcatctcgggaaccaaacggggtgatacgatacaaaaccaccgagagggggacaacgccggtggcagccacacaagacacagaacacacaagcgggggggcggcggcgccccccaacagaatagtcccccgccgagaggggcgcccaaaagactgatcagcgcggatgacccgggactcttatcctggggcacaaacgcggggcgcccccct

SEQ ID NO: 520025 - DNA, 821 bp, Homo sapiens
tgcaataatcacgagacctgccaggagactcttgtagataccttgacctagaagaagtacggaactttctcaatgccttgttacactgtgtcccagccttggtcagggatacaatgcaccttaatatgggagcccagtgcaagagggatactcatgcggcctcactcaggttgtaccaaataaaattgtcatcacttgctatttgcttgcacttaggaatcctcttctgtttcctaaacccgtagagagtttctggaacgccatgaacccgtgagctgtgaattccactttcgtcattgcaggtagatggaggaatgacctacgacaaagttcttatgcagctacaagcagatattcatcatattccagtaataaaaccctctatgccgtgaaacaactgcaactaggagctggccatggcagcaggggtctgacagaagggagtaagcgtttggagccttggaaccacaggctttgtcagttctcaggatggaacgatttgaaccacagatccaggccacagaaagtgaaattcgttatgccacatggaagaaagccgtaatgaactctatgggttgggttaccagtcagtctcggctgaaggcggtgatccttctatcttctctagtctgcctttgggatgttttatagtgagtagcagtggtaatgcctaacttggagcaagatatatctcgggtgtgccataataataagcgagctatggagatcccacagaagtatacattgttacataacctgaaagcatatagcagttctgcctcttaatatagattacagtattataggactctgcttttgtt

SEQ ID NO: 520026 - DNA, 945 bp, Homo sapiens
  misc_feature (1)..(1): n is a, c, g, or t
  misc_feature (68)..(68): n is a, c, g, or t
  misc_feature (91)..(91): n is a, c, g, or t
  misc_feature (95)..(95): n is a, c, g, or t
  misc_feature (99)..(99): n is a, c, g, or t
  misc_feature (103)..(103): n is a, c, g, or t
  misc_feature (107)..(107): n is a, c, g, or t
  misc_feature (109)..(109): n is a, c, g, or t
  misc_feature (123)..(123): n is a, c, g, or t
  misc_feature (125)..(125): n is a, c, g, or t
  misc_feature (241)..(241): n is a, c, g, or t
  misc_feature (248)..(249): n is a, c, g, or t
  misc_feature (256)..(256): n is a, c, g, or t
  misc_feature (274)..(274): n is a, c, g, or t
  misc_feature (308)..(308): n is a, c, g, or t
  misc_feature (312)..(312): n is a, c, g, or t
  misc_feature (335)..(335): n is a, c, g, or t
  misc_feature (340)..(340): n is a, c, g, or t
  misc_feature (346)..(346): n is a, c, g, or t
  misc_feature (349)..(349): n is a, c, g, or t
  misc_feature (365)..(365): n is a, c, g, or t
  misc_feature (368)..(369): n is a, c, g, or t
  misc_feature (393)..(393): n is a, c, g, or t
  misc_feature (402)..(402): n is a, c, g, or t
  misc_feature (419)..(419): n is a, c, g, or t
  misc_feature (425)..(425): n is a, c, g, or t
  misc_feature (446)..(446): n is a, c, g, or t
  misc_feature (448)..(450): n is a, c, g, or t
  misc_feature (465)..(465): n is a, c, g, or t
  misc_feature (484)..(484): n is a, c, g, or t
  misc_feature (488)..(488): n is a, c, g, or t
  misc_feature (493)..(494): n is a, c, g, or t
  misc_feature (745)..(745): n is a, c, g, or t
  misc_feature (804)..(804): n is a, c, g, or t
  misc_feature (869)..(869): n is a, c, g, or t
  misc_feature (889)..(889): n is a, c, g, or t
ncagaatcaaattgccctaagtcacgaacatggcagcaaccgcaactccttcgcacttgtgcatgctntcgtgcgctcgcagacgcacacncacncacncatnttcncnctctctcttatgcncncatccatccacatcccaacaattgcaggtgctaagtttggacataacccacgggactcttccctgacttctgtcaggtcctggaaagaagaagtaataaatgaaaagcagctgggnctgctcnntgcatcnctcctcttccaacaatgncgcggagaaggcaagacatacactcggggcagcnagcntcctcggcaccaaaatgaacagncaacnacaagntcnaggcagtgtttccagntcnnctcacgcgttctcaacaccacttnccaacaccncaaaacagtagcaagcnggaaancaaaacacaacaacaaaaacncnnncgtctcgccccccangactccagaaaaaaagggnaggnggagnncttacaacttgatccctattattctaacaaattgcagcatgaccataagcaaaaccagctcggtcaaactgacagcatcagattgtgaccttatctgaacagtgtagttcacttttattttggctctgaagagaggaagaaaaactttttagaggaacttaatggtaacataaaccaaatctccactatattagtatttgagacaagattacatctatgcattcacacagcttgtctgtagatctgagagntccaagggagtggcccagcccccattactctgactttagccttctgaaaagaacaagtnaaacctgaaatatgaaaaataatacctgaatcaaaatggtgttttctatacaatcggactagggnagaatcctgctcaatcctcnactcctatttgacacaaagttaaaaaatttttaactaaattaaatgtgatgttttg

SEQ ID NO: 520027 - DNA, 1174 bp, Homo sapiens
ttcttgtcttctttttcgttttgtctgtcacgctgctcctttctgtccttctttctctgttttgttttcttgtgcgtgtccttgtcttcttctctcttttttcttcctgttggccccctctttttttcggtctcctggttgcgcgtcttgttttcttcccttcttcgtttttttcttctgttgtcgcctggtccgcttctgtgcttttttcgctgtcggtttcctcttgtttacgttcttcttgttctccccctctgtggttcctttttgccctggtgtcccttctgctggcggtgtcggccgttcttttcgtctcgctctttcgttgctcttggcttgtgcgtcttttttcctcttttctggtttatcggtttgttgtttcagtttagcccttttttcgcctttttttttctctgccttggttgtactactgtgctctgtctatgtgtctattgttcctgtttctttatcttctgtttgtgccctttctgtctgttgcttatgcttttttccccttgtattcctcttttggcgtttcttatgctggttctttatcccttgcttttttgtggtttctttattgggtgtccaagatagtctgttttatgtaagtggatgttttctatccttgtttgcctctgtttctctttgttaatttggtctactctacactatcttttatcttattgtatcttatctcatgttttcttttacttacatatattatgctacataattatcgcagcctatatatttgctagttagtgtagtcaatagtatagtatagtatggctgaatatttacataagtatatatttctatatatcttagatatttctctctaagcatgtgtaatataggatagaaggatatgttcttgccctagtaatcttaggtaatcaccactgttcggttatatatcactgcctcctgaatcgttgaggagtcttttaaattagtatttttgttttgttgtctcccaagttaatattatattgagatatcagagagtcaggcaaaataggtaaaacttttatctctagggtatataaacatttagaaaaatgtattcagtgtatctaatactgaaatgcggtaccaaatttaatgttaaaatatatatctatagacattgacatggaaaagagatttaatgttttgaataaattaactc

SEQ ID NO: 520028 - DNA, 117 bp, Homo sapiens
atatgctgctgctgttatctgactctagagtgatccccctagttttgtaatgtcatagcagattacatgagaaatgaaagatagctctgtgtttcatgttctccctgtgtgtgtacc

SEQ ID NO: 520029 - DNA, 425 bp, Homo sapiens
  misc_feature (9)..(10): n is a, c, g, or t
  misc_feature (22)..(22): n is a, c, g, or t
  misc_feature (35)..(35): n is a, c, g, or t
  misc_feature (97)..(97): n is a, c, g, or t
  misc_feature (111)..(111): n is a, c, g, or t
  misc_feature (129)..(129): n is a, c, g, or t
ccttgggcnnccccgggttgcnggcaagaacttcnagaacggaaagaaccaccagaaggggctttctggaaagtcccttccgccacggaccccattntgcaactgagaccncttccaaaggttcccccncaccaacttggccttgaccccattccaagtatcctggcatggttggaccccgaagatgatcggcccatcaaagaacagccacgcaaaacggagaacgtcagccgcacccgaagccctggccgcccaactcaccgctgcgccccaagcatcagtgtgctgcaaaaccaaggggcttgctggtggggaccgtgccagccgaccactcagtgcccggagtgagcccagtgagaagggaggccgggcacccctgtccagaaagtcctcaacccccaagactgccactcgaggcccgtcgg

SEQ ID NO: 520030 - DNA, 576 bp, Homo sapiens
  misc_feature (394)..(394): n is a, c, g, or t
cctcctccccccccccacagggttgggtgttggtggggggggaggaggcccccccaccccccctttttttgtggggggccaaaaaaccaaggggtgtggcccccccccctcccccccccggagggcaaagggggttcccctctccacaccgggggtgagggggccttgaggaggggggcgcaaaggttttttccatttcttccccccggggggaacccgggtgttttttttaagggggggggcccccctctttttccccccggggggggtttttttaaaaaacaccccaggggaaggggggcccccccggggtttttccccccccccccccttttttttatttttccccccccccccggtggggggggggccccttttccccccccctttcccnttgggggggttttttgggtccttagaaaatggaccccttttccccccccaccccttggggggggggggggttccccccccccccctttttggggggggaaaccttttaactgttgggtttttttcccctaaggtttcttttcccgggggggttttggcccccaaaattttttttttttttta

SEQ ID NO: 520031 - DNA, 172 bp, Homo sapiens
cggcccggtagatcatcctacactgacagtgtaggaatgaatctactggcatactttatatcttctggactgctcttttcacctaatggatgttcacccttcttttcctattataatccagcagcatatatctgaatgaattataataggaaaagaagggtgaacatccatt

SEQ ID NO: 520032 - DNA, 723 bp, Homo sapiens
ctgcctcagcctgggtctggtgacagagtgtgactgtgctaaaaaaaaaaaaaaaaaaaaaagaagaagaagaaaatagtgtcgtttaatttccatgtgtgtttaaaaagtatttctaaaattaagaggcctgagttaaggctgctaagtggtgggacctcagaacccatagtttgcgtgtttctggatatgttctctcatagataaaattgagaggcttggagtaaatgggcctgagcccataggggttttgcccaggttgtaacatctttattatagtatttgccaggactctttagaaatcatggagggtgcaggacgagagaccttttgcagttgagaatttacagggaaaattccttttcctctttttctacactttttctccattaggcattcttgtgttgggtgccctagaatttaaattggggggcacattggacgggttgggtcctccgtgcctccttttagttaggattgacagaggttgctttctttcgaaagttctggtggtgtcaaacaggttttatttctcagccactagccctcttgtgaatttgccagctcaccgtgttcttgtcccgtggtaggtaggggcagtctggatttccaagggccaactccaggagggaggcaacgcatggctgtctcccagggtaccttcctgcctcagtttgccccagaaattttccttgccccattggctttccttttatgcgccta

SEQ ID NO: 520033 - DNA, 292 bp, Homo sapiens
ttaacaagcctgcccaggtttgtggtaccactttgatgtggaactaatggtgacatcctgctttcacaatgttctgatctggtcaggcgctgtggtcgagcactcatggggaggtgctcatccgaaacacacgggacagctcctgccactgcaagatcactttctgcaaggccaagtactgcagttccaatgtccacgaggtgcagggcgctgtgctcagtcggagtggccgtgtcctccaccgactctttgggaagtggcacgaggggctgtaccggggacccacgccagg

SEQ ID NO: 520034 - DNA, 214 bp, Homo sapiens
tccagttacaaataagatttctaggtccataaaaaggagtctcaccgttttctttcttatcatgtttttcttctttgactctcctatgcttgccgtgttcaggagagaaaaagactgaaaacaaatgaggtcaattaaggaatcttctaagtataagaaaatattaatgatggttcattctgggtggtaggtatgggtaggtatgatgaggacg

SEQ ID NO: 520035 - DNA, 188 bp, Homo sapiens
gcgcttacaaaatatcaagtaaaatgcccggttaaaccttgatatatcaagcccaatcgctaaaaatgccggtctcatcgcgtttgtaatgtaaacgtttacatgttttccgtgtgactttccagtaaacgttaagcatctgggtgacgtgcacgacatttaccacaggttcaccacaaaaagcaccg

SEQ ID NO: 520036 - DNA, 483 bp, Homo sapiens
tagtcataccattcagtatgtttgctttttaaaataagtaaccacaattaagttgttgtagcccttgcacttcaagagatctagtctttactttcagttgtctgttaggtccattctgtttactagacggatgtacttaaaactatgagagcctgtatgtattctcagcactatttagtggtgtctgtcatctggaatggattagttcctaattgtataatgggtcagtccgcgatagctttaggggataaaggatttgccttgtatagagcagttcataaagttgtgagctgtgcaatccataggctgtaagctcttcagggagcaagaggtgcgctttctgtagtgtcaaggatcttttttacaggtggttggcagcactatgtttcctgtggaggttacagcacctttggtttaaagtggttttcaaatcttttcaaatggtcccgttaaaataaaacccattaaagtgaagcaaaagtg

SEQ ID NO: 520037 - DNA, 105 bp, Homo sapiens
cccgccagtagagatgatgaatatcaacagcatcctgcaaaataactgtagtagcctccagtttttaacttcttgtctcaactcatcctcagtctgctatgttgg

SEQ ID NO: 520038 - DNA, 894 bp, Homo sapiens
tgtctagaggatcccgcgtggttctgcagaagacctggaggcacgaactggaggtgggctgagcggggacatgctcactatcaacgggaagggatcatctccaataaagacatcctagccaccaacggggtgatccactagattgatgagctactcatcccagactcagccaagacactatttagaatgggcgtgcagagatctgatgtgtccacagccattgagccttttcagacaagccggcctcggcaatcatctctctggaagtgagcggttgacccgtccatggctcgccctgaaattctgtattgccaaagatggaaccccatccgaattgatgccgccatactaaggaatttgcttcagtgaacgcacagtaattaaatgaccagcatggcctctagagtatctgtaccatggatcagacctctgggaaacgtctgggctggcgaaaaggaaacgtgagagtttttgtctagatcagtaatagcctttgcattgagaacagctgcatcgcaggtccacgacaagagggggaggtacgggaccctgttgcacggatggaccgggtgctgacccccccaatggggactgtcatggatgtcctgaagggagacaatcgctttagcatgctggtagctgccatccagtctgcaggactgacggagaccctcaacgggaaggagtctacacagtcttcgctcccacaaatgaagccttccgagccctgcaccaagagaacggagcagactcttgggagatgccaaggaacttggccaacatcctgaaatacacattggtgatgaaatcctggttagcggaggcatcggcgcccctggtgcggtaaagtctctcccaggtgacaagtggaagtcagttgaaaaaacatgtggg

SEQ ID NO: 520039 - DNA, 106 bp, Homo sapiens
cccggctacagctcctgagtagctgggactacaggtgtgtgcaccgatcagctaattgtttattagtatttattagtagagaccggttttcaccatgttggccatg

SEQ ID NO: 520040 - DNA, 485 bp, Homo sapiens
cgcgttacagagtagaatgggaccactaagtaggttctcatcctaagcttgcaggcacaaagtgctagccgggtgttggagaagtagttatggtatactgatgtagataaggtaatacaggatctagtgggagatggcattggactggagaagggacatatgtgacccacaataattctggagatgacactcctgagtcatttacttctctgcccatgggaggtgagaggtcagctgacatccttcccattccaggtggatcaccaggcccaaaatcaaagaagtagctaccaaactccaagaggcagaagtccctgtcccagcacagaagatcatcctggggcaaagagagcccatgggatagtggaggggatactagtaagatgagccccagagacagaggatggaggtgaagtgaaggaagcacagagacaccaatgctgggcccagctggacacagtgagctgcagggacctcgtctcctc

SEQ ID NO: 520041 - DNA, 115 bp, Homo sapiens
ctctaggccttactttgtagaccttcatcaggatttgctgaacatgcggtatataggctgagcaagaggtggtgatgttgatcgcggttatcgattacagaacaggctcctctag

SEQ ID NO: 520042 - DNA, 102 bp, Homo sapiens
atcccaccgctactccacaaacagtgtatatccgcgtaatgtggtgtgttttgtgtgtgtgctagtatgtatagtgtcaggcgtgatgtgctgtgtgtggtg

SEQ ID NO: 520043 - DNA, 1254 bp, Homo sapiens
  misc_feature (235)..(235): n is a, c, g, or t
cccacgcgttccgaccacgcgtacgcctcatagtaccgagttctagtcgcaagtggcgttcctaaatgcttaccgagacgaatagaatgctaggctatatacagactacgcgagaaggctgccaagcgtgttgataggcccctacgggactacgtacgaaccctttcgcctggagcgccataaaactgtcgttcaccggatagtagcccactagaacccgccactagtctagcantcacccgtctacatgcaccgctcccgacacattagtctcgtcaacagtcgacgtcttgctaggtaatgaagcaccgctccgtgacctataagcacaaagccctctgtgctacaaactggctaaacataggcgcttctcttaatctaattaactatacacaaacatctaagcccagaggtggccgggtaggaactagcgacttaccctgctggaaatcccgcgggtcgtaagctccaagcgaagagtccgaagggtcaacgagcaaacatggacttcggaaggcccacggaggaaagaccagaagataccgccaagaatgaaggcccacagtcattcgaacaaggtccaacttggttacgtcccattgcattggcgtaactgtgactacgaatgcatgatgaacttaacattgacacgttcgagccatccacatgtcaaataacgcgtgctaggggacacttcgtgttcagtgcaatccaaaacaggtcacttgataacaatcccctcatgcagactttaactagcgcagaggggcccactggcaagtgagaagggcgcctagagcatgccacctacaaggtaccgagaggaaagagactactggacacaaacgcaacagaacctgcaggaaaagaaccccaaaacccaggggggtcggccacaactcttccgggaccttagcaggaccggaaaaagcagagtgcacgtaaccaaggaattaaaagacctacatggcccgtgcgttcgggaagaacagtccggcccatatgggacagatccggccaaggggtaaacccaacgaaagcggaacgacaaaaaggtaagggcccaaggaaggcaagacacgacaacggaaaagaaggcaataggaaaggcaaaacaaggagatagaacagcgaacgatgcgaagaaaacggaagcaccaacatggaaaggaaaccacgaacatcgggggaccgagcaagacagtggccgaactggaacagagcatcacacacagaaattaaataatggaagaa

SEQ ID NO: 520044 - DNA, 1245 bp, Homo sapiens
ccaaggccttatcctttggggtcaccagctccttgggtgcagagtgttagtagagggtggagagggacctttatctcccaaagggcgaaaaaaaggccaggtcaaaaatgaaggattctcagcccggataagtaggcaatacttctaaggattctcagcccggataagtaggcaatacttctaagggtgctccaggaggtgaggaagggcacgcttaaaatacgtgttttggacctccggagcaggatttccaatggagagggaagagaaactcgttcttgaatgggaagagagtggggaggtgcagagtaagaaagtgggaacgcgtcagtcccttccttgcaggagaggtggcggcaggagggggctcccagcagctacaaatcccaacactgcttggccgcagagaaaatgccctggccaggaagccggcttgggggtgttgtgattgatcaccgtactccggcctccgtcctgaaccgtgacgggggcccgaggccgaggaagatcggagcccggatagaagggttcggcctgagagaaggcagtcccgggcctgaataacccccggcccgctgtcttgggccttggggaacaccggggtcggccccgggatcaaacggcagggacccagggccacacgagaaaaggagcgtccacaggccgggaagtatgaagggcacccgggacacgggcacacactcttcgggcaaatctacacgcgccaagagcccaaattcaaaggccggaagatccgggccccaggttcacggagtatcagcccccaggagggacatgggtcccccgcaaaaaagggctgcgacgcgatgagcagaaatgacatgggcgaacgacaacacatgacgacaaaaagacagaccacgcccctataaaaaagatatcccccgtgaaggggggacccaagagcgatcaagaccgggcgactccacccggcgcgttgtcttcgtggggcccaacaagggggtggacccaccaaaaaggtggacggtccgcgatattttcacagaccgctcagacgccgggtgaccgcctggtcgggatcaacaaaacagtggcgtcacaagtgttgctaacgaccgcggtgaacagcggtgggagcaaccagttggtggtcaaggagcacgacaccactatctacagcgtacgacggcggcaccaccaaatagtgggcacagaacaccaccacccactcagcaacacataatacaccgtctctgcggacca

SEQ ID NO: 520045 - DNA, 235 bp, Homo sapiens
ccccctgaggcgcgtcaggtcctcagagtataagtccctcgccacaggcctaggatacccacgttgatgtgcactctcctctggtagaccgacctgcctccatggtggttagcctgtgtgacactcatgtgaccaaacgtcgtactgccacttctgcagcccgatgactccacgcagaacgcgcctaatggctcccgagtctcgaattctcctaatcttgtcttcgcgtctttcc

SEQ ID NO: 520046 - DNA, 968 bp, Homo sapiens
  misc_feature (10)..(11): n is a, c, g, or t
  misc_feature (14)..(15): n is a, c, g, or t
  misc_feature (18)..(19): n is a, c, g, or t
  misc_feature (21)..(21): n is a, c, g, or t
  misc_feature (23)..(24): n is a, c, g, or t
  misc_feature (28)..(28): n is a, c, g, or t
  misc_feature (47)..(47): n is a, c, g, or t
  misc_feature (693)..(693): n is a, c, g, or t
  misc_feature (700)..(700): n is a, c, g, or t
  misc_feature (968)..(968): n is a, c, g, or t
gtacaggccnnagnntcnnananngcgngattacaggcttcagccancacacccagcctcattcatacatttcttatgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagttaaaaaaaaaacacancaacganccacagcagaaaaagctacagcatacaacccagcactcaacaccctcactacatacatacggcccgcagccagatcgcatacaccacgacaaagaacagcagcaggggccaaaaaaaagacacgggacccaacatccaccagtcttagagagaccacctagttcaatatagcacgggccgtcaccgccgaggagaactcgcgatggagacctgttgggtcggaacccactagcggcaaaagtatttcgcctggagtctagaccacgan

SEQ ID NO: 520047 - DNA, 638 bp, Homo sapiens
cgtagaatgccagcaacatgggagtacaggtcataagccgagagctgaggattcaggcgaataccacggcgtatatcacttggtcagcgctcctaaagcaaacgccaccatgtgaagtgaaagccgctcctgacatcacgggccataaacggggtgagaacaagaatgaagggcaggatgccactatgtatggcaagtcagtgggctacccccacccagacgggatatggcgcaagaaggagaacgggatgcccagggacatggtcaatacctcgggccgcttcttcatcatcaccaaggaaaattacacggagtggaacatggtgaacctgcagatcacggaagaccctggcgagtatgaatgtaagtgccaccaacgccatgggctccgcctctgtggtcactgtcctcagggggcggagccaccgggccccactcgggcctttcttgggaattctggcggaaattatcatccttgtggtgatcatggtggtgtatgagaagaggaagaggccagatgaggttcctgacgatgatgaaccagttggaccaatgaaaacaagttctacaacaatcaccaaagataaaacttgcgcagagaacacaattaagtacggttacatatcttaggttctgaa

SEQ ID NO: 520048 - DNA, 922 bp, Homo sapiens
  misc_feature (647)..(647): n is a, c, g, or t
  misc_feature (654)..(654): n is a, c, g, or t
  misc_feature (922)..(922): n is a, c, g, or t
ccacagagctcctgccaggagttcactcattcgtgcatttcttcctttttttttctttttgagatggagtctcgctctgtcgcccaggctggagtgcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagttaaaaaaaaaacacancaacganccacagcagaaaaagctacagcatacaacccagcactcaacaccctcactacatacatacggcccgcagccagatcgcatacaccacgacaaagaacagcagcaggggccaaaaaaaagacacgggacccaacatccaccagtcttagagagaccacctagttcaatatagcacgggccgtcaccgccgaggagaactcgcgatggagacctgttgggtcggaacccactagcggcaaaagtatttcgcctggagtctagaccacgan

SEQ ID NO: 520049 - DNA, 575 bp, Homo sapiens
gcatgagagtgacaacatgtttaacacttcctaatgaaagtaaaatttttctgggcctggtagctcatgcctgtaatcccaacactttgagaggccgaggtggattacttgaggccaggaggttaagaccagcatgggcaacatagctagacctcatctctacaaaaaaattaaaaaataaaaaatgagcccagtgtggtggcatgtgcctttggtcccagttacctgggaggctgaggtgggaggatcgcttgagcccaaggattcgaggctgcagtgagctgtagccactgcactgcagcctgggcaacagaacaaaatgctgtctcacaaaaaaaacaagggctttatttcccccaattggcctcggtgctcctaaataagacttatgggtgggtggataggagggaaccttcacagtttggcgaagattatacccatggttttgtcggtgggtcagacctgtctggagatcttctgcagtcgcatttttttttgttcggaacggggtttccgccctttgtggccccgggtggattgccggggtggctctggggtcctgggcacttgggtcc

SEQ ID NO: 520050 - DNA, 400 bp, Homo sapiens
gcacgcgagaggacctgtgagtgaaactgaggagagagggatattctaatatatcttatatatgggttaatcatcaaggaatctcttctctgattaaaatacacacatcttaagaataagggttcagagcatattcctcgtgtatcaacacagaagaaaaccaaacacgatgtctggactcttttaaatggaagcaaagatgacttcctcatatatgatagatgtggccgccttggatatcatcttgggttgcgctttttccttcctaactttcccatatgtagaagaagccattaagaatgcgttacatgtggagaatgtggaaactggtctctcacgactcttgatgaagacttttgtgcgtgtatctttggctactgtggattggacattagccctt

SEQ ID NO: 520051 - DNA, 138 bp, Homo sapiens
cggcacccctcttctcccgctctccccctccatcgctccacactagataaagttttgcatggtatctctcctatacgatgatctgacatccaccgtacatgtccttttaggtcatcctttttttttctaagtttttaa

SEQ ID NO: 520052 - DNA, 996 bp, Homo sapiens
  misc_feature (677)..(677): n is a, c, g, or t
  misc_feature (996)..(996): n is a, c, g, or t
tgggttttttttttgggggttttggacagtttatttggaaggtcattttaaaaacaaagttaaagacaatctgagaaaaaaatggcgacagaatacagctcagttaaataggtagtggtttatgggtgattaaatcaagaagtaagggaaagtatgttatcttctgcaattccagaaataggttctgtggtccggaaggttcttatagcatccaaaaagagggaatgatcagtggcaattaaagctgcctcttaatcagtgtaaatctacagtagcaactaaatttttcggttcttcccattaagtcagtttcgatcttcaaacgtgggcctgggttttttaaaagataagatgctagaaattcaaggggattggggggtctttccttggcaagcacagcaagtcccgtgtaataagataggcacaacggtctgatccaggtaggcacgagtgggcaaagacgggagatctaccttcggcttggatgacttttctggcattaatcttctcattttctactattctctcaaggtttgtctggtgagaccgtactcagagtgaggattttctgcgaacctgggttgtccctccagcatctggtctggtccatgggggaccctgcaagtcacagtcccgggatacagtcggggccaagcggtacgtgcttaagagcctgnacggcctggtggccggctcccttcggcaggaagcgtgctgaagaagacctatgcgaggatggcagcgaaggggccaggaggcccggaggatgagtcaggaaaacccggccacgggtgtagcacgcttaagggctgccaaggtgcccgcgaagaaccagggcaagaaacctgcagaaggaagcggccaaaaaagagggagacagaaggcacagtcacaggacaaccaaaaacgcacttatgacaccaccaacgaagagcaaaagcgagacaggccaccaaaaacaaagcaccaataaaccgaggcgctcatcgcgagcgn

SEQ ID NO: 520053 - DNA, 618 bp, Homo sapiens
ctgaataaagaaatagttggatctccttcactaagttccaggatgtctgtccacattcggccaatgacttcactgtatagtctgaagggctctgcacaggattcaatttcgtctgttcaggaaaacatccaaaatcgtcagctgctgggtacttgtaaacgacatcaatccgttgggtgtatgggtcgtatcaaactcagaaaggtctagtgttttgtgacagcagagttcctacttttctccttggcatcattaaactctctgccacgtaatgcaggtgctggacatccgtgacagtgtaattctgaacggctgtcttctacagctccaggtggataagctatgtcttctctgataatcagagctgtagcacaccaaagcatgacaggagcccagctccatatgccttaacagagtctcagtgtctgcagagagctcactccacagtgaatcagtacattgtgtcgagcttatcactgcattcatcaggtgaatccacaaaggcaagtgccatgtcctggcagaactgggcacagctgagatctgaatgcaagggcacatgaccccacagctcatggcagctgtcagttcaggggtatgcgtgggcttgtatccagg

SEQ ID NO: 520054 - DNA, 641 bp, Homo sapiens
  misc_feature (277)..(277): n is a, c, g, or t
  misc_feature (431)..(431): n is a, c, g, or t
  misc_feature (443)..(443): n is a, c, g, or t
  misc_feature (447)..(447): n is a, c, g, or t
  misc_feature (450)..(450): n is a, c, g, or t
gggaccccaaggcccagccgcgcagaccctcaaaggttaagcccacaaaagcctattgaaacccacggccccccccggcaagaccctcaggggcgagccaaccaaaagcccatggagaccccagggccccgcccggcaggacctgaaggggacgaaccaaccgagagcccattggagaccccaggcccaggccggcaggacttcaaggggataagccagccaaggcgggggaggcagcaaagttgcaggacgcagaggtggagtcttctgccaagtntgggaacccttaaggaaaggagtgcccgtcggggttttggtcctcctgtccctgctgcaggggctggggcctccggagctgctgcgggctcccctcagggtttggtttgtgacccgtgacccatgacccacagtggtggcctcctgtggggccnctatagcagccnccanaanccgcgaggccctcagggaagcccaaggcctgcaaaagcctcctggcctgggtgtgttttccccacccagctttcccctgggcccctgtttttgtaaattgacccttttggagtggggggcggcgggcagggctgctttttttagtttgatgccaagcaaggccttttttgaataaattcatttgactttga

SEQ ID NO: 520055 - DNA, 351 bp, Homo sapiens
agagaatctgggcgtaaaaatgagaatacaggaaatggctcttgtatatttttttgctgctgtttacagcttgttaatgctctactgtctttgattcaagagagatttgttcacgtgcccagactcgtatctgtgtcaccttggaagtttttaacaactcaggtgagttttagctttattggggagggggtgatctaaaacactctttacgccggctactattgacttgggttaatcgtgtgaccgcggtggatggcacgaaattgaccaaccctggggttagtatagcttagttaaactttcgtttatcgctaaaggttaatcactgctgtttccccttaagcggatcag

SEQ ID NO: 520056 - DNA, 1871 bp, Homo sapiens
  misc_feature (355)..(355): n is a, c, g, or t
  misc_feature (734)..(734): n is a, c, g, or t
  misc_feature (1541)..(1541): n is a, c, g, or t
cctttgctgcctcatgccgtgatgatgatgttggttacaccacccatcttttgtcgctggtaatataaaggaggggctgcgtccttgtcgactagctggcgtgctgggctgttttagtgcgtcccgcgcgggtgcgtcatcccctcgtttaggggtgtctttctgctctacctctggtgacactctcctgtgttgctgcgccccccctttggggttttgcgacgcccacatggtgtgtgcctctgttttaccccccccgcgtgttcgcttgtttgtggacgctcgtgctacgtcccgtccccacgggtgtttcgctctctccctgtgttgtaacggtgcgataagaagaggtgcnccccctatgggggagcgggcggaccactctatatatgtgggtggggagtttgccccccccgcccgtgttgagcagtttggagcccccctccttcgggcgcacacaagacacaacccgcttattttggggagatatgtatgtgcttctcatttttcgtggggggcgtaaaaaagtttctggggccgtctgctgttgtatcctccggttgtgcccgcctttcttgtgcggtgtctccttatgcctccccgcaaataaggcgggtttctgttttatgacccgtccgcccccgctttcttggggaaatgttggtcgctacccatatgctctcgggacgatccctttatgatgttattgggacggtttatggtcacccgcggcnccccctcggtatatatggggagttttgaagttgcgccgctattctgtttgggttgcccccccgcgccctgttggcggtgtttcttgccaaccctctgtggcgctctcgtataggagcagcggtggtagaacacccaccgcctggtggaacactgctgttgtgtttacctctccctcggggcgccccctccttacaaggccctcttggtttttctggcgatgttaaaaaagtgtcctctcgcccctcttggtgttccacagcagaagtagtgatagacatctgtccccacgtcatgatgttgatatgtggcctccgacatagaggtgtcttataggctcgtcttcattgtgggcccctcgttaacgccccacctaatcaacacagggggacgccactcgggtgtcgccccacacagaggagacattaaatagcgggcgtctctcttctcttgttttatggcgccgcacgcgccactcattgtggttttccccccgtcgtgtcgtatacccccgcctgtgtacgacgtctgtgcttgtgggtgtctcctcgagcatctttttatggcgaccacttctctcgggcgctcgcggcccacatcgttggcgcttttgtctgcgatctggccctcgcgtcgccttcgccacgtgtttggcccgcactcgggagatttcatgcgcacacgtgcgcacatcacgcatttttggtgagagagatatctcacacacgggcgagagctcacagctttctctttggccttcacagagacacccttcccttcgctcgtgctgttgtacacattcggtgttntctcgaatataatgggttctatactcgctgtcctctttcttctcccaaaggggtatgaccacggcccacagctgatcggctggcttgtcttatggaaggccacatcacgtgtcctttcctccatggaagacaagggttctgaacaatggaacagtcacagtggctatgaaagcgggctggttctcgctcgggcccgggcttaacacatcccctgagattcttcagacttcccgttccctgagtctgcaccaacccctggtcatgtatgggtgcgaatttgtccactgggaccccagaaaccaccaccttgtaaacaaaaataaaaataaa

SEQ ID NO: 520057 - DNA, 179 bp, Homo sapiens
acagccgtgtgctgacctttaagggacaggaccaccaaccaatacatgcagatttagtgtgtgtggacagaaggtacttttgacattcagtttagctatactagaaacagaatgaataaatgaactttatttcttttttctattttttttgcaaagaggtaacgtaaaacgattcaatt

SEQ ID NO: 520058 - DNA, 849 bp, Homo sapiens
gagtaggctatgttcagtgattacgcctataactaaggtctatacccttaatacctaagaacgagcgtccatacaatctcattatcgaatatcgatacttcatacgtgcagtaaactcttaatcttggcttcctcacaactattttcctcggttttcattcaggacatgccccagacgatttacatcgggattatcccgtatgccatacgacccacgagtgaaataaatcctcagtcaatgcagttagagtcctcgatctcgatcttcttcatcacacaagtcacgtcaatcaatctcacatcacactttccccatgacatctatgcacgaaagtacatttcggctgtaggaaggcgcaaaagatccctcatatcaggttagcacaagtacaaccctcccattaggaccatggaagctggatctcatgatggcatgcgcagctccaaccggaactcacgagcatgcgtaagtaatcccgatatcactataattattctagcaccaattaaaataggaataggaaatcgagacgacccgaaaggctggcttgcaaagtccgaacacactcagtggtcgtcacaattcgacgtatttgccaagaaacacaccaatatcgtaataaataatttacaatacacaatggatgtgtggtgggcaacttccgaatgatgcgtagaaacacctattatttaaggcttaatgaaatgatgagggagtgcagagtgtccccggaacgtgttaaagaagccaaaaagtgtgacgttttaagcgcggttaccaacagagaggaggggttgattacttaacgagtacaagggctcgtagaaaatcttggctggaagacaaaa

SEQ ID NO: 520059 - DNA, 91 bp, Homo sapiens
catggatttgctggtgcagtacaactaggctctaataggggacatgctagcagcaaatagcagaaattcataagacattttctagaaaaaa

SEQ ID NO: 520060 - DNA, 410 bp, Homo sapiens
  misc_feature (272)..(272): n is a, c, g, or t
tggatgatcgacatattgaaaaaaatagaagagggagtccatcgtggcgcagtggttacaaatccgactaagaaccatgaggtagcgggttcgatccctggccttgctcagtggagttgaagatccgagcattaccgctgagctagtggtgtaggtatgcagaacgtggcttgggatcccactattgctagtggctctaggcgtaggctgggtggctacacctcttgatttgacccctaagcctcggaatctccatatgccacaggatcggnccaagaaatggcaaaaagccaaaaaaaagaaaaaatttagaagaggatttaccaatcatcaatatttttgcccctattttagggagcccccagattcctacaacaattttgaccaaggcttaaaaggaaaaatggcgg

SEQ ID NO: 520061 - DNA, 307 bp, Homo sapiens
  misc_feature (242)..(242): n is a, c, g, or t
  misc_feature (267)..(267): n is a, c, g, or t
  misc_feature (271)..(271): n is a, c, g, or t
tgacttgttccaaaagagtcagacttgagatcttggagtcattggagactgatcatagggatcacgggaggcagatggggaaacacggctaaatgtgtctgaaagaccaggtcagggggcctaggtgtcttgggaacatgtatcaggtggccttaccaacgggccaggtaaagctggtcctcggttttttgcgtcgttcgaggaaaggatcctgatttcgatgaggactggtcttttgattnggacctagtaaaaaccctctgaaanagtnttcaggtgttcgtggtcggtgagactctgagacctt

SEQ ID NO: 520062 - DNA, 435 bp, Homo sapiens
  misc_feature (358)..(358): n is a, c, g, or t
tgctatctagcgcttctgacagttgacagtccgtcactgatggtgttgtcatccccctcagtaactggtggggcccttgtcaatgcttgtgaactctggctcatctgttacattcataacagtactcactgacctgcaacatgtggaacacacaggcactgcggtcgatcatttgcacttgttatctcactcccaacacagccttccacggaacactggtaagtacccctctttacatgaaattggaaacagggtgtgacttttcaacaacgctctttcgcttgtgaagtgcctggtgccgagtctcacaccatagctgttcttgagtgcaaagccatgggctgtcctgtgatgccanctaaagacagtgctgctcagcaattaggcacacggtcacacttggcaaaaagcaggttccccccgatacagtgacca

SEQ ID NO: 520063 - DNA, 934 bp, Homo sapiens
tgtcacctagtatgatggtctggtgatacttacgcaacacatttgtgctctttcgtaactgactctcgtctttggacttacaagtgacaggcacaacgggtggtgtactgaagagaacgttgagagaacgctacatgagactgctctcaccttgtctagtcgagaagatgacatgtattgtcgagtaaccgaattgaaggggtctatcctacaatagaacgtgcaaattgcctgcaacgtcagctcattaaacagctgatgaaaaaggaattcactctagagttttcacgtgacagcaaagtcaatgtcggtttactgtacaccaaataaaccaagcaggacatcaatgagcaagatgtatgtgaagggtgcttccatgaatggtgtcattgacaggtgcacccacattcgagttggcagtactaaggttcctatgacctctggagtcaaacagaagatcatgtctgtcattcgagagtggggtagtggcagcgacacactgcgatgcctggccctggccactcatgacaatccactgagaagagaacgaaatgcaccttgaggactctgcccaactattattcgactctgagaccaatctgaccttcgttggctgcgtgagcattgctggatcctcgaggactcgagggtggctcctccgtgacgctgtgccggcacgcaggcactccgggcatcctgactccttgggaaacacacagggcacgcttgtgacaatctcttagccgaaatcgacaatcatcgcagccacgcaatgacgtacatttcacgttaggaaggctcaccaaaggaccgagacacttgtcttcacctcataccccttcgtcccatataaaagcgtgtctgaaagacccactgtaagcacacactagaaccctcgcaaagataaaccacaacaacatacaaacattcagaa

SEQ ID NO: 520064 - DNA, 386 bp, Homo sapiens
attcgcggccgcgtcgaccaactcctcaaaaagaaaaccagcctgagggctgggtgcggtggctcacgcctgtaatcccagcactttggaaggccgaggcaggtggatcacttgaggtcagtagttgggagacgagcctggccaacatggtgaaaccccatttctgctgaaaatgcaaaaattagccaggcatggtggcacatgcccgtaatcccagctacttgggaggttgaggcaggagaattgcttgaatctgggaggcggagattgcagtgagctgagaccatgccatcacactccagcctgggtggcagagcgagactgtctcaagaaaaagagagagagagagagagagagagactgtctcaagaaaaagagagagagag

SEQ ID NO: 520065 - DNA, 594 bp, Homo sapiens
gtggagaggagggccatgccggagacacggtacccacccagacagagtagatgccatatgccaggacgcccagcactcccaggatcagcaccagcagcagggcccagccaccaggcgcagaagcaagataaacagtaggctcaagcacagagccacccccagtgcaacaagaatccaataccaggactgggcaaaatcttcaaagatcttaacactgatgtctcgggcattgaggctgtcaataagaccgctgatcccctgctgtatggtggtgtcattggtgatccctgtggagcgccggtggagtaatgttggtccatggacagccgcgtcccagagctggagcagcgtgggaggaggacactggggcagagtacctgtatgcaggcttgtgatcaccgtcatattccagggtacccctggcagacaaaagttccgtgtgtattgtaatagaagacttccccaacagtcttgtgagaactcgtatcttcccacagtccatgggtcctccgggcaggaggacacacacacctggtgtgtggggcactgtaggccgttctcagcaaatgagatgatgtagctggaccggatgca

SEQ ID NO: 520066 - DNA, 409 bp, Homo sapiens
  misc_feature (320)..(320): n is a, c, g, or t
  misc_feature (344)..(344): n is a, c, g, or t
  misc_feature (377)..(377): n is a, c, g, or t
  misc_feature (388)..(388): n is a, c, g, or t
gagacagagtcttactctgtcacccaggctagagtgtgacgttgagatcttggctcactgcaacctctgcctcccgggctcaagcaattctcccgcctcagcctcccaagtagctgggactacaggtgtgctaccatgcccagctaatttttgtagttttagcagagacaggatttcattattttggccaggctggtctcaaactcctgacctcagacgacctgcccgcttcagcctcccaagtgctgggattacaggcataagccaccatgcccagggccagaatttgcccatttttaatgcatgtttctccacctttncataggaaaaagccatattatccnactaaggttatttatggaaggaccacaggtttntaggcccatgnacaagtttttttattcctttt

SEQ ID NO: 520067 - DNA, 141 bp, Homo sapiens
ctaggagggtccttggcctattactatccatcctcatccatagacaataatacccatccacgatatatacaaaaacaaagcataatatttcggccactaagccacatcactttataagactcctaagcagaataatctcaa

SEQ ID NO: 520068 - DNA, 189 bp, Homo sapiens
  misc_feature (5)..(5): n is a, c, g, or t
ggttnactctagacggatcccctgctcgctgactttttgttgtttatgcggggcaacgccatctcgggcggccgattaattaggggaactagtcagttgccaaagcctccgattataatgggtattactatgaagaagattattacaaatgcatgggctgtgacgaataacgttgtagatttggtcgtt

SEQ ID NO: 520069 - DNA, 121 bp, Homo sapiens
agacagcacagacagattaacctattaggttatatcgcgagtctagagagggaagcgccgcggacctgtatttactagacctgccctcacgcctgggttcgtaggcgcctaagttaaccca

SEQ ID NO: 520070 - DNA, 271 bp, Homo sapiens
  misc_feature (35)..(35): n is a, c, g, or t
  misc_feature (48)..(48): n is a, c, g, or t
  misc_feature (94)..(94): n is a, c, g, or t
  misc_feature (178)..(178): n is a, c, g, or t
agaagcctctgaccccagcacactactcattgtanatctctgctatgngccctaagggctaggctcaatgccctagctcaatgggaagtaaagnggatgattcttgcctttcagtcttgttgaaaagtcataattcggccgggcgcagtggctcatgcctgtaatcccagcactctgngaggctgaggcaggtggatcacgaagtcaggagatcgggtccatcctgggtaacacagtgaaacacccgtctctactaaaactacaaaaaatt

SEQ ID NO: 520071 - DNA, 244 bp, Homo sapiens
ctaagtgaacgtgaggatggaggtgtgaagggcggacagagaagccttgtccctcccgtagtcccctctaaatgctaccacctgcgtgtctggcggtagtgatgagggagacccccggtccatacagctggtccaggaagggcaggcagggcgtgtgtgagccggagcagctgtgtgcgtgcagcctactcagagctctggagccacagaagtgtcatggtaggggtgccactaacaatctccc

SEQ ID NO: 520072 - DNA, 103 bp, Homo sapiens
gagctgagcaacgtactggccgccatgaggaaagctggtggcaagaaagcctgagcccctccaaagccctcaccctgaaataaagaacagaagcgcattccga

SEQ ID NO: 520073 - DNA, 134 bp, Homo sapiens
agtctttgaaaactgctttaatggacaacataagtagaagtagcaggttattattaatcttcatgatttaagattttattcactaccaggcatattctttttcttttctttctttatttattttatggaacggg

SEQ ID NO: 520074 - DNA, 765 bp, Homo sapiens
  misc_feature (639)..(639): n is a, c, g, or t
  misc_feature (715)..(715): n is a, c, g, or t
ttttcttaacagctgatgttttaggctctgagggagaaaaatggattcttttgatttctcgcacttctgtatgttctgtaattgcaactctcacatttgcatcttccatgcttccatcgctctttcttttccgagcaactgaagctgttgtcgaagagggtgttacctcgtttttataactcttagatttacttaatattggatctataattggaagataagaatgaaaatcttctttttccttttgattatttattactttttcatgttcacccactgcactgttgagacatctttttgcttttggtttattaatctcagtttggttttctctggtacaggtggccttccttttagtaacagtggcagaaagtattggacgtctcttaggttgtttattgtggctatgactagaaatatcctgaactgcagaaaatttaggattattttgttttataaaactgtagtaatttgacttcatttctactagttcttcaaaatctcccaaagctatttttgaacccttaatgtcagggttcaaaaatagctttgggagattttgaaccctgacattcaggaatacgtggcgaaacttcactttttctccaatcttcaggagactgtgggacttgagaattntcatttgataatggtactttacatgtttgctgagatgtacacatatatgccatgttatcttttaaaaaatgattangggataaaataggaataactgactcttgatctagaaccggattagtccat

SEQ ID NO: 520075 - DNA, 848 bp, Homo sapiens
ggccccccctggagttttcgttgtcgcgcgaggccgaatgtgttgtccgctctgccaaggccccccgccctgttgatgtggttgttccgtgcgcggaacaccttattgggggtctcccccagcggtggtggaagcgacaacacctggtggggcacacgaccaaggggggttgcggtaacacaacgtcgtcgcgagaaatataatttattgtatccaaaggcccccccctgtgtcgcgacacaacatccctgtggagcaacccatcctagaggaaagggggacagtttttcgttgcgcctcaacacattgcagtgtgcgggaccaacctcgttgcgggggttatacccctctttttcttataagaagtggcccattactctttttttccagggaacacgttcacgcgcgcaaatgttcgtgtgttgttaaacaagtgtgcgcgaggtcagtccaaattctatgcgcgtcgtgtgacaaattcatgggctcgctcctcacccacacatagtgcgtgtgcctgttgagaaagtgtcgcgcacacgcgatgtcgacatacgcgcgcggtggcattataccccacggtacactctctgactcaccccacgtagtttttctagttcatccagtgggtgtcttctacaccagagacacaaattctttcttttgtaatgtatttgcgatgcttgctaacactagtgctagatcgccccattcaatatctccgctttgtcggcgacccgatttcccgcacgacaccgccctacccaagcttgctacaatatttctgcttcttccccaccaactacagaatgcaaccacatttacccccacaatatacaaacacaact

SEQ ID NO: 520076 - DNA, 167 bp, Homo sapiens
acccccgcgtctccccccctccccccgcgctcgtcccgcgcgcccacacctcctcccgatgcctgtcggcgatactggtccctcctcgtcgtctctgtgtttcgtgcccgccccagccaatgatattgagtcttccccccccaatacaacaacaccagacatatacc

SEQ ID NO: 520077 - DNA, 137 bp, Homo sapiens
ggctttgtggccccccgttctcaagttggcagtgcacgcatttttttcagcatctgtccttttcggtgcaggtttccagtcatcatcttgtgtcctcacccacaggcagtgtccacgtcacgcacatgcgtttgcgg

SEQ ID NO: 520078 - DNA, 273 bp, Homo sapiens
aggctgtatctcctcattacttctctatacctacattcctagcttcttccacacgtctgtgaggacagatcttatctaaaacagcacatctcgaggccaggcatggtggctcatgcctgtggtcccaccacttatgggaggacaaggtgggcggatcacctgaggtcaggagtttgagaccagcctgacaaacatggtgaaaccctgatctctactacaaatacaaaaaaaaacaacaaaaacacaaaaaaaatgggccagcgcatgagctga

SEQ ID NO: 520079 - DNA, 503 bp, Homo sapiens
tgaggtagtatttggtaatctggtatagagatctttcacctctcgggttagctgtattccggtatataattcttttggtggctatggtgaatgggatggtgttctggatggggctctgggcttgatggtggtgggtatataggaatgttagttattttggcgcatggatttggtgtctggggactgggctgaagtggtttatcagcttaaggagattggggctgagactatggggttttctagatacagcgtcatgtctgcacacaggcataggtcgacttcctctcttcatattcgaatgccttttatttcttgcctgatggctctggccaggacttaagtactatgtggaataggagtgatgagatagggcatccttgcctggttccggttttcaagaagagtgcttctagcttttgcccattcagtatgatgtaggctgtgggtttgttatagcttatccctttattatatacgtgtatctgtataagtgatgggaaata

SEQ ID NO: 520080 - DNA, 292 bp, Homo sapiens
acatatgcaaggaatttattacttttatttattggagatggggtgtcactctgtctcccaggccagagagcagtgccatgatctcagcccactgcaacctctacctactaggcgcgagcaatcctcttacctcagcgtctcaaatagctgggacctcaagcgtgagccaccatacctggttaattttggtatttttcagtagagacaggtttttgccatgtccgcccaggctgttcttgaactcttgagctaaagtgagccacctacgttggtctctgaaagtgctgagatt

SEQ ID NO: 520081 - DNA, 896 bp, Homo sapiens
gtggcagcggatgcacggacatgagcggatggcctggagacatcaccttttcagtaattggtcaggtatgtggattatctcgtgaaagaacatgggagttgaagaacatgtatttgtgaatggcactagatcaggagaaaggccatgtccctgagcgtctcagagcgtcttcccaggttgcacagggatgtgggtgacatagagggaaggacacatgctggcgtcatggtgataattcagggtaggatgacactgtaactatgaatggagtctcaggaactggtgcaccatgcagcataaataggagctgatggcattcgatgtctattgcatccgcgcttcctcaagccattggaccaaagataatcctgattaatccctcctaaacggaatgtgtgctgctgccgacccatgcacctgccatttaattactatcaccattcctgcttgacaggggtaacgattcgtgctgaggagttgtaggatgggatctcttggataagatccccaccttcaagggctcgacattcagtgatacacgatctcttagacttcgggcaatgtgttgatcagaatcgcccagcaacagcttgcttccctttcggggtgatgagcacccgctcgaagtgctctggtgatgcggaagcaactggagcagatgggcatcgtacgtataataactgggaaaaacagacataaccacatgctgggaggtttgaccacaaggacttctctttaccagactataagtctgtatccgaagattatcacgtgtggacaacataggcacggcaggcacacaacacaccacagacacggttctggatccaagggcaccccgcaaagtcaaccccagggtacaaaagctgacacaaactgagcacccagacaagcaa

SEQ ID NO: 520082 - DNA, 483 bp, Homo sapiens
tacaggcgagtcgggttccgagaccaagtacgaggcgctgcaggtcacagcaggcagacatggggacgagcatggcaaaccaagcaggagattgctgagatcaacctgcatgatcctaaaggctgagatctgagatcgaacacgtcaagaagcagtgtgccaacctacaggctgccatggctgatgctgagcagcgtggggagatggccctcaaggatgctaatgaacaagctggaagtggctggaggatgccctgcagatagggcaagcaggacctggcctggctggtgaaggagtaccagtgagctgatgaactgtcaagctgggcctggatgtggatgatcgccacctacctgtaagctgctgtatggtgaggagtgcaggctgaatggcagagggcagttgacaaggtcaagatctctgtagtgcagtccagcgtctcgagtggctatggtgggtgcagcggagtcgggagtggcttag

SEQ ID NO: 520083 - DNA, 2408 bp, Homo sapiens
  misc_feature (30)..(30): n is a, c, g, or t
  misc_feature (102)..(102): n is a, c, g, or t
  misc_feature (155)..(155): n is a, c, g, or t
  misc_feature (1184)..(1185): n is a, c, g, or t
  misc_feature (1238)..(1238): n is a, c, g, or t
ccgcttttgttgtcagggacccagcgaggngcgccgctcgccggccgccgccaccctctctcgctgcagcctgctgtgcgctgcacggcctggggcccgggngccccgcccgctctgcccatgagggggccccgcgaccaccgctgcttccagcncggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagcttgccagcccaggaacagctgcgacccaagccccaactggagcaagaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcatgcggcaatgggcttagcagccattttccctgtagtgagagccagnngcatctcaatggacagtcaaagggaggaatataatgcattacccaaatggtcntgccattgtattgcacaatggacattgtactgaaccttctccaatgcttatactcaacgcagctcatgctgcatacagcttcccgatcagcacggcactttccctccagtaactgcagacacccacaatagctccacctgtgccaaccacctgcgcaggcacagcaatgccatctggctctcgtccaactgcagctaagtctccactactgtggatcctcataacatccaggcacatgcaacatctgggccagcaactcctcgcatgcacgccttccctccaagccagcggacacgaacctggtcgcgacactccggcacaccccgctactccctgggctctcaccaccactctcatccttccagccactgaaccccagggatcaacccccgcacaccgggcctcgcgcacctcccacgcagcgccccaacccgcgccacccagcgaaccggcactccactcgaaccccgactcgcccagcgacaacgataccaagacacgcctcccaaacagctggcaacaggaacacacaaccgctcggcccgacatcacaccgcacgtccacaccggacgcaaccacagcggagaacccacgccaccaaaaccaccaaccgccacgcaaccccaagcgcagaaagcgcaaacaccaccccacccaccccaagagacaccaagcaacaagcagcccgcaaccccgaccagcccccccacggcactccgccgaacgaggctggcaccaacacacgccacccaacgcgccaacaccacgcacgcgagcacgctccaccccacacacacggccaccacaccacgacaaccccgccccgagcgggccccaacaccacgcccacgccacccacccggcgccacacgcgactccaccaccagcaccccacggcaacaggacacagcaccagcaacggccgaccaacagcacccgccgcgcacacagccccgcacgtccacgacaacccgaagcaccgcacacacaacacgcacagacaacacatccgagcacacgccacagcagccaacacagacccaccgacacagagtacctcaacaccgacacgcacaccccacaccaccaccacccgtcagcacccccgccgccgacccgccagcccagcgcccgcgacacgcccgccccgccacccaaccacccccccg

SEQ ID NO: 520084 - DNA, 104 bp, Homo sapiens
cagtggagctgccctcgcagggagctgcccctcgccatctaacagaagtatttaaacagaaactatatgctcagcctaccagaaataaggtagaaggttccagt

SEQ ID NO: 520085 - DNA, 831 bp, Homo sapiens
ctgttgtgatctatgtcctgggatacaagctgtgttgccagtagacctgtcaagcgtgaatcagcatgatccgtactattaccatcgtcgtgctgaatgtcgaagctcacgtgagctagcagcgcttaattggcagtccacgcgtcatcatctctcataggacgagcatgcccgctgaagagaagggcggattgcccattgggcataaacgtgaggcgcagtctaatccgagaagtagatctactatcctgcacgaaatgtaggcctctagtcagtcctcctactcatcgatctacgctcaccattcagcggtcccttataccatcatacgtctcgtagcctaccccttcatcgtacatccatcatcagagtcacacgtactcgcccagtaatctaacagacgtacaaaagaataacattcgatcagggttgtggaagcaataaccatcgacatgcaccaccgagtgtccctctgcctgagcgagcctcacatcgtcctgcgtgtcacctaccgtgcgttatcctctccgtaaccccttagtctggtccccgccctacttcaacatagcgctagaggttaagactcccatatgagttgccccattgcgccgaagatacacttagcacgcccacacagccgacccacaaaccagcactaaaagagccccccaagccaacaccgcaacgcccaggcccgttgtcaccgcaccgccgcagtccaccctggccaaccacgacaccacgctcacacagcacgacgcgacaaacaccccgacgccgaccccacccgtgcaccaccccaccaccatcacccatcacctccggccaccg

SEQ ID NO: 520086 - DNA, 112 bp, Homo sapiens
tcgaggattctagaggctgaatggctcgagatgtatccctgcctgtggagcttacccccagagggccgccagtgcagtcggtggtactgcagatggaggagtcgggagcaca

SEQ ID NO: 520087 - DNA, 868 bp, Homo sapiens
  misc_feature (30)..(30): n is a, c, g, or t
  misc_feature (102)..(102): n is a, c, g, or t
  misc_feature (155)..(155): n is a, c, g, or t
ccgcttttgttgtcagggacccagcgaggngcgccgctcgccggccgccgccaccctctctcgctgcagcctgctgtgcgctgcacggcctggggcccgggngccccgcccgctctgcccatgagggggccccgcgaccaccgctgcttccagcncggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacacgtaagtgactttggttttctaaagattgctgccattaattgcaaatggggcttattttatcagcttttcatttagggggccattatgtttctgggtacagttttcactccttgctgggtaatcatacatcagtagttagggaagaaatcagtgatgatgatagaagttataacctaggggctgtcattaattcttgcctcagagcaagacatgtgattatgtactctgcctgaccctggtccctctagggtaccctcttttactacatttcacagttacttttcttctgaactactagaactaagtctagtaactagaacagagtacttgctcactgtggggga

SEQ ID NO: 520088 - DNA, 588 bp, Homo sapiens
ccttttttgggccccatggggggggggggcccccaaccccaccaaaatttccttttttttccttccccccccccccgggggtgtaggcccccgggtggtggggggctcggggtggccccctacccccagccctttgtcctgggtgggccccccacccccagaccccttgggggaggggtggggcctaaatttttttcccgggtcctcccggggatttttgttagggggaaccccccccgttccccccttagccaccccctttttttggggtttcccccaaattaaacccggttggggccgccccgggccgggttttttttcccgggccccccttttttttaaagggggggggacccccccctttgtggggggccccgggccccccgtttttcaggatttttttttttggggccccccaacctggggggattttccccccccggaaatttggggttttttttcccccccggccaagggggccctttttttttcccccgggggttgggggggtccccctgggggggccctggggggccccccccccccccccccccttttgaaaaaaaaaacccctttttttttggggga

SEQ ID NO: 520089 - DNA, 192 bp, Homo sapiens
  misc_feature (16)..(16): n is a, c, g, or t
  misc_feature (77)..(77): n is a, c, g, or t
ggcccatttaaaaagntgagggtagtttccagaaaaccttttttcctacccctgccgttggcaggccccaatttccncaccccagccccttccatggtattgtagcaggggaattcccctcccccctccttgtgccttttttgtaaataggcttttcccggcgaccaataaacagctcccagtttgtatgca

SEQ ID NO: 520090 - DNA, 181 bp, Homo sapiens
ccataacactcatggatctgaatcagatggatactcacatgggagtcaagaaggtggagcaaacacgaagtctcgtggtcctataatggacaccccataattccatgaatggcatgatcatcattggcatcccttcttgtgcctatgggggtaccgacgctcgagatttcgtaagtcgtgg

SEQ ID NO: 520091 - DNA, 880 bp, Homo sapiens
atcacaaggtcaggaaatcgagaccatcctggctaacacagtgaaaccctgtctctactaaaaagatacaaaaaatgagctgggcctggtggcgggcgcctgtagtcccagctactcgggaggctgaggcaggagaatggcgtgaacccaggaggcggagcttgcaagggagccgagatcacgccactgcactccagcctgggtgacagagtgagactctgtctcaaaaaaaaaaaaaaaaaaagaagggaaaacacaggcttctctataaagtcgggtggagatctcattccattccatttggatacttatttaaaaacattactttggagccaaacctttattgtagagggccattagattctcagaagaacaaaaagctcattattttcccgtctgcaaaattactccagtagggaagattattgactcaaaaaagaaatttttatagaaggacatgcctgggtatagcattggttttcaaaaagggctttctagaacagtggcctttaaattggagacaatggagtatgcattagaaattaatgaagccagaagtggggggaacttgtgatccaggcaactccagttcttggaggctgcctatcacaatgaaataacttggtgtccctttcaccagagaagctaaaatgtgtcccttaagatagcattatttgtgtccccttactaaagtgcacaactcctgggtttgttaaccaagagcagagtgtgggcacggtctcatcacgtgtcgccctataatgtatttaattggccttaattgaaaaaaagacgctgggcacaatgggagacccgttcttagaaaatagaaatcgcagcggtgtatgccctggtggccccgactgaaggggggggaaag

SEQ ID NO: 520092 - DNA, 237 bp, Homo sapiens
cgacaccgttgcccggactgtccacggggtgccttgggtacccctctgggacctccgaccgtgacaacgggggctcttcctcgttttcttgctcatcagcccattcatgcattcattcaatgcatgcagtcattgcatatggtcagtcattgtgttcatgcgttccatctgctccggcagcagctcatcattgttgcacagcaggcatcagctcattcagcacaggcattcatggca

SEQ ID NO: 520093 - DNA, 341 bp, Homo sapiens
atgaaattgcaggaaggcgctcatcacagagataccagcttgctgagaacagaggcagagatgagggaatgcatctacaagctaggggaccccataagatagctgacaacccaccagaagctgggagagaggcatggatcagactctctcactgctctctcagggaaccaaccctgccgacaccttgaccttggacttctggcctccagaactgggagacaataactttctgttgttgaagccgcccagtctgtgggactttgttatgccggcccgagcaccagcaatgtgtggctcgcagtattggatgtagctccaggggatgctcgagagtcgagcct

SEQ ID NO: 520094 - DNA, 334 bp, Homo sapiens
cgagcacaggctgaaccaacatggtgaaaccgtgtctctaataaaaatacacaaaacaattcagccgggcatggtgacaccatgccttgtaatccgcagctcactcatggcaggctgcaggcacagcacaatccacttgaaccgcagtgagaaggaggtttgcagtgatgcctgagaccgcaccatttgcacttcagcctgggcaacaagacccaaactccgtctcaaaacaaaacaaatttggggcagccatctccttccacaccccatggggagaggactagggcttggtcagtctgctgctttcactgtaaaacaccagcgtggtgcaggc

SEQ ID NO: 520095 - DNA, 143 bp, Homo sapiens
tacagcttgttagcgcgtgctgtccggacagcacgcgctacaccaatcgtgcaggaagaatggacataagacagggacgtgacagtcattaataccaaaatctcttacctccaattctccacatcattcaagcggttgagccc

SEQ ID NO: 520096 - DNA, 422 bp, Homo sapiens
gtgcatgacacaaaccagggccggttgcctgtcatctcctggtctaagtgagcaactcatgtccgctctggtgtatgattgagccccagatccacgcgtaggtatgccagaaggtgttgagccctctaactgggttcgttttctgatctccatctgggagctatctggtggtgatcttctctggtggtcctgactgcgatcctggctgttacactgctggactgtgttacaatagtggtccccgagactctcttgtggccgctcaatcgtgccttatcttgcactctcttacctacagctgtacagtacctgtctgtttcctgtcctccttcctgttacatctgtccatgtctggagctcggctggccgttccctccagccccttgctggttatcttactctgagtctgaaggcagtctgga

SEQ ID NO: 520097 - DNA, 260 bp, Homo sapiens
  misc_feature (41)..(43): n is a, c, g, or t
  misc_feature (71)..(71): n is a, c, g, or t
  misc_feature (76)..(76): n is a, c, g, or t
  misc_feature (78)..(78): n is a, c, g, or t
  misc_feature (84)..(84): n is a, c, g, or t
  misc_feature (120)..(121): n is a, c, g, or t
  misc_feature (150)..(150): n is a, c, g, or t
  misc_feature (153)..(153): n is a, c, g, or t
  misc_feature (205)..(205): n is a, c, g, or t
  misc_feature (246)..(247): n is a, c, g, or t
caaaatctaaaacaaaatctgaactctcaaaagtctatttnnntaactgaaaatgtaaatttataaatatnttccngngttggnatgttgtagttacctactgagtaggcggcgattttnntatgctatgaacatgcagttcattatttngtngttctattttactttgtacttgtgtttgcttaaacaaagtgaactgtttggnttataacacattgcatgcgctttattgcccatgggatatgnngtgtatatcctcc

SEQ ID NO: 520098 - DNA, 306 bp, Homo sapiens
ccgttactatgaggggagaggagaaccctgaagtgggacctcccagtcacgtctcatgggcacagatcccaacagatctgatcaccagtctgatcagatcaaagcagagatgggtgcacatggaggtggacagtgtcagcccatgagcacccgtgcctccagtgctgcatggaatactgagccatgtgtcttcactcttgctctgtgcctcagattttacgaattgtaaaactagggcactacactagaagtactgggtacatttatgtgtgtgatgtaagacagggaccagcacagaggcccctt

SEQ ID NO: 520099 - DNA, 877 bp, Homo sapiens
gtggctgagctgctgtctcaggcctacagactgccatggagcagattcgagctggcaaactctgcctttcatctactgtgaagcaggtggtacgcagactaaatgagctgtacaaggccagcgtggtatcctgccagggcctcagcttgcgacttcagcgcttctttctggacaaacaacggctgctggacgggatccatggtgtcactgcagagcggctcatcctcagccatgctgtgcaaatggtacaatcagctgcccttgatgagatgttccagcaccgagagggctgtgtaccgagatatcacaaagccctgctattgctggaggggttgcagcacactctcacggaccaggcagacattgagaacattgccaaatgcaagctgtgcattgagaggagactctcggccctgctgagtggtgtctatgcctgactacctgctgccaacctgcagggtagggtctgagacctggcagactgtcctcaacactgatcagatccgatggtgctgagactgctgccagccaactccagcagggatgctccacagtggacctgtgcagactggtgcaatcttgcttcctagactgccagtctctgctggcaggtaagacatcagagtgccagggggtccctttggcccactgggaacagggagtttcttgaacattattcttccctaggcttgggttccccttggcaagcagggtatgggggcccgagaaagtgggaaccctggcaaccttggaaagaaggccaaagggaagcgctgtggtctccggcaaggggccctgagagaaccgttggtgaatcccaaagccaaaaggaaagtgtttctccacaagttacttggccccttggtgtcccgaaacc

SEQ ID NO: 520100 - DNA, 388 bp, Homo sapiens
ggacgatctctgaggatccccttcgttttactttgtcttcattaatgcctgttgcttgtgctgccttggagtcttgtgcttgatgctgtgaagcacctcactcattcccatagcacgctgtatgcctaggctcacgacaagctcaagtagcaagaagaactgaggagtggtggaacaggctcgaacactggccgaggaggagctctctgcctgccagaagagtctcgtcctgctcccacagtttggacggaccaagctgatttatctgtcacactcaggctcatgggcaggtaccagaagggtaattaaggtgctgtgtgaagtgcactgctgggagcccttagaacacagatacaagagaagtccggaagtctttgctggtggcaaa

SEQ ID NO: 520101 - DNA, 135 bp, Homo sapiens
accctatctcccaccatcgagcattgcttgaatctataatcaagatgagaatattaacaatagatcattagacatctctgtaaactgtacaaaaaagtcagcctaccgtacagaatatacacaaagtatgtacag

SEQ ID NO: 520102 - DNA, 233 bp, Homo sapiens
ggacgcgtgggcagcgcagcccggagtcgcccaggcctgaactcctacacaggtccccggccccacgcaccgggacccgcgaggacaccggaggccaaccaccgagggtggggagcggagcgcgcagtgtcagctctgactaagcgccaccgcagctaggaccatagatccaggacggaaaaagaaagctggataaagacatagagattaagacccatcacaagaaaatacaa

SEQ ID NO: 520103 - DNA, 119 bp, Homo sapiens
ctagaggatccctgtgctcatgtgatcctcagcctcagcctccaagtagctgggattacaggtgaatgccaccaacccaatgactttttatattattacgtagagatagggtttcacca

SEQ ID NO: 520104 - DNA, 171 bp, Homo sapiens
catgatacaatcgagctctgtacctgatcattcgtgtccgcatcggtgtatcgaatacgtcggggcgttccggataggccgagaaagctgttgcgtgaagaaagttagatgtacgccgatcaatattattagtgaacatgggttccggcgcttagtttggtctacgggagt

SEQ ID NO: 520105 - DNA, 261 bp, Homo sapiens
actgggtgcaccatgcttcctttggaagcttaaggtgaaagctattgggagctcgctactccgctggctttgaggaatcatccgtgcacggcaagtggtccttcaacacagggctggttcagattgaatagctggtaagtcaggtctctctttcagtggtgtactcagggttccgtcagtagcagccattcatgtagcctccagtgtattgaatcagtgcccaataggtggtcagtgtagagcacaattctgatctctgcg

SEQ ID NO: 520106 - DNA, 873 bp, Homo sapiens
  misc_feature (6)..(6): n is a, c, g, or t
  misc_feature (75)..(75): n is a, c, g, or t
  misc_feature (85)..(85): n is a, c, g, or t
  misc_feature (103)..(103): n is a, c, g, or t
  misc_feature (118)..(118): n is a, c, g, or t
  misc_feature (122)..(122): n is a, c, g, or t
  misc_feature (131)..(131): n is a, c, g, or t
  misc_feature (221)..(221): n is a, c, g, or t
  misc_feature (232)..(232): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (356)..(357): n is a, c, g, or t
  misc_feature (363)..(363): n is a, c, g, or t
  misc_feature (425)..(425): n is a, c, g, or t
  misc_feature (460)..(460): n is a, c, g, or t
  misc_feature (602)..(602): n is a, c, g, or t
  misc_feature (714)..(714): n is a, c, g, or t
  misc_feature (724)..(724): n is a, c, g, or t
  misc_feature (742)..(743): n is a, c, g, or t
  misc_feature (754)..(754): n is a, c, g, or t
  misc_feature (760)..(760): n is a, c, g, or t
  misc_feature (786)..(786): n is a, c, g, or t
  misc_feature (791)..(791): n is a, c, g, or t
  misc_feature (807)..(807): n is a, c, g, or t
  misc_feature (860)..(860): n is a, c, g, or t
caaagngatcatcattgaggcttctgttaaaagttcttccaaagtagcccagttttaagattaaagcaatattgnactttaagangagctagacgggggggcnggcggcggcaaagangggngggggtgcnccatctgtgcttttcttagactaaaagcgatactgcagaaaactctattttaaaaatcgaacactgcagggtacagtaacataggaaagnacctgcctatnttagaatccnagngancatttcattgtaagaaactagcccattatttaagtgtccacagtatttttcatttcagtggtccaagatgcgaaggtttccagacacaatcttgttctcgaatactgnnccaggngggatatcaattctgtcaccatgatttgcaatgatgataaccgtcccctggaatgaaacagnttttccaaatgtcacatcgcctgaaactgtgaggngatccaattcaagcatatctggtatactttcaaatcttctgagataatcttgaaccttcggaaaagaactgcctaatttaaccaagggcactggaggaaattcccgcttttcactcattgtcagagatcctgcattaagacnatagaggggtggcatcaccagcaagagatctgatgtggttttgacaggcagaaaacggctccgggcacattaatacgctagagaattctcaaaacttttgatggcagccccntactgcagtntctaattgaatgacattnnggcctccatcngggggntttgcattcacaatgatttccatgtnaatgncattttgctcctgcantcttttaactgctgctagagaaatccataggttgtttgtattaaatattttgnactttgatacaga

SEQ ID NO: 520107 - DNA, 664 bp, Homo sapiens
cttggggtgggaaggggacgggaatggggtcagtgggcttgagtgtgcctagtatgcatggcagctccctctccctgcctcctccccagtgtgtgttcagtgctgcagtggtgtgccatgcatggcccttcagtggccccttatcttgtgccttgtgaacgtatgtgtgtacattgagccatgcaaggcccaatgaatggacagaggaatatgatgccccacaacagagagctgattgtccaggtaatgagaatgcccccgtcccatgcacctgacagccactggcgctctgagccccctgtcgcagcgtcggggcgcgtccatgcatggcccatccaggggagtggtcagacacatgcttggcttgtggatgccttgctggcaccactgcggccgtggacccatcccagaagtgggaccctcagtatggcgggattctgtgctccaggacgcctggggagtctcatgcccaggacaatggcgaggccccccttgtagtactacagactttagctacaaaggtggcccacctgggcccaaaggcgaggctaggattccctgtgcctccaattcccctctttgaaaggctcttgcacagttgttgcctgcaaggatgtgctaccttggagccttgggtggccaggcatctagagtgccaaagggg

SEQ ID NO: 520108 - DNA, 186 bp, Homo sapiens
acgactaccagcagcactctcgcccagcctcggcctaaaagggaaatcttaattaatcaggtagggttcacacgatatttcttttttaaacacaaccccaccctcctagagaagcacaagggtcacgagtctggtccacacaacttcagcttggcatcacgagtctggtatcccaagacactcagg

SEQ ID NO: 520109 - DNA, 228 bp, Homo sapiens
tggtgtctctgcaggatccccttcaatgctacccgcctttgaaaatacttagagtgtcaaacgcatggcccgatccgcctggcattccgctagtctagtcaatagtgtgaatatgaccgcggttctattttgttggttttcggaactcaggccttcattaatagggacggccgggggcattcgtcttgcgccgctagaggtgaaattcttggaccggcgcaagacgga

SEQ ID NO: 520110 - DNA, 231 bp, Homo sapiens
ctactctattgttaaccacttataagggtctgttaggaatagtatgtgggcagagaaaaagtacaaattttacctgctttacaattcttccagagctactctagaagccacatgactaagtagaaaaaaatctttcagtgcacaataaaaacctcagctttaagtcaattttcccatcttaaaagtacttaccatgggccggacatggtggctcacacctgtaatcccagc

SEQ ID NO: 520111 - DNA, 435 bp, Homo sapiens
  misc_feature (45)..(45): n is a, c, g, or t
  misc_feature (78)..(78): n is a, c, g, or t
ctgggtcaagggaaggaagtcttttaaacaagaccgaagtttctntctcccacaagggagtcacatctttgtattttnatatttgccagataacatccatagactcactctttcccgtaatccacagttccatggagtactataatagctgccataaaagtaagtgtgcatcccctgcttgctccaccggttccctggtaacaacttgctggggctttgcaacatggcctactaaccaacaatcactagggctaatcatgcttaccaaaataccttcagaaccagattgtaaaactaacatttgcaatcctgtgaatcttaccaccttggagccaaattggctcgtatggactacaggtttaaaagcaccactgagggtacaagccagcagccaagaaatagactcaagagtctatgtctatattatatacataa

SEQ ID NO: 520112 - DNA, 941 bp, Homo sapiens
tccacccgggggcccggggggccccctccggggccccttcctgggaaattttctttttttcccccccctttttttttattttttagggggcgccgctgttgttccctactcctaaaaacgaacaggtcggcccaaaaaaataatatttctttctcgtggcgtgagtgtgaaaatattatcatttaatttccgcccagagtgttgatagaaagagttgtgtggcgtgcccaccccccaaccaccagcttgttgttgtgactacgcgttgctacactcaaacatgacgtggtgtgataattttttggagctcacacagtgtgtagtagtgggccttatattgttgggcggcccccaaaatattattattaacccgctcgtgctctgtgtgaaaacaaaaaaactgtgttcaacatagaaggtgtgctgctgtccacatattttcaacaagaacaccaaaccaaacatggtggtgctgttggagatcttttctcgtggagaacccccctctcctgttcttataacccagcggcgcggcgcgatcgccgcaacttacctcaccacttatttttgtgggcccacttgttggggccgccctctttgaacacgatcattcctctcattgcaggggtcgtctcacaaccagatcttcttgtagacttcttcaccaagcggccgtcttttctattcttcccaccctattatatgggtggcgcccaccccctttgttttttttcaaccgctctcctcttcctaatacaaacgcgcggcgtttacagagtaccatcatcgtacctctcgtggttctcctatatgcgtccccctacgagttgtggccccgcgatattacctcctgcacccccgatggcagggcgaccgttctacgccgcccttaattgcggtgtttgttatcccgccttttttgtttctgccccagcatcggg

SEQ ID NO: 520113 - DNA, 173 bp, Homo sapiens
ctctagacggactccccctcgctgggggcgacactgagcaggtgcaaagttatctgaacggagggacaggctgggcaggtataagcaaggcttcaggcctcattctccaagcccacttccagccccaggcaagagaagcccgtcgctgggggcgcaactgctggaggggcaca

SEQ ID NO: 520114 - DNA, 272 bp, Homo sapiens
acccctgcatcccggggagcgggagtttccctgtaggagtttatcatccaatttgaggagggcagcagggggcactatttcctcagggtgaggtctttagttaggcctcccagcccaagctaagccatcatatcccctgtgacctgcacgtatacatccagatagcctgaagcaactgtaaaaatatccttaactgatgacattccaatattgtgatttgtttctgccctaccctgactgatcaatgtgctttgtaatctccccggatacag

SEQ ID NO: 520115 - DNA, 272 bp, Homo sapiens
atcgagtcggtacacatgatgctcaccgctcagcctaggtgacagagtgagactcacaaaaaaaaaaaaaaaaagggctttgggtgttttttaaattcccaaaaggttaaccagaaagatcgctaccaaatacttgtttataattaaggggatccggggttaaaggacccaatattctacttagacggaaaaggactatcaaggtccggggtccagaattcactggcatttcctctctttaagcaacagtaaaaatgtggtattttccaaaa

SEQ ID NO: 520116 - DNA, 259 bp, Homo sapiens
  misc_feature (7)..(7): n is a, c, g, or t
  misc_feature (17)..(17): n is a, c, g, or t
  misc_feature (82)..(82): n is a, c, g, or t
  misc_feature (108)..(108): n is a, c, g, or t
  misc_feature (201)..(201): n is a, c, g, or t
  misc_feature (203)..(203): n is a, c, g, or t
  misc_feature (217)..(217): n is a, c, g, or t
  misc_feature (228)..(228): n is a, c, g, or t
ctcaccntcccacccangattgtgaggcctccccagccatgtggagctatgagtacattaaacttctttcccttataaattncccagtctcatgtatgtctttattanaagtgtgaaaacagactaatacactggtaaagcactatttgggctgtgtctgtgaggatatttccagaggagattagtgtgtgagtctgagtntnctgggtggggaatntctgctcttgntgtttcaagtgtttttgaagattataccagt

SEQ ID NO: 520117 - DNA, 521 bp, Homo sapiens
  misc_feature (39)..(39): n is a, c, g, or t
  misc_feature (67)..(67): n is a, c, g, or t
  misc_feature (125)..(126): n is a, c, g, or t
ttgtttgaaaaaaaaaaaaaaacccccttcccctctttnaccccccccccccccaaaaaatttttanttttaataaaaaagggggggggggggccttcttccccttgtgggaagggggggaaaannttttttttttttttttttcaaaaaaatttttataaacctctttttttttttggggcggccccacaccttttcttataaaaaaaaaaattttttttttcccccccccccccccccccaaaaaaaaaaaatttcttttccggggaaaatttccccacaaaaaaaaaaaaattttttttttcccccccccccccgaaaaaaaaaaaacccccccccttttttttggaaaaaaaaaaaaggttttttaaacaaaaaaaaaaaagtttgtgggggccccccccccaaaacccccgtaagagaaaaaaaaacgcccaaggatttttccccccaaaaaaccccccccccccctttttgggggccccccccttttttttttttttcccccacccctaagggga

SEQ ID NO: 520118 - DNA, 400 bp, Homo sapiens
  misc_feature (63)..(63): n is a, c, g, or t
  misc_feature (154)..(154): n is a, c, g, or t
  misc_feature (288)..(288): n is a, c, g, or t
  misc_feature (324)..(324): n is a, c, g, or t
  misc_feature (329)..(329): n is a, c, g, or t
cagaagcaggagcaaaatatggcctttcttctaagagatataatgttcactaatgtggttatnttatattaagcctacaacatttttcagtttgcaaatagaactaatactggtgaaaatttacctaaaaccttggttatcaaatacatctccngtacattccgttcttttttttttgagacagtctcgctctgtcgcccaggctggagtgcagtggcgcaatctcggctcactgcaacctccacctcccgggttcacgccattctcctgcctcagcctcccgagtanctgggattacgggcgcccgccaccacgcccggctanttttntgtattatgtagtaagagacagcggtttcaccgtgctctagtcactggatggtctcgatctccatgatctt

SEQ ID NO: 520119 - DNA, 278 bp, Homo sapiens
  misc_feature (1)..(1): n is a, c, g, or t
nttccggacgcatctgcggtttatttttagcaccaactttaaggatttttattatgacaatagaggggaatgagcatttggcaagggggacgaaaaatccccccaaatatgcgagtgtgttaacataatgattgcagtttatttttcactcaggggaaatccaagatgggggtgcctgatctgcctgtgactctcctccaacccagactcctttcaaactggggctggggggggttcaatatggagcttccaaaatcaccctgctgccctgcatcaag

SEQ ID NO: 520120 - DNA, 159 bp, Homo sapiens
agaagctgggtgatgttctggtggacgtggaagatactggaacgacaccagcatttaggcaaaagccagtcgtattttgcatccgaagggaggaaaatagggttctcatctcccgggatttggttgagctggatggcaatggggacaatcttgttggcc

SEQ ID NO: 520121 - DNA, 287 bp, Homo sapiens
  misc_feature (47)..(47): n is a, c, g, or t
  misc_feature (186)..(186): n is a, c, g, or t
aaagtcaaactatctctctttgtggatgataggattctataccttgnaaaccctaaaaactccaccgaaaggctcctggaactaatacatgacttcagcaaagtttcaggctacaaaatcaatgtacaaaaatcaattacataatttctacacaccaacaatattcaagctgagagccaaatcagnacacaatcccatttataatagccacaccaaaaacaaaacaccaacataaaaaatcctaggagtacgtataaccaagaagatgaaagatctctacaaggaga

SEQ ID NO: 520122 - DNA, 163 bp, Homo sapiens
gcaccactgcactcaagcctgtgcgacagagtgagactctgtctcataacagacagacaaaactatatgacactgtattggtgatttatgatatgcatttggcagaagtatacagtatctctttgcttgaatctataaaaccatggaccttagttaataatag

SEQ ID NO: 520123 - DNA, 558 bp, Homo sapiens
  misc_feature (366)..(366): n is a, c, g, or t
  misc_feature (475)..(475): n is a, c, g, or t
caccgcgctcgcttccgcgctgtcaggctagcgccgccgtccccagccgtcaccatgatcatctaccgggacctcatcagccatgacgagctgttctccgacatctacaagatccgggagatcgcggacgggctgtgctggaggtggagggcaagatggtcagtagaacagagggtgccatcgatgactcgctcatcggtggaaatgcttccgctgaaggtccggaaggcgaaggtaccgaaagcacagtagtcaccggtgttgacattgtcatgaaccatcacttacaagaaaccagcttcacaaaagaggctttacaaaaagtacatcaaagacttacatgaaatcacttcaaaggcaaacttngaagagcagaaaccagaaagagttaaagccttttatgactggagctgcagagcagatttaagcacatccttgctaattttcaataactaccagtttttttatttggtgnaaaacatggatccagatgggtatggtttgctctccttggactaccggttgaagatggtgtgactcccattccatgattttctt

SEQ ID NO: 520124 - DNA, 159 bp, Homo sapiens
gttatgtcaaaacaaatgataagccatacacaagcactatagtgacgaactctgatctcttatagctaggagtgcgttaatcatttgtattgccacacatgtagagctcctcggattccggcctcactcatttacaccgcaatcggccatcttcgagga

SEQ ID NO: 520125 - DNA, 491 bp, Homo sapiens
aaacgaaatccctgatttacctgaaaataattcagaagggtgattattaagctaatcaaggaggcaccagagaagggtgaagtccaacttttaaaaaattcaaaaaatgatacaagaaatgaggagagaaatcttcagtgaagagattgcatacattttttgttgttgttgtttttgagacggagtttcgctcttgtcacccaggctggagtgcaatggagtgatcttggctcactgcaacctccgcctcccaggttcaagccattctcctgcctcagcctcctgagtagctggggctacaggcacccaccactacgcccagctaagttttgtattttcagtagagacggggtttcaccatgttggccaggctgatcgcgaactcctgacctcaagggatctgcccaccttggcctcccaaagtgctgggattacaggcatgagccaccgcatctggctatgatagtactttttgataatgagctttaaaa

SEQ ID NO: 520126 - DNA, 1885 bp, Homo sapiens
ggactcatggctgctcgcagagctctgccacttcgtattcaatgtgtggaaactcgcttccagacggacgcgataacgtatcgcggacgtcctggtggcatgagcggttcttgctggcgatgatggaatttggcaacgaaggcgtgcaaagcatgccctgtcacatgcggtcatgatcaccgttgtctacgttacgagatctgcctctgtaggctctagactcacgaccccgtggataacaagcaagaacgagctctcgtccaacagcccttcatgaatagggcacaatcggcacgtcaacagacgagatggtgcggatattcgtggccgtgaggcgcatggatctattggaggctcagcgaaacccgtgcatcgttcaacagatatcacacgggccggtccgcgaagcacttgacacacgacgtatgcgccacactgcaccctccacacatgagggacactttcaacagacgtaccgccattccatcagctcgcacggagcatagctacgagccgacactgcacagaggaacgcctgggcatgtctcggggcccaagcttggcaacgtggatacatggattcggacacgagcaacgaggactggttatatccactcgggaaacatagccccggcaagggtactcccgcaggcgagcaaaggcaggtatattacttagcagcgattttacactaatttgactatagagcgaggcacacattaccggacgcgagtgataccgttgggcgccatcacaaggaagtcccagcaggatatttacgcacttgggatcacctagcacagacacaacacgggattcagaaggcattaccggataactgcgacttgaaggacttcatgctcccagctgggaacatttcccttatgacccgaagctgacacggttcacccgttcgtggatatcactcttaaaccctgtcgggcggcatggtctacacaagtgtccagtaagagctagtggatgttgagaaaacattcgcaagagcacagagtgcagagcaattcggaacaaacacacagcacgggaatgtcgaatcgacggaataaagcaaggtcctatagcaatgcgcgtcacacatatcatgtggagcgttggacagaagactatactaactgggaccgtttggacaggttagtacgtccaccccccacgagcgtggtgttctaacatcgatcgcgttgtggtggacaagacgccagttaacctacgggcgcgcgtcctagctatatcagataaccgagcaacgatagtgacagtacgggcttgtgagcacaacgcgcgcagtgattgctccaagtcgcgcacaaagaggccgcagtacaatgatggtgagcgagcagccacaggggtggtaaggacacagtaagcaaagcgaataaggaggccaccacccacccgaaagggaagcacaagtacaagacacaagcccagagcgaatactcgtactgaaggaatatacccaactgttatgagacatgggcaaataagaaccgtgcgcgcagcgacagatcgccgcacagaacaccggagactacatcaggcaacatagcaccacacccatggggagaaagacggaccactagtgggaaacagcaccactcaccaaaggccgaaacgaacacgctccacacaacacagactgtcaagcaagcgggactagagacacagaaggaacacgtcagcggcgaccacagaacacagctcattacgtagcgtcaaccacggcacacgaggcagcgcacagtcagagcacaacgtacgcgagcgaacaaggcgagccacagtgcgtcgacaaatcaaacacgcaagtcataacagcaccaggaacacgaacccatacagaagcaatgggacaacgaacaag

SEQ ID NO: 520127 - DNA, 827 bp, Homo sapiens
aaatcgacgctgctgcgtggcttcagcaaaatgtttgaactgtacccggagcagcgtgcggaaggtgaaagtctgcttgatggcgacaacatcctgaccaactctcaggatatcgcactgctgcgtgcgaaagtgggcatggtgttccagaaaccgacgccgtttccgatgtccatgtggggacaacatcgcttttggcgttcgtctgtttgagaagctctcccgtgccgacatggacgagcgcgtgcagtgggcattgaccaaagccgcattgtggaacgaaaccaaagataaattgcaccagagcggttactctctctctggtggtcagcaacagcgtctgtgtattgcgcgtggtatcgccattcgcccggaagtgctgctgctcgacgaaccgtgttcggcgctcgaccctatctctaccgggcgtattgaagagctgatcaccgaactgaagcaggattacaccgtgggtgatcggcacccacaacatgcagcaggctgcgcgttgttccaccacaccggggttatgtacctgggcgaattgattgagttcagcaacacggacgatctgttcaccaagccagcgaaaaaccaacagaagactacatcaccgggtcgtaacggtgattcaggatggcgtttggacatgctaatcttataaacatatttcggccagtcaccgcgaactggaagtttccgacccagtgaggccctgggcggatgggggacatcactttttgatcatcaccgattctaaccagacaggtctgggaatccgcttcaggcaacaacgtaattgatgaggtggacgtgatctcgtgcga

SEQ ID NO: 520128 - DNA, 844 bp, Homo sapiens
gtgtgtgtgtgtgtgtgtgtgtccgtgtccctgagttaagaatggtttttaggcttgtataggattaaaaaaaaaaaaaaacccacagaaaattgtgggcgcccagataaaataccgcctttcacaaaattgtttggctgcccccggaactggtcactctcgggttacaagagttgggtttctttgaaacagtctgggctctgtcacccaggctgggagtgcagtgggcatgatctcgggtcactgcagcctccacctcccgggttcaagcgattctgcctcagcctcctgagtagctggggattacgggtgtgcccaccacagacagctattttacagggtgtacaccaccacagccccaggaattcgcttgaacccgggaggtgtgggcgttgcggtgagccgagatcatggcagctggtactcccagtcggggtgacacactgtctgaacaaataacagtttagttctaggtacaacttagtggtctacccaaccaggaagctgtgaaattagaagtaatttaaaagcatacttacccctctatataactcaaagtaggggcaagataaacacttgtcagtcacaacgatgttctcattatttcagatagggagccctgccacaataaaatcatttgtgaaagcggtagggggtgtatacatctgcacaaaatccctgacttgtttcacatttagtggactcgaccccttggtgtaagccttgggtgggcaagaaggttcctagagagcagaatttgaactcccatgggcatcccaggtggcgcggcagaaaggcggaaagcccatcttttgacgaaaccccgggcaacaccgggcgacac

SEQ ID NO: 520129 - DNA, 207 bp, Homo sapiens
aagtcgggctgaccaggtgaggccgcaggtctaagaccaaggaagcacgcaagcgcgtgaaagcgctccaggcaagaaggaggagatcatcaagactttatccaaggaggaagagaccaagaaataaaacctcccacttggtcggtacatacgggcctcggtgattacttagatcatgccgttaaaataaaacaagccttatcggcg

SEQ ID NO: 520130 - DNA, 159 bp, Homo sapiens
aaaaattttgtgttattaacaaaaattcatatttgggggggcttaacggtatttcaaaaggtcatcaaattgtgagactgcttcccttaaacatttttgtgctattgttttaaaaaaataattaaaaaacagttggggttaataaaaatgtccatgtga

SEQ ID NO: 520131 - DNA, 773 bp, Homo sapiens
  misc_feature (85)..(85): n is a, c, g, or t
  misc_feature (92)..(92): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (118)..(118): n is a, c, g, or t
  misc_feature (121)..(121): n is a, c, g, or t
agcttctcctccaggtctgacaagaaagggccaaagaccattgcagagatgaggaagcaggacctggctaaagacacggacccancaaagtnaagctcctngnctngatgagggcaangancgggacatcccggccctgctgtccaccttgcacacagtgctgtgggacggggagagcccgctggaacgcccgtgggcatggccgacctggtggctccggagcaagtgaagaagcactatcgccgcgcggtgctggccgtgcaccccgaccaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaa

SEQ ID NO: 520132 - DNA, 300 bp, Homo sapiens
ggaagggtggaggtgagggtggacccatctggctgtgctgcacagtgtcctcccccgaaccatcgaccgcctaggtcttttctctggccgtttccaggcaccttcaccgtcccctttccttcgacaggggacgtagccttttcttgctctggaagcccagggaggtttaacagttaaaaaaggaaaggactaacgtgctccggaaaggtggaggtttctcttttaagtccttggtctaaaaagcgctgtcccttttttctctcccccttttttttttctaaataaaatttgcccacttta

SEQ ID NO: 520133 - DNA, 803 bp, Homo sapiens
  misc_feature (85)..(85): n is a, c, g, or t
  misc_feature (92)..(92): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (118)..(118): n is a, c, g, or t
  misc_feature (121)..(121): n is a, c, g, or t
agcttctcctccaggtctgacaagaaagggccaaagaccattgcagagatgaggaagcaggacctggctaaagacacggacccancaaagtnaagctcctngnctngatgagggcaangancgggacatcccggccctgctgtccaccttgcacacagtgctgtgggacggggagagcccgctggaacgcccgtgggcatggccgacctggtggctccggagcaagtgaagaagcactatcgccgcgcggtgctggccgtgcaccccgaccaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaaaaaaaaaaaaaaaattggcgcgcagcttat

SEQ ID NO: 520134 - DNA, 271 bp, Homo sapiens
  misc_feature (49)..(50): n is a, c, g, or t
  misc_feature (52)..(52): n is a, c, g, or t
cgcggccgcgcgacaggctgcgagaagacgacagagggcagaagagaanncnccaaagcctctgagttgcctctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaa

SEQ ID NO: 520135 - DNA, 1365 bp, Homo sapiens
ggtgaagaaaatatgttagaaaggaccccataaaaagaaaatgaaaggactttgcattccgtggctcaaaggttgcagtgctcaacaatcatgtggtaaatttcccagtcacaacaggcagttcagcaacatgtcagggtcacaaatgcaattcaaaacttctttttcaaacaaacatccattcgttgaccgttcatttaacagcagtcaagccggtctccctagggccatgcgaacagtcaaagcaggcaacactcacaacaacccagcacacagtcacacataggaccactggcatcattagccagcttgcccattgtggggccattatgatccagcacttccaagggaaaccttaagaagggttccccacacggttttatatcacaccacaaaggccttgcggcaatccacacttctaactggccaacacgcaacccaagcggcgccacattataagagaggccacattatggtacacaacacgacaagagagagcaattagcgcaagcaaaatttttggcaacacagaccaccttttacgccgttttattgcagtaaaagttttaagagaagcacgggagcccaagattgggttagcaactagtgtttctgtcgggaacacaatgagggcgtattagttaacgccacctagttaccggggatatacagaagcagtgattgtttgatacaacgcacgggggggtgctatcacggaacaccattgttcatcggtagcaacacacacagaacctgcgacgaatgctcaggttaccgctgaaaagcatacagaaaaggagccaaacaataaaaaggaggtgtgaccaacaagcggcacaccctgtgggctgggcccccaaacaatatggtggagttcaaacacaacgaagaggcttaacgaagtcatggaagcagcactacccggaattagactaggtaagagagaaccgacgatacctacacgaacaacggcggtccccaaacaacaaacgacgggggtagcactcaacactggcacaagtagacttaccgccaaagttatactagcacccagtattccaccgagatgccagtcgagggagaaaaagggacggaggcacacaacacaaccatttgatagaatgagggggcaaccccaagatgttatgagtttgacagagaaaaagtcaagcaggatctagtcagtgttcgatacaaaaggggcgtggagaggaacacacacaaccacgttataatcatcgtacgtggggcaagttatattgatcacccgtcatgtattaggtatgcatacgtctgccaacaccgaacatagatactagtgagggcggcagacgaacaaatcgtatgtaatcactcagacaagca

SEQ ID NO: 520136 - DNA, 443 bp, Homo sapiens
gactctaatccattctcatatggaccattctagcctcctcaccttgcttacctgtaaattcccactccaactgtaagaaacctggctcccactatccatcattgatttatttatttgttctattccagtatgcttgtgcagtcatgtgctgcattttggtcaatgatagaccacatatgcaacagtggtcctgtaagtttacagtggggctgaaaaattcctactgcctactgatgttgtagctattatcatgtagcttgatgcattactcgtgtttgtgatgatactggtgtaaacaaacctactgctctgccagttgtataatattatagcacatacaaatacacacagtacatacttgaaaggtgactatgttactagtttgtgtatttattatactgtactttttatcactgtatgacagcatactccttctacttatt

SEQ ID NO: 520137 - DNA, 744 bp, Homo sapiens
  misc_feature (85)..(85): n is a, c, g, or t
  misc_feature (92)..(92): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (118)..(118): n is a, c, g, or t
  misc_feature (121)..(121): n is a, c, g, or t
agcttctcctccaggtctgacaagaaagggccaaagaccattgcagagatgaggaagcaggacctggctaaagacacggacccancaaagtnaagctcctngnctngatgagggcaangancgggacatcccggccctgctgtccaccttgcacacagtgctgtgggacggggagagcccgctggaacgcccgtgggcatggccgacctggtggctccggagcaagtgaagaagcactatcgccgcgcggtgctggccgtgcaccccgaccaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttccttttctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatgaa

SEQ ID NO: 520138 - DNA, 462 bp, Homo sapiens
  misc_feature (85)..(85): n is a, c, g, or t
  misc_feature (92)..(92): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (118)..(118): n is a, c, g, or t
  misc_feature (121)..(121): n is a, c, g, or t
agcttctcctccaggtctgacaagaaagggccaaagaccattgcagagatgaggaagcaggacctggctaaagacacggacccancaaagtnaagctcctngnctngatgagggcaangancgggacatcccggccctgctgtccaccttgcacacagtgctgtgggacggggagagcccgctggaacgcccgtgggcatggccgacctggtggctccggagcaagtgaagaagcactatcgccgcgcggtgctggccgtgcaccccgaccaaggctgcggggcagccgtacgagcagcacgccaagatgatcttcatggagctgaatgacgcctggtcggagtttgagaaccagggctcccggcccctcttctgatggcgctcatgggccctggtgtttgcaccgcactttgtaatcagtcccgtggttgtctgtacagaattaaactattttccgatgaa

SEQ ID NO: 520139 - DNA, 402 bp, Homo sapiens
tggttagggttgtgggaggttgtgagggttgtgtaggaggtgtagaaaggatagggtatttagagatgcggttaatttatttcttgtttagtattggggtaagtttttgaggtgataaatgatatgtgtttagctgaaggatgttataggtttattcttttattaaggagtattaggttaaggagaatgattttgataggctggtgctatagtatgtttctagtgcttgaggttggcccagagttgttaggaccatgaagtcaggacagaggtcaggagccagccttgcagccctccccacccggcatccacctgcatcccctttgggggcaggagcccacccccagcacccccatctgttaataaatatctcaactccagggtgttccacctgaaaaaaaa

SEQ ID NO: 520140 - DNA, 311 bp, Homo sapiens
ctcggacctgttcgagctgggcgagctttgggctcctcttacgtgggctgtggcttttcggtgtgacacactttccattgtgttacgacacggactgacgatcttcacagccggggcttcttttcgggaaaggctgcagaggccgcctgctcacaggattacctcttctgatccttgggttcctgatccacagtttcctgacggcaggctaggacttctgtctggcgattgcctcggcacgtgccacgttgtctgtctccgcctggatccccgaacgccccatgactcctctgggacttcgggaaccctcc

SEQ ID NO: 520141 - DNA, 1611 bp, Homo sapiens
  misc_feature (1031)..(1031): n is a, c, g, or t
  misc_feature (1089)..(1089): n is a, c, g, or t
tctggtgtgctggctctgtgttcgagaccgacacaggtgtgttgcttgttgccacacgctgtgtctatgtgttgttcgtggcttgtgtgtctccgatgacgaagagttggggggagtccttctgtcgggtggcccctccatatatgttggtaggtgccgcctcgtcgtggggggtgttctctttctccgtgtcagtggcaatgttgggctcggtcgtgttggtaagcacgtttgcttcttgtctcgttggtcccgctggtgtggggggggttctcctatagttatgtcgccccctctgttggttgggtgtagccttgtgggccgaccgcatcagtaggtgatgtcatcttattttgcagtgcaacatggtggtgtttacacatcaatccctcttcaagtgaatagtgtgtttaatactcgatccactgttctgtctaataatagatggtttgatcccacccacgaatggtcttcaatttgttgcccaccatctccaccatatttatctgttatttcttgtgtgaaaaccccaacgccttatgaggctccctccgttgttttgtataatatagtgacataaaattgttgtcgtgggccctcccccccacctgtgttatgcctttggaggatggtgtcgccaacagaaagtgtgttttggaggggagggtcaacacctgtgttccacgtctgtgtggtcttggtcgcaccacacgagaaacattgtgtctgttcttttggtccacaacgttagtcactgtgtttgttatgacgggttattacataatatattatgatgtggtattagagtgtcgctatcgatgtgttggtgttctgttggtggtgtacaacacatgccccggtatgatggtgtgtggtgcggcttccacgagtgtaccacagcgagaaacgtggtgataccgtggccgtttatagttctctgtgtgtgtacactcttgtgtgtgaaacaaaatgttctgtaggatagaagatgtgtataaatggccccctgcgtgttcacacataggtggaanaatattgtgtcccgtagaggttgtggtgtccacagttggttgaagatgtatatagggngggcaccacacaactgtgtgttctcacagcggccactgctcgtattgctcacagaggatttatcgtatttgtgctttctgtgtctccgtgcgtgccccacggcccacacacatgtgtggtatgatgtatcgttgcgggcctcacacgcccacgtgtctcgtgtcgtatatatacgtatgaggtggccacgcccaacgcggtgtatatggagacactatataaaagaaatgtgttctgtgtggcgtcacataatggttgaaattgtggcacgcgttgtacagaatggtaactgccaccgcgggtgattctatgggccacggctggtgttgtccacggtccacatgtggttttcgcggtcccccgtatgacacgcgcctttggctatacccccgctgaggctaaccttgaaactgtcaaggggcatctgcctataacccagaatcttttgtccagaacacccttaacccccaccgacaccaattttgaatagctcatgccccggctcttaggaattttgtctgg

SEQ ID NO: 520142 - DNA, 271 bp, Homo sapiens
  misc_feature (128)..(128): n is a, c, g, or t
  misc_feature (242)..(242): n is a, c, g, or t
agtcgtcaagcctgtaatcccaacactttgggagaccgaggtgggggtatcgattgagcctcggaggtcgagatcagcctgggaaacacagggaggcccccatcgctacaaaatattttaaaaattanccaggtgtggtggcttgtgcttgttgtcccggctacttgggaggctgaagtgggagggtggcttgagtccaggagttcactgcactgagctgtgatcacaccactgcactccancctggacgacagagtgagacgtccatctc

SEQ ID NO: 520143 - DNA, 365 bp, Homo sapiens
  misc_feature (8)..(8): n is a, c, g, or t
  misc_feature (276)..(276): n is a, c, g, or t
  misc_feature (292)..(292): n is a, c, g, or t
  misc_feature (303)..(303): n is a, c, g, or t
  misc_feature (319)..(319): n is a, c, g, or t
  misc_feature (340)..(340): n is a, c, g, or t
  misc_feature (353)..(353): n is a, c, g, or t
tcggcgtnggtcttggcttactgcaacctctgcctcccagattcaagtgattctctcacctcagcctcccaagtagctggcactacaggcgcattccaccacacccagctaatttttgtatttttagtagagaaggggtttcactatgttggccaggctggtctcgaactcctgacctcgtgatctccccaccttggcctccctaagtgttgggattacaggcgtgacatttggcacccggcaagccacttgccttttttcacttgccaagaggcngattgacacaaaaggnagacgaaaggnaaaccctgatgagggnagatggccctgttggagtctntttgttcttagtngaatgcataggt

SEQ ID NO: 520144 - DNA, 1543 bp, Homo sapiens
gccgggctctgtcgtggagaacggctccgtggatgtgcaaggccggcttcgtgggcgacgatgcgcgccgggccgtacttgccgcctccatcgtgtggggcgccccaagtgcgcccaggggcgtgatgcgtgaggccatgggtccacgaatgtgcattcgtatgcttggtgggaggaggcccaagcagcaggagaggcatccatcacccgtgaacgtagcccatcggcgcaagggcatcggtcgacgcactcatggggacgacgatgcgagaagacactcgctgggacgaccagcggccggtacgtacaatagagctagcagtggtggactcccgaggaagcaaggcccgtgactgctggacccgaggaccaccccatggaagcccgcagagggccaaacactgccgacgaaatgcgcttgaccgcatcgaatcactgggtacgtgacgacaccctgtcgacactatcgcgccctaggtacactgggtccctggttgacttactctgatgcgcgatgttgcgtaatacaccttggatatcaggcacatacatggcgcgggaaactccactttggccagtccggtgaagtatcgagagcgtcaccgggcgttagaaccgagcgaggagtaccaaccacgcaaaagacattttggatggcccaccagtcgttaacgggaagtcggtgaggtaaattcggaccccatccgcaccagagcaattgctccaaatcccattgtcgggatccattgggagcccgtgtggcgcatgggcgccgtgtggtgacacgtgggctatggaccctaagggtatcacttggaccacgatatccggtcgacagctgagaaacgggcggagcaaacacaaggcgttccaacacgaggcacaacggagtacccagaacgcgtggggcacaaattgggatgccgagtggacacaccattcacaggaagacgacacacccatgtggacagaaacagacacagcccccacgggcacagtagcgcatagcccaaaggaggacatgagcacaggagagaggggccaaacccacgaaggtccaacccccttggcgacgaaagaagaacaacagaacactgacccatataccagggaacaaggggacacagaccacccaacttgtagcaacaggcagcacgtgaaccccgaacacaccagaagcaagcaacaaagcaagcacatacccctccaggggccacagtgaagccagtagggaacacgcacaaaagcaaccctgccacaccacgcagtgacaagggaccacaggacacatcggagaaggacacggagccaagacagaggacagaggcgaggccacacgagtcacggacatgacggaggaacacagaagacacggagaggccgcagagaagacaacgacagaacgcacacgagacaagaaggaacgaagcaaccaggcgagcaccagacgaggacaaccagcagaggaggcacagacacgaggaacaaacaaaccaaagcaaagagaaagaggagaaacaagacaaagcaaagaacacacaca

SEQ ID NO: 520145 - DNA, 330 bp, Homo sapiens
  misc_feature (2)..(2): n is a, c, g, or t
  misc_feature (86)..(86): n is a, c, g, or t
  misc_feature (112)..(112): n is a, c, g, or t
  misc_feature (116)..(116): n is a, c, g, or t
  misc_feature (141)..(141): n is a, c, g, or t
  misc_feature (145)..(145): n is a, c, g, or t
  misc_feature (261)..(261): n is a, c, g, or t
  misc_feature (329)..(329): n is a, c, g, or t
tnaagtaaagaaaaccacatgcaagggaaaccaaatgaaaaggagaagatgatctcaggacagaaattggaaatagaacgactggnaaagaaaaacaaaactttagaatatnaganagagattttagagaaaacaaccacnatcnatgaggaagataaacgcaattggcaacaggaacttgaaactcagaaccagaaacatcagcgacagttttcggacaaacgcagattagaagccagggtgcaaggcaaggggacaganacgacaaagaagtgggagacagaagtgagcgtagagtggcagccaaacagcggggggggcggaataanc

SEQ ID NO: 520146 - DNA, 823 bp, Homo sapiens
cggcgccctttttttttttgttgtttttccaatgaactctgaactttttattgggcctcctgctccccaaagggtaccctgtttctgctggctttaagtgccttcaaaactttgtgggtgtcatgtggctctcaaacaccacttttgccatccactatatccgggcggggtgggtggctctttgtggagtggtttgcattggagtttgcgtgctgttccaaggcattcaccaagatttaaagttccttcgccatctttccagaaggccggccggatagggttggcaactcttcaggcctcacagtgttgacctttgatgtgtttcagacaggggccttcaatacctccgtgggcctgtggacgcgtgttcccttctgtgcccgggtctctgttgcccgagctctcgtgcacctcaaggtgtgcagcgaggaatcccggtttgaagcgtgcttcccatcgtgttaggggcagtaggcgggcactccaccttccctcaagggctggttcctccaaggcgttggccttcaaaatttctcatgggagtccagggtcgatctccaaggactggactgtagcgtctcagctctgtgaaccgtcgtctcagcagctccaacctcagagactgggtggtgcaccactgtgggtgccccctcaatctgctggaacccggatccgtgtttaagtctcctatcgggaccttcccgaaggccagttgccaattagggggccgagttttttcccaatatctgggagggccacaaataggggagagaatccaccggggtacaacacggcacactggccgtagacaaaaaacacagag

SEQ ID NO: 520147 - DNA, 685 bp, Homo sapiens
ggaggatctgggcccccctggaatgttccagatgtgaagccattctcacagacaccgttcaccttgttcactgactcccccatctactgacctcccagggtacgagccggccaagaccgtaacaccctggcataaatcactaccgacactacggaccccgaggaccagcataggcagcaacgaacagcaagcgcgtacggcgcacaccgcaagacgtacgcacgagacagggactacccgctcagatgcgagcacgcccgatcatccacgcacaaccactagacgcgaacacacaagcgccggagccgccgcccctgcggcagagacacccacgaccaacaaggcacggccaacgccggacggggacaataaccgcgcccacgagcccacggccaagcacaccgcctgcgaacccgcaccaccgggaggcccacactcctgacgcggaagcagactgggtagaccgaacagagaaacgacaggaaggagaggaggacgacccaccaacacagccgcaactgacgggtgccccagcccgagccgacgaacaacagcgcccaccacgagacgccacccaccgaaccccacacgaccacccacagcgtcactcaacgaccgcccgagaccggacggcacaaccccacgaccgaggacgaaaccaacaccggtgcgacgaccgcgacga

SEQ ID NO: 520148 - DNA, 171 bp, Homo sapiens
tagaggatccctttaatgtggcatgatgcaaagaactgaggagtgtgagaagggttgctgggagagatacggggaggagcctccgggggataaagggaatcgtataaagtcgatgtagggccggtgagggagaggttttggctcaggttatcaatgaccaacaatttattg

SEQ ID NO: 520149 - DNA, 262 bp, Homo sapiens
gtataatatgctgtctcacttcattcaaatctatattcaatgtcattttatcagaggaggccttccctgaccgtcctccacaataatgctacccccaatccattctctacctcccttactgatttatctagcttatcatccctgacacattgaatatttgctttctgtctgcctctccccacgtgtagagtctgagactttacagtccactggtacatacaagttactcaataaaattattaaatcagactcaatctttcca

SEQ ID NO: 520150 - DNA, 399 bp, Homo sapiens
ggcacgaggctggttcctgagctctaggctgctaagctgagccacacacccctccgtttgcaccagttgcatgcaagttgcatcgaccctccaacaaccatatcggaagcgcagtacatggcttctaacccgcgaacacagccatggcagcaagggtctggcaatgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatag

SEQ ID NO: 520151 - DNA, 176 bp, Homo sapiens
cggagcgatgatgtcctttctcgggagacaagtcgggaaagtctggctgtacttcttcagccccgcgcgcctcctggactcaggttccccgtctctgagctcgggtagatgtttcagagtcacattgccgcccggttctgctcacgcagaggtctcaacttgctacctgcgtccct

SEQ ID NO: 520152 - DNA, 287 bp, Homo sapiens
actcgcaacccaaggagcaaagactagaaaacctcccccgcatctataatcacccttccccccaccccctctagagagaccattcccaacgcggcgggtcacccatctcatccacctcgggagaataaaaaaaacccccccccccccacaaaaaactaaaccccccccccccgccaaaagaacaaaacaccccccgcccggggaaaaaaaatgcccccccgcccgccgtaaacaaaaaccaccccgacacatcgtgaaaaaaaaagccccaacccaagctagtcata

SEQ ID NO: 520153 - DNA, 557 bp, Homo sapiens
gatctagagcatccctttcttgccctcccatctactggctatagtcaatcgaataacctttctctgatctccaagtaccggtgactcagggtgggctctcagtctccacattgaggatacgagcctgaatgaggattctataacaatctcagaagaaagcattggggaacgtcttcatgacactggattaggcaatgcttgcctggatataacaccaagaggatgggacacaaaagaaaaagatttagataaagctagacttcaagaatgataaagtgtcgtgcatcaaaggaacagatcaggagtggaaaaggtaacccacagaagggtagaaaatatttgcaaatcattgacaggttgtgcatatgaaatccaataatctgaaatcggaaatgctccaaactccaaaactttgggagcactggcatgatgctcaaagaaaatgcttatagaagcataccgaatctcaagttcgtggatatagaatgcttaactggggctggacacggtggctcacacctgtaatcccagcagtctggggggccgaggtggaggat

SEQ ID NO: 520154 - DNA, 141 bp, Homo sapiens
atctgaggactgagatgtgccacaaagagaagggcatatggagccatgttgctccatgtacaacagcagcagacttactgccatttatttctagtagtgctcggcaccctgaatggcacaaaggatgagtcagcgaattga

SEQ ID NO: 520155 - DNA, 215 bp, Homo sapiens
  misc_feature (108)..(108): n is a, c, g, or t
ccccttaaaagggacccccccttttttttcacccccggggttccaaaagggggggtttttttttttaaacccaagggggggcagggccctttttcccccggaaaattnttttttttttttttttttaaacccgttttggaaaagggggccccccccccccccctttttgtttccggggccctttttttttttaaaaaaaagggggggggggggga

SEQ ID NO: 520156 - DNA, 143 bp, Homo sapiens
gcaagctcgctcccaggtgcagagagcggggaacaatcactttgggctaggcaacctagcagaagtgaacagataggattacatgaggtgaaaaagcttatgtacagcaaaggaaacaatcaagaaagtgatggttccccgcg

SEQ ID NO: 520157 - DNA, 535 bp, Homo sapiens
ctgcagtttccggcacgagttctgttgttccgccttcagagatgcactaagccggtaagatctgctcggccttcgcatcttgagtctgcagtaatctgtattttccccactgcactctttaaaccccgtcggacagagcgagatcttgtccaaaaaatcaatggacggatgcatggaacgagttcgtcatggcaagaaaaatacaagaatgttggttttagggccatgctacattttaaatgtgtctcgaacttcccagtagaagggtttaatagtcaatgaaatatctggctctggaacttggtcgttgatgtagttaaaatgtcctatcattttagcttgcgtattactgttatctgtccagcacgaatggattctgtttggctttcggcatatgtcacgagctatccacatcagttgttgttacaaaggcgtagtcaataaggtggtcctgtatgttgccgtaggccttcgtagcaaattccctgggtagggcagaaaaggccatataaaattctcggggaccgcaatttgt

SEQ ID NO: 520158 - DNA, 378 bp, Homo sapiens
ttctgtctagaggaatagagtggaacgtaaagtcgagaaatgcaagtattcacagtagaaagatgttggtcatcgggtggtcaatgtgtgattgagggcataggctgaattccttcttcactggctggcagtaatgggctttatgtccaaaagtacccaagttctggtcgttctgacaggctcatcttctcgtgattcatcattgaaagaggtagaactgatcagcatttgcacattgtctctcgccgcagccatttctctatagcataatctcttcggccgttatctcttgtaatgaattttggaagagcacatctagtagccctgtcctcagcgcatgtaagggctgttctgcaactaccaacattctgtgttctg

SEQ ID NO: 520159 - DNA, 1498 bp, Homo sapiens
  misc_feature (176)..(176): n is a, c, g, or t
  misc_feature (381)..(381): n is a, c, g, or t
  misc_feature (624)..(624): n is a, c, g, or t
  misc_feature (715)..(715): n is a, c, g, or t
tccatggggatgatgttttaaatggtggagggcaaaatcagcccacaatacaaatactctaaaatatcacccccattttccccaccgggcccccggggaagggggagaacgctgggggtgttccttttgcgcctgcagggttgtggggagagggacgcaagaggaggcgccaaaanaggggaagaagggaacacaagatgcgccaacaaatgcgcctgggctgagagagttctcctgtgtcgtgtttgccccctgtgccctgtgttccctgtggaagctgtgccctgtgtggccctcctgtgtgtgccctctctttcaccgggtgtgccaccgcctgtgtgtgtgtggcgccccaagcccccacaactctgtgttctgtgngctctgtgcgcccctgtgagagagaggctctcgcgcgcccaccacgagtgttgtgcactctcaagtatctctctctattctcttctctctcacagagccgccctttctcgagagtgctgtgagagtcgcctctctgtgtgtcccccctctctatgtgtgggaatctctgtgtcgtccactgtggcacggacgtgtggctactccctctgtgagagatattgtggacactctcctctctatatnacactgtgagacacatctctctctgtgtctcacacttttctctcccgctgtgtgggcccgaaggggcccaccccagaggacaccgggaaanaacagccgagtatgcagagcggcgggggggcaccccgaggttctatgacgggggagggggcccagtgctcgtgagagcccgttgctctgtgaagagaatatgtgtgccctcgtggtgtggcacacatagtgtggttagagggccccccgggggccgcgcaaaatatttttgggggtcgtgtccaaagcctctgtggcgttgtgtcacacacaattctcagcgcgctcagcaggggggtaaatacacattttcttttcacaaaaacgcctgggtatttgtcccaaaaagggcgcgacaagaacaacgtcaatagcgcgatattggagaaataaatcccccttgggggaaaatttggcaccagaaatattttctcccacaaaatggtcccccaaggctttgtgggcccgaaacgttgttgttttcttgggcccgtgccaaaggggaccctgttttttctccacgaagggaggactatccctgcgtggggggggcaacacagcccccctcaagttcttctgttggggggtggtgcccctcctccacaaagaggagacactcttgtggggcccccacgtgtgggtctcacctccacatctcacacctttgtgtggggtggccccccctatttttcccccccgagaagaacactctctctctgtgctaatatataagaaaaaatcctctcgcgcccccacagtggaatgtgttaccccgcggttgtgttgcatcctttgtttggaggagaggggcggaggaggccctactatcaccccataggggaga

SEQ ID NO: 520160 - DNA, 453 bp, Homo sapiens
  misc_feature (29)..(29): n is a, c, g, or t
  misc_feature (32)..(32): n is a, c, g, or t
  misc_feature (42)..(42): n is a, c, g, or t
ttagacagggtctcactctgttgcctggnctngaggacagtngcatgattccagctcaccgcaacctctgcctccaaggctcaggtgatcctcccacctcagcctcctgagtagcagggactacaggtgcacaccaccacacctggctaatttttgtatcttttgtagagacaggttttcgccatgttacccaggctagtcttgaactcccatgctcaagtgatccactcaccttggcctctgaaagtgctaggattacaggcatgggccaccacaccaggcctatgctaaaacttcttcagtttcaccactggtggtgaacttaaaacatgggaaaaaccagggaaaaacccaggtcaaattttcttactctgttctctttagcaccacagacatccacagtcaccacgggcaaatgggaagtttaaaaaggaagagtgcttggcccggggt

SEQ ID NO: 520161 - DNA, 338 bp, Homo sapiens
  misc_feature (333)..(333): n is a, c, g, or t
  misc_feature (335)..(335): n is a, c, g, or t
  misc_feature (338)..(338): n is a, c, g, or t
gagaagagtccgggaaaacaattgtattccccagcctgtgtcccctgggcacaagcaaatccccaaattccccctcctgaaccctcccaaatttgtcctaagaacttcgaaaactttaacaaacaggctgatatccttcataatattcccagcctagacccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttcntntgn

SEQ ID NO: 520162 - DNA, 419 bp, Homo sapiens
  misc_feature (8)..(8): n is a, c, g, or t
  misc_feature (23)..(23): n is a, c, g, or t
  misc_feature (28)..(29): n is a, c, g, or t
  misc_feature (34)..(35): n is a, c, g, or t
  misc_feature (59)..(59): n is a, c, g, or t
  misc_feature (74)..(74): n is a, c, g, or t
  misc_feature (83)..(83): n is a, c, g, or t
  misc_feature (87)..(87): n is a, c, g, or t
  misc_feature (92)..(93): n is a, c, g, or t
  misc_feature (95)..(95): n is a, c, g, or t
  misc_feature (108)..(108): n is a, c, g, or t
  misc_feature (128)..(128): n is a, c, g, or t
  misc_feature (139)..(139): n is a, c, g, or t
  misc_feature (191)..(191): n is a, c, g, or t
  misc_feature (193)..(193): n is a, c, g, or t
  misc_feature (265)..(265): n is a, c, g, or t
agctaacnaagcacaacacagcnaagcnngacannaagaaaggacaaggagcctttcanttttccagcctgcantggcagtgntttncgtgnncnttcctttcagatngagaaggggacaaaaagacnttcctttcatngtccagaagaatgtatgtaactaaagctttgtcctctgtgaagaattataananggaggggggaaaggattcgcctctcctacagaaattctgaattcatttaagtctaagcatttgatttatgtnatttatacagttgggatctaattaggaaatgtgttttgtagttctggataaactatttcatccgctgtttcctcccaaaacacacacacagagcaaactccctttcataaaagccctcatatccactggcagtcccgttcgcatcatggtctca

SEQ ID NO: 520163 - DNA, 341 bp, Homo sapiens
  misc_feature (13)..(13): n is a, c, g, or t
  misc_feature (58)..(58): n is a, c, g, or t
  misc_feature (122)..(122): n is a, c, g, or t
ggaatggattcanatgcaatgtaatgtaatggaatcgtaaataatgggatggactcgnattgtaatggattgtattggaatggactagaatggaaatggactcggaatggaatggaacaaanatggaatggataggattggaatgtactcgaatgtaaatgactagaagggaatagacttgaatggaattgactcgaatggaatacaatcggatggaatggaatgcaatggaaaggaatggagtggaatggaatggactgtaatcgaatggactcgaaaggaagggactcgaatggaatggaatcaaattgaatggaatcaaaaggaatggacgtcgacgc

SEQ ID NO: 520164 - DNA, 708 bp, Homo sapiens
  misc_feature (6)..(6): n is a, c, g, or t
  misc_feature (539)..(539): n is a, c, g, or t
ccagcntcagcttcgtccagcaaccccagctccagtcatgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatggtgtggcacctccgatcagttaatacttagaaggagccagaaataagtgtattttcggtatcttctatcccctcaaaggcatcagancatgggaaagattggtttaataccaaagaaaggcttctctctggtggagaatcgtgtctcgagcgctacttgtattcctggcattggggaagcgcagtatcgcaggaggctaaatgtcaaatagaactgacaccagaactaggtggattccaggagaataagggataaa

SEQ ID NO: 520165 - DNA, 336 bp, Homo sapiens
  misc_feature (78)..(78): n is a, c, g, or t
  misc_feature (81)..(81): n is a, c, g, or t
  misc_feature (290)..(290): n is a, c, g, or t
  misc_feature (336)..(336): n is a, c, g, or t
gagatactgtgaatgcttgtacagatcagctgctgagactcagacatacgagatgagagacaagtcagctctccattncgncaggaatgtgggaactgctacgggctcatatgaaggcagagctcccacattctctatgtaattggctgactgcatcagtggctctgggagagctcaatagctcagcgactgaggggctggggcgtttgtcattgacagtgccacctggtcatcgggctatgcccaggtggcctgctaccatgctgtggtggaggctttggaacagatanctccataaagatggcatcatcacagaaggttctaggcagccggtgn

SEQ ID NO: 520166 - DNA, 267 bp, Homo sapiens
  misc_feature (223)..(223): n is a, c, g, or t
  misc_feature (234)..(234): n is a, c, g, or t
cagtatcagggggggagccggatggagtttgctatgtgtgagcgggaggcagattttgggacggggctgttgtgggttatgccagcttggagcaggctgggggggggggaattgcatggtgggctccggccacccagactcccccacccccactcccttttccactgctctgacctcgggcactgttgaaatatagtttttattgcatttctgccgttttacnaaaatatgacnaaataaattaaaaccaataaataatcgcctgtt

SEQ ID NO: 520167 - DNA, 142 bp, Homo sapiens
ccaaatacgatgacatcaaggagtcgatccgtcagcgtgacttgaatacaccaccgccgacgacccgaaagcctgatgaggagaagtccagaatcaggaacaacggcgacactcgactaaccattttaaaccaattggaacc

SEQ ID NO: 520168 - DNA, 1271 bp, Homo sapiens
cctgtcaggtcccagaagtccaggccgacgggcgcctctgcagctgagatgattgaaacaaaatcttccaaaccggtgcctaagcctcgggtcggcgtgaggaaatccgcactaggaaccacctgatatggaccaagatgcccaatcccatgccagtagtctcctgggttgtggaccccaaaccagactctaagacggagcctcagcaccaagtatagagaccactatactatctaaaacaacccactaccctgtactccactagtctacactagagcctttgccatccgatactttctgctagtcctacaactactactccttaccagctgctgcatgccaaggccccacctagcactgggacctgctacctactatgggcgggcggcagcgtatgacgctgtacacttgcagctctacgcacctaccaccaccgaacactagtgaattctaccccccttgggcctgaggacacgcttgacgggggatgacgttgccctattgacaggtgggcactcacgacgggcctcacgggctcctgttgccacccatggaaacgcctcacaacggagcagagcacatgctgagacccacgacaggtaccaacggccaagcatcctccaagcagagcaatcccaaactacgacacctgcctagttacccccagaggctagcggcatggagacgtcaagcatgtaggcctatcacatcccatcctagactcaggcatcagctaccatagaatccacacagcactagtgaaacaccgactaggccacaagcacactacaatcgtagacattagcaactatacaacattattcgcaggaatccacccacactccacgctaggagaaccaaccacatatgctcacgaaatatccccaacgactcctctagccatcaactagtgaacgcgactagataatgtacccactagcccacaaagtgactcaatcccaaaaatatactccgaaacaatatattctgtgctaccataccatattcaacaagaccactagcaccctatcgttatagtcaaccctctgtacctcaccagacacaacaattcacatcatcacctatatgtaaccaagattccacacacgccaactacaacaagcgtaccaaaacataatctactccacacacacaagacgccactaacacagtaacctccactccaaactgctagagtagtcatcactccacaacaaattctacacgagatacacagcaaatacatactaaacaaacagactaacaacgcg

SEQ ID NO: 520169 - DNA, 416 bp, Homo sapiens
gctctagagatccaccgaagcacactgcacactactttcatcttacaaaactgaagctctatacccatgaaacaacgactccctactccttccttcttccagtccctggcaaccaccatttactttctgcttctgtgagtgtgactactcctgtagtgaaatcagaaaataatttgtcttgtgactggcttatttcactaagcgtagtctcctcaaggtttatccacgttgtagcatgtccttcctttttaaagctgaataatcgtccattgtacgcatataccacattatgtttatccatttgtctgtggaaggacacttgggttgctttcaccttttgactattgtgaataatgctaccatagacatggtgtacaaatatctctttgaaaccctgtttcaattattttagacat

SEQ ID NO: 520170 - DNA, 1202 bp, Homo sapiens
  misc_feature (215)..(215): n is a, c, g, or t
  misc_feature (218)..(218): n is a, c, g, or t
aggtggagcaccagctacgcgtggcgcagcgcagcgtccctagcaccgagcctcccgcagccggccgagatgctgcgaacagagatgtgccggccccatgtgtcgccctgccgtggacatggtttgccggcgggctgtccccggctcctgcttgcttgctgctgcatgctcgccttgtgtgcgctggtgctgccttgcccggagtttgctccaantanttaccttcaagggatttacaggccttgaaacaaacaagcttacaggtttggtgggacattggggggcattccaagacggccaccttggggacgggagcgccttttgcatttagtggattatggggaattgctccccaaagagccttcaggggaaacaagaatttgcaaaaaaaggaattacatttaacttaagagggggggtttcttattttcatttattcgaagaccacagaagtttgggcaatgtcaacagtggtcgggtggtcggatcaggttggtggcattcccggtttggcattggcaaggctttcggtttttccccctttccaagcccattgggccaattttgaacggaagggaacacggacaactttggacaggcacaggcaattttccaaggaacggtgtgggactgcaatggaatattttcccacaagagttcccactctttggcacgacgggttccacaacacgtttccgggacgggcgaattaattattagaatataattttcccagtgggcgcacaccgtgtgtcacacgttgggcacacacgacaacaggggggtcccatggcccagaggggcgcttctccaagttttttacaaacacagttggggtggatttgtgccccgatggccttttaaaaattttattttaccaccagacgcaatgggaagggcaaaagattgggcattaaagttgggcgcgaacaatttaccccaaacatacagcgttggtttataaccgttggtgaaacccaaattatattcatgaggcttatattatccccattttcccgttgtgcgaaacacaaaatacacacttcccctattgtggactataaacacaagttgtggtttaacccttcccgtgtggcattctcggcaacacgcataattatctcccccccttagtgattgtgtctttttcgggttctcacacacactcatggggtctctcccacttccacacaggtcattaa

SEQ ID NO: 520171 - DNA, 601 bp, Homo sapiens
acataaacaaatttaaagatgcaatattaaatataactgtataaagttcactgcaacacatcttggactactgtgataatttaaagatgcagtgttaaattgtaactgtataaagttcactgtagccgggcgtggtggctcatgcttgtagtcccggcactttggggggccaaggcaggtggatcacctgaggtcaggagttccagaccagcctggccaatttggtgaaacctgctctctactaaaaatacaaaaaaattggctgggcatgttggcaggcacctgtaatcccagctactcggaaggctgaggcaggagaattgcttgaacctgggaggcagaggttgcagtgagctgaggttgcgccattgcactccagcctgggcaacaagaacaaaactccatctcaaaaacaaaaaaaaaaaaaaataaaaataaaaaaaaaaaaaaacacataattaaatataaataaagcatgcgccgcatttcgagctaatttggccaattcgccctatagggagcggttaacaattaatggccggggttttaaacgtcgggactgggccctggcgttacccaactttcgctttggctccccctt

SEQ ID NO: 520172 - DNA, 326 bp, Homo sapiens
  misc_feature (40)..(40): n is a, c, g, or t
  misc_feature (284)..(284): n is a, c, g, or t
ctgaatgtgtgtttcgagctagaaaatcccgggagtggcnaatcggagattcgtttcttatctataatagacatctgaagccctggcccatcccatgaaacccaggctgtagagaggattgaggccttaagttttgggttaaatgacagttgcccaggtgtcgctcattagggaaaggggttaagtgaaaatgctgtataaactgcatgatgtttgcaggcagttgtggttttcctgcccagcctgccaccaccgggccatgcggatatgttgtccagcccaanaccacaggaccatttctgtatgtaagacaattctatccagac

SEQ ID NO: 520173 - DNA, 280 bp, Homo sapiens
attcgcgggcgcgtcgactggttgtcaagggttggatatgggggtaggttgagcttgcttaaaacatgaaaggtcgtccttgtttctaacttaagtttaatgagggcatctttgattcttcactctcgttaatgacatgttcaactttttaaacggattcttccaaaaggacaattttatgaatctttaaaacctgaatgaaaagagtgttagctcataagtattggctttgctgctggttgtccccatttctgccttccctactccaggcaaaattatt

SEQ ID NO: 520174 - DNA, 131 bp, Homo sapiens
tattttaatgtcatttggcattgtggcagtaaatgcagttctttaaggatacacatcttcagatttaaaagaacaggctaggaaaccatttctctcttttttattatttatttatatatatttattttatt

SEQ ID NO: 520175 - DNA, 444 bp, Homo sapiens
  misc_feature (125)..(126): n is a, c, g, or t
  misc_feature (128)..(128): n is a, c, g, or t
  misc_feature (232)..(232): n is a, c, g, or t
  misc_feature (278)..(278): n is a, c, g, or t
  misc_feature (281)..(281): n is a, c, g, or t
  misc_feature (348)..(348): n is a, c, g, or t
  misc_feature (396)..(396): n is a, c, g, or t
  misc_feature (426)..(426): n is a, c, g, or t
gttatcaagactggctacttttccaaaactcatactcatctaactgtatcccccttattaggaaatcctttcaggctctagtacaagacctaccctacataaaggacccaagatattgtccaggnngnagatttcttcaagagatcagctttagctccaaattcacaactcccaatgaaccaatctcttagagtgcaaattacagccttgcactcttatcttatcttgcctncttatcttaatctgcctttagataactcaaaggaactgcatcaggntgncaatttattccttgtatttaattgtttaaatatacaattttttactcattattaaccttagtgtaanttgggtaagaggccaatggtccaaggaatggactctaaagggactatnttcctttttcatttagcatgggccatattnattttttaggttacaaaa

SEQ ID NO: 520176 - DNA, 317 bp, Homo sapiens
atattaggcgctaaggtccggctagtgtgtcggctactaaaaggatgtcactcgtttcagtacgccaatgttcgttatgatccttgatccggcacgcttctcagggcgtgatacaagggctcggcagatgtggatccgctgaggcatctttttaccacggtagaggccgcccgctgacacggtttatgcaggcgctgcggacttttagacgaacggttaaaaataatacggaccgtcataagttagaaaatttactctgctttcgaccgatgcattttattgacaccttacaaaaacgtcactacctagcgcctata

SEQ ID NO: 520177 - DNA, 369 bp, Homo sapiens
aggctgtggataattgaaatttacgattaacaattttgtcagaagaatgccttttagtccccggggtcctttattgtgtatgctaataggacaatttaggataaagacagggagtgggttataaagagaaaagcttcattatgtaagttaaggagtaatacaacgcattcactaatgagaagttttaacatattttacttatctacatttgaacagacaatacattcatatagttcaaaactcaggctgggtgcattggctcacgcctgtgatcgcagcagtttgggaggccaaggcaggtggatcacctggggtcaggggtttgagaccagcctggtcaacatgatggaaccccatctctacttaaga

SEQ ID NO: 520178 - DNA, 232 bp, Homo sapiens
ccgggtttttttggggggccaataaacctaagtttgcctttttttgggccgtggcctgccgtttccgttggggtctccctagaaattcttttttgcctgggggcctggggaggttttttgtccccccggggggcccgtaaatgtttttatttttaaaattaaagctgccaaaggaataaaatgggttttataaaaatttggcccctaataaaatcattttttttttcttgga

SEQ ID NO: 520179 - DNA, 742 bp, Homo sapiens
  misc_feature (408)..(408): n is a, c, g, or t
ggtcgccgctgcgaaggtagccgcgcgcgcatgtctgcgtcactctgcaattggatggtcgtgcgagaactgctaccagtttcctgatcaatcaggaataatgcactaccttacagcgactgcagcccaaagtaacttgaaggtcgccgcacagttcccttccgctacaatcgcgacttgagttcagcgcgcaacaggaactgtgcgcgccgtggacgccggtcagccgacgagcgagagcgtgtcgtggttggtcattacatcgtgagatccggccagacggaagcctgactacctcctatgtgcggaccaccatcacagcaagaatgcgtcgctgccacgctcacgcagtcatcagacacagtgatccgcaaggaacaagtaccgccccgtagcctgcgcaatggngagcgcatccgcaggggcagacgtccatcctgcgcagccgagaagcctgtgtactggtgaagaggaagcggagccgacccaggcaaagagctcctgaagccccgctgcctgccccatggaggcatatataagctccaggctggactttttcttcagcccataattttctacctaaacacttatggcacgtacgggtccggcttcatcttgtccgggttcgggcgcactggatcccgtaccgcgtaggagcgggccatgtgaccgctggggggttactcggcgccccacctccttcgttcccagtgtggttgatctgttcctggtccccccatag

SEQ ID NO: 520180 - DNA, 100 bp, Homo sapiens
aaagtactgagattacagccacaaggccactgtgcctggctgcaatttatttcttaaataaaataaacctagttgtagtaatatgcattgttccctaatt

SEQ ID NO: 520181 - DNA, 2247 bp, Homo sapiens
  misc_feature (2026)..(2026): n is a, c, g, or t
ccgacagggggagtggtgagtgttgagtagaactaacttggtgttgtgatgtgtgtgggtgtggtgggttgtgtgggggatggatatgtaattgtgtatggttgttgagttggagtgtgttgttgttattattcggtttgtttctgtgttgtttatgagttggtttgttgtgtgtgtggggtgggtggagtgtgagtgtatgtattggtgggggatggtggtggttgtttgtatcttggtgtgatattatatattgtgtgtgtttgtgtggtggagggatggcaagaagtgattgtagttgggtgggtatgtgatatttagtaggttagttgtgtagtagggttggttggagatagtaggtgtttgtggggtggtggtgtggtggtggtgttatgtttgcgtgtgttgtgtgtggattctcatgttatgggtgtgggttgagtggtatttaggttgtgttaggggtgtgggttgtggtgttggttgtttgtatgtggttgtgagtggtgtgtgtgtggtggtgttttagtattgaggattagttgtgtttgttttgtttgggtgtggtggttttattcaaagtatgttgggtggtgggttatcactcagttggtttgtttgttgtagtgtgtggggtggaaaatgttggtttgtggtggtattgtatgtatatctgtatctagtgttgtgtatgtttgtgtgtgtggttggtgtgaagatatgtgtatgtgtatgtagtgagatggttggtgggaggttggtggtgtgtggggtgtggtagttgatcgagggtggggaggtgagggtagagggtgcggttgtggtgcatgtgtatgttgtgtggtggtggtggttggtcgggtgtgaggatttaatggggtgtgtgtgtttggtcgacgttttgagggttggattgttggttgtgtggtttttgagttgatgtagtggggggtgttggtggtgtgttgtgttgggttggagatgtgagtgtgggtggatggagtgggcggtctatcgtggagtggtgtacgctgtctgtcgttgttgtgttgttgtttttgtctccgtcgtgcgcggttggtggttgcagtgtggtggtcttgatctgttcgtgttggtggtgttgtgtgatgggtctggtggttggaggtagttgttgttgtgctgtcgagtagcgacggggtgtgggaggagcaccgccgacagcgtcagggtatgtggatgtgtggtgtcgttgttgttgtgtgtctctcgtccgtcggtgtcgttggtcgtgggtggggtgtgtgtactgattgcttcctgctcctctctctttggtcttgttctgttgtttttgttgtgttggtgttggtgtgggtgatgtctgctactgctgcgctgggtggtggagtggagatgaagaagtgcagcagcagcgctgctgttggtgtgtagccactcacttcgttggctgttgtggtcttgttgacggagggggttgttgtgttgtggcgtgctctcgacaccaccctactcatctacacacaccacgcgacacactctgtgttgtgtgttctactgctgcgcggtggtgggggtgatatacacgacaagagatgagcggagggggggtgtggacgcgctgcgctcgtcgtctgcagtgctgtggtgtgtggggatgttgagaggtgtgttgatgagtgatgtgctggggggtgcgcgctgcgtgcgtgggatttcgctcggtgtttgtagttagggtggggtggtgtgttgatgtaagtgtagtgctgtgtggtgtttcgctcacacgcgcgcgaagtgagaagtagtaggtgtgtaactctgtcttatataatgagtgtgtgtgtgacgacacaacacacaccgcggttgggtggtgtttgctgcagcacggtgggtcaccactgcgcgcacactcacgcgcgagtggttcgcgttcgttagttctcttgtgtgtgacacactgcttgtgtgtgagtgtgtgttgtgtgtgtgcggtatgtatgtggttagtaggacncgtccgagcgccccgtgcgtgtgtgtgtgatggatatatatatatatatgatgtatagacaacacacacatatatatttaaaatttaatgttatgactattaagtttataataagcaaaaggatgtatagatacgttcgaaggctagtgtagtggttcatggggactaggtagtatgatgttgtgtactgttgtccttgttttgttggtttggtggtgttt

SEQ ID NO: 520182 - DNA, 525 bp, Homo sapiens
  misc_feature (347)..(347): n is a, c, g, or t
gatgtcagtccctttcacaatctttttttaagctggaagaagctaaacatgctttgtgccattgaagaatatagcttttctcaagcaacattggaccaggttttggtagaactcactaaagaacaacgaggaggaccgatacatagtggtggacctttaaacagcacacttgggtgggaacgaacacaagaagatagagtagtatttggacattggtatggtccggtctgcttactgggacttctttcctttttccacttaattttaacttgtggtttaacaacagtttctttatcgggacatggtaactgggagaaccaagaacgcaccttgaaatttttcctaangctccttaacttggaaactgctgtggttgctgtgttatggcttttctttaacactaaaacgtatgtatcattcaagtgaagctgcatgtttgtatcgacagtatattgaactatatagttcgtatgtcatctttttcaccattcagcaacacagtgcttctgaatttgtgatttaccg

SEQ ID NO: 520183 - DNA, 90 bp, Homo sapiens
gcggccgcctactactactactgctcgaattcaagcttctaacgatgtacggggacatgtgaaaaaaaaaaaacatgaaagttgtactgc

SEQ ID NO: 520184 - DNA, 1039 bp, Homo sapiens
  misc_feature (28)..(28): n is a, c, g, or t
  misc_feature (94)..(95): n is a, c, g, or t
  misc_feature (140)..(140): n is a, c, g, or t
  misc_feature (160)..(160): n is a, c, g, or t
  misc_feature (169)..(169): n is a, c, g, or t
  misc_feature (190)..(190): n is a, c, g, or t
  misc_feature (199)..(199): n is a, c, g, or t
  misc_feature (203)..(203): n is a, c, g, or t
  misc_feature (206)..(206): n is a, c, g, or t
  misc_feature (214)..(214): n is a, c, g, or t
  misc_feature (219)..(219): n is a, c, g, or t
  misc_feature (229)..(231): n is a, c, g, or t
  misc_feature (233)..(234): n is a, c, g, or t
  misc_feature (236)..(236): n is a, c, g, or t
  misc_feature (242)..(242): n is a, c, g, or t
  misc_feature (246)..(246): n is a, c, g, or t
  misc_feature (258)..(258): n is a, c, g, or t
  misc_feature (265)..(265): n is a, c, g, or t
  misc_feature (273)..(274): n is a, c, g, or t
  misc_feature (299)..(299): n is a, c, g, or t
  misc_feature (303)..(305): n is a, c, g, or t
  misc_feature (307)..(307): n is a, c, g, or t
  misc_feature (323)..(323): n is a, c, g, or t
  misc_feature (394)..(394): n is a, c, g, or t
  misc_feature (396)..(397): n is a, c, g, or t
  misc_feature (406)..(407): n is a, c, g, or t
  misc_feature (422)..(422): n is a, c, g, or t
  misc_feature (474)..(474): n is a, c, g, or t
  misc_feature (560)..(560): n is a, c, g, or t
  misc_feature (567)..(567): n is a, c, g, or t
  misc_feature (574)..(574): n is a, c, g, or t
  misc_feature (626)..(626): n is a, c, g, or t
  misc_feature (633)..(633): n is a, c, g, or t
  misc_feature (663)..(663): n is a, c, g, or t
  misc_feature (692)..(692): n is a, c, g, or t
  misc_feature (715)..(715): n is a, c, g, or t
  misc_feature (722)..(722): n is a, c, g, or t
  misc_feature (760)..(760): n is a, c, g, or t
  misc_feature (770)..(770): n is a, c, g, or t
  misc_feature (783)..(783): n is a, c, g, or t
  misc_feature (854)..(854): n is a, c, g, or t
  misc_feature (862)..(862): n is a, c, g, or t
  misc_feature (876)..(876): n is a, c, g, or t
  misc_feature (886)..(886): n is a, c, g, or t
  misc_feature (902)..(902): n is a, c, g, or t
  misc_feature (950)..(950): n is a, c, g, or t
  misc_feature (952)..(952): n is a, c, g, or t
  misc_feature (972)..(972): n is a, c, g, or t
  misc_feature (1034)..(1034): n is a, c, g, or t
actgatcacacacagacaaaaggacagnccctgccctcgaggagctcacagtctagtaaggaagacatatgggagaacgattccccaaagatgnngggagtaggggaggcagtgattagagtggggagacattgtcccanccaccccacgctccaaagtncaggctggntaggagaaagtgagtaggaanagtagatanaatntanataaaatnaaaantctaaatttnnntnntntaattntgtnctaaatatctanaatagangaaaatcnnagagacaaggatgataaggatatangagnnntnctcaaaaagctagaanacccctggcagaatatatacaacggtattttatttcccaaagccgcaaacaagcgcagagaagcggggganannggggaatgnnggaaaaacaggggcngggccagcccagttcagtggtgggaacaggaattgatgagaagaggggtacnagggccagagaagtaggtgagagggaaatttccaggtggagaagctcacagtaggtacaccagcagccacggccaacagaagggcngccaatncagctgngggagccacacagcctttattatggggctgctggggccccccttttgcaggntactgcnctgaattgctgcggtcctggtggccagcgncgcctgcagtcaacctgggctcctcatcncgggaggcctcgtgttctactcnctgtctnggagtctgactggttggcgctggcatgggtttggtggnggatgtgggnctcactggggccnaggtagaagtggtgacagatgtggttgaggccacagtcgtgggctctggagggggcagccggacaaggggngggattcnaggggagaagtagntcttgttgcngaggtcagagttacancgggacccctggcaacaggagccactgagcgtgaaccctgggcctgtnantccataccgagtgcagaatncatcctggacacagccccggacaggcaaggacacagtcacattagctggcgtcaaggtgacntgccc

SEQ ID NO: 520185 - DNA, 124 bp, Homo sapiens
gcctgccttaaacatgctcagaacacttacattagcctacagtgggcaaaactatccaacacaaaatctatattgtaataaagttataaagaattttgaataaaaattcaatatttgaagtaca

SEQ ID NO: 520186 - DNA, 310 bp, Homo sapiens
  misc_feature (24)..(24): n is a, c, g, or t
aatgaggtcctgccaccgcactcnccgccctttttctttttttcccccactttagccagggagggtttttggccctttatttttggggtttttttaaatccccaaggggtattggcaccctttccggttttttctctggtttggttttgccgagggttttttatccaatcccctttttttcccttccggtatttgttgccccggccggttctgctggattttggcctttttttttccggtcctttaaaactgcccaacccctttgtttcttggtcccaactttctttaaattaatttacatgttttttta

SEQ ID NO: 520187 - DNA, 82 bp, Homo sapiens
  misc_feature (37)..(38): n is a, c, g, or t
atgtaatatttaactgatagctgcatgaaagtgaganncgtgttactttggcttttctgtctctgttgacacggttgcacat

SEQ ID NO: 520188 - DNA, 231 bp, Homo sapiens
gctcgacaactgactacactctaatcattcttaggtcatttatgccagaggttgcaaaatttttttgtgaaaaatcatcagaccttggtgctgaccttgagcagtaggatataaataactcccacatgcttaacgttccagtgatggaacactaggcataaatgatttaagtatagccagttattcaggatatagatactaaaaaaaaaacatgtaaatgtgtcgtcgacg

SEQ ID NO: 520189 - DNA, 284 bp, Homo sapiens
tgtcttaagaggggatgggcattgatagcgaagaccccgtagaaagagcatgaaaatgttatgtcacttgataaaaacttatggcaatttactgttatgaagtgtctgttgaagttgaaacaagttctaggtaagccctttgttaagcaaccagaaaatagacagggagaaagcagttagactggaatgctgattagagtcattaattagtaccatgaaagtcccgcagagttaccttccattggaaacctagatgactgcagaattaaaggctttggtggggg

SEQ ID NO: 520190 - DNA, 266 bp, Homo sapiens
agaaagctcgaaagaggagtggtcatccatgttgaaaactgaacgtgtgatgtttgataatgggcttcatttacggtgtgtagtgagcacggttagactcactgttaaagaagctggatgcacttctctaaaaggctgcactttccgtgaacacttttacgtggtacaaatccacatgacccactattctacccctgaggggacgtatggttacagaggtttggtaggcacttaggggagaacgtatactataacacagatttctt

SEQ ID NO: 520191 - DNA, 231 bp, Homo sapiens
tacaccggatacaattctagtcttcaaacacaagatgaagaactcgtgtggacagaggtatctcagccctggatggtgaatatcagtcagcctcagaggttgacttctacattgataaggacatagatccacatcgcggacaccaaggtcgccaggcgttatggggattacttcagtccgtcagatccacaaatttgaggagcttactcgaacccggaagaagaaaatgat

SEQ ID NO: 520192 - DNA, 531 bp, Homo sapiens
  misc_feature (57)..(57): n is a, c, g, or t
  misc_feature (64)..(64): n is a, c, g, or t
  misc_feature (77)..(77): n is a, c, g, or t
  misc_feature (91)..(92): n is a, c, g, or t
  misc_feature (107)..(107): n is a, c, g, or t
  misc_feature (181)..(181): n is a, c, g, or t
  misc_feature (225)..(225): n is a, c, g, or t
  misc_feature (239)..(239): n is a, c, g, or t
  misc_feature (428)..(428): n is a, c, g, or t
  misc_feature (455)..(455): n is a, c, g, or t
agcgggcggagcctctcgggggtcacccggccgccgggccagcgggacgcacggggnccgccangggaggacaacanagcctcaggccctnngtccctgcgccccgncccggcctcccccgcgggggctgcgcagcccaactcggccatcctggcctgaaggggccgcccccgggcctcgncgggaaaaggcctgagcctcccggggccttctcggggccttctncgggactttccccncaggcgggtcctggacctttcttcgggccttctctgggcctcctcggggcttccttgaccctccccaggccttccccgaggcctccaggcccttccctgggcctctccaggctgagctctccgcgacatggccagtgggcctctgggacccggggccgggccaaccggctccacctccattcccaacgnctgctcacatcaagccaggagcaccgnccggttgagaatcctggaaactctctgcgcttagaaaagaaatctttagcaagacattcagtttgccaaaagagac

SEQ ID NO: 520193 - DNA, 816 bp, Homo sapiens
agggcatacgagatgggaagtatagagggaactattcacccgtggggacaaatggattagagtggtataggactgaagggacggaatgtaaaagtgtaccaatactccgaaaaagcgcgagtgaaagagcccagtcacccgttatagagaagtagggaacgcacctgcggccataagaaaataagaccacattccgcaggattggttttgtaagatcccgatatgtgagagggagggttcaatatggagccgggagtccgaactagtattaaagtggtaagcgtagaggaagaggccgggacgaggtaacagcaaagtgaccgaatggcaatggggatgcaaaacaagtcggccccagcaggtggaagggattcaagtggcaagggccttattacaatgggataagctcaagcccatgcaattgaaagtaagacctatactataaggtgaaccaacctagccacggtttaaaggctaaggtgaaattgagatagaaataaatgccagtttatcatgagcgctgcgagtcctgagctacaggcaccaagttgtgctgtgaagggtcatagggagacatctgcatgctcttccgtcatggacacggacacgtgtagtgatttgggtcactgcgtttatatgtaaggcatgattgtcggagagggtccaagtaaggttctgggatgtatctatgtttcaagcgtgaagcccggtggtgttaggggttggcaaaaggtctgtaatgtaagggctatctccattagtggtttcatgcagggagtcatgagcctctgggatgcataaggtaaaaacatttaa

SEQ ID NO: 520194 - DNA, 1235 bp, Homo sapiens
  misc_feature (45)..(45): n is a, c, g, or t
tatatgaattgcgttattcaaacaggatgatttgtaatgaagtcnaaacatagtaatatatagaagtgagacatttgagagggtggctcgcctgattattgtgttccatcatagtgacacttaaacattatactctcttggtagataagattccgagcaggtcgatatcattcttggacacttcctaatcaagatttgtgctaggatttgcggcataattcgtcgtgacctcgattacatgttacctgctacgtgaatgttccacaactatagttgtctaagcgaagattctataagagcagacctgtaggttttcaaatgatttccactgttctgatttgagcgcgatttttgttaggtaaagagccaacagcaatctaatttcgtccttaacttaggtagaaacaatgcattatcattatttgctgacagatcacttgatcctactagatacttctatctcctttttaggatgtctcgcatggaatttgactttcacatcgcaacaaggatggtcgtatagtggaccttatcagaatctgttcacttttcgatacttgtattacacaaaaagtagaataattgctcaaccttcaattatatacactttttaaaagaccgcaagatctttttgaaatccgaaaacccttagtaggtaaatgcttactttaattatggtgtgacgtatagccccaatatgaagggaatggaagaggggctttggtagacaatgttaagtcattgggaaaactaaggcaaattttgaattttttcaattggtgccattccattactgtgtgctgtgttttaggattaattgccgtagggatactttgggctttaattttcactttttttaagtagttggaatatattcccatttggacacaaattataagttacatcaaaataatacttgtaaattacaagaaggcaacgtttggatttacaaaaatttgttaagttttgaactttgagtattaatttgctggggcaggaaattgcaagtttaaggaagagggtaccttttagccagcacttaggaaaggtcccgctttttcacaattctggacttctcctggtattggggcttgttactttgggcttaacctttggattgtgaaggaaccaagcggggacctaacgagaaggggctaaaaacgaactgccttcccaagtagaatggacaaaccagtaaggaagcacccaccctctggttgtgggggtcacaataa

SEQ ID NO: 520195 - DNA, 714 bp, Homo sapiens
cccggggacactggggctcctgaccatatctgaagcaagatgacagcacgaacatgatgctgcgagctgaggaccgtgcatacatgcttgtgccatggacaactgctgtgaaagacaaccatcctgaagaagttcaactggtggagtgacatctgacaccatctccccaacgctgtggacttcaacatcaagaccctggagcaccgaggattcaagctgaacatctgtggatgtgggtggacagaagtccactggtggatcctactggcggaactactttgagagcacctgatggcctcatctggtgtcagtggacaatgcagcagacctgcacagctgcatgcagtgacttgacaccgtggatgctccaagagcctgctggtggcggagctgcctgtgcctggagcaaaccctcctacaatactttgcatactaagcaggcacctgcctgtgagccactgtcctcatatacgcctatcccgacgaggcccatggatgccaggcactcccatcctgcaaccacaaccaccatgggcttgcaatccaacgggcactggcagctggaccggtcaaccgtcgggaagaaagacattgactgcactgatgaactcgacctagtgctccttgtgatgaacataataccaagtaccgcaatttacaccacgcatgaactgacaccaacttccacgattggcccacccacctagccagtcc

SEQ ID NO: 520196 - DNA, 394 bp, Homo sapiens
  misc_feature (97)..(98): n is a, c, g, or t
  misc_feature (135)..(136): n is a, c, g, or t
  misc_feature (353)..(353): n is a, c, g, or t
cccttgctgaaaagtgtaacctgtcagggggctgtgagcctcacatcatgtaagttagccgttattgatgtgcttttcctttattcatttagagatnntttcactctatcgcccacgctggagtacagtggtgcnntcagagctcactgtagccttgaactcctgggctcaggccatccttttcacctcagcttcccaagtagcagggactacaggcatgtaccaccatgtccagctagtttttaaaatttttctgtagaaatgggatcttgctatgttatccaggctggtctcaaactcttggggctcaagtgattctcctggcctcagcgtcccaaagtgctgggcatcancaggttatggagccaagtaccatttacccaagtggacaact

SEQ ID NO: 520197 - DNA, 459 bp, Homo sapiens
  misc_feature (23)..(23): n is a, c, g, or t
  misc_feature (29)..(29): n is a, c, g, or t
  misc_feature (58)..(58): n is a, c, g, or t
  misc_feature (74)..(74): n is a, c, g, or t
  misc_feature (84)..(84): n is a, c, g, or t
  misc_feature (87)..(87): n is a, c, g, or t
  misc_feature (121)..(121): n is a, c, g, or t
  misc_feature (184)..(184): n is a, c, g, or t
  misc_feature (311)..(311): n is a, c, g, or t
tttaaccattccggtgaaccaanaaattnttggggcacggccaaaggcctttgtgccnagaaaattgttggccngttgttttantangggggagaccaagagtttctttttgtggaggagnaaatgatggtgttgggcggtcttccgcatacacttggttcaggggttgggagatgaagaagantccggaggagcccagccccaaagacagcgagaagagcgccatgggggtgtgagcaccacaggcaccttggatggcccggccccggggcccgtacacaggcggggccagcacagtagtgaaggcggtntcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgcc

SEQ ID NO: 520198 - DNA, 227 bp, Homo sapiens
accaaaacccagggaagccccttaacttctaatttacagggcgtttactttaaaaaaggggggcccattaagggtcaacgtcaggggatctggaacaaaatttacttttaccattagcaacctggaacctgattaattcccaacttatttttgcccacaggatcatatttatttcacttttggccccgggaccaccttggaaatgaaaccaactgggggtggaccat

SEQ ID NO: 520199 - DNA, 694 bp, Homo sapiens
ggtgaaatgagcgcaggataaaggaggagacaaggttacagggtgggtggcctgatcacacaggggctagaaagctcttttaaagattatggttgtgaaagagagagcccatggagggtttggacaaaggggtgataggatctgatttatcagtcatctgggttgagaagactgtgcaagaagactagtgagaccgctgcagtgacccaggcgagaggtgatggagctcagaccaggctgtagccatggaggtggtgaggaggaggtggactgtgcgtgtagtctccaggaggagccagctggatttccagatggatgggatgcagggagtgagaacaagagagaagggagggccactgagcttcagcatggagaaggatagtttcatcagctgagactagaaagactatgggtaggccaagcacggtggctcatgcctgtaattccagcactttgggaggctgaggcaggtggatcacctgaggtcaggagttcgagaccagcctgccaacatggtgaaaccctgtctctactaaaaatacaaaaattagccgggtgtggtggcgaacacctgtaatcccagctactcggaaggctgagacaaaagaattgcttgaacctgggaggtggaagttgcagtgagccaagattgtgccactgcactccagctgggcaataaggcagactccgtctc

SEQ ID NO: 520200 - DNA, 157 bp, Homo sapiens
tcaccgtggcgaatggaggcctgggcccggcttctgtttaatccccgaatcatcgcgtgcaacagagcgcgcgcgcggacaatctcattcccagtgctcgctgtgcgcagcagctggagcagatcctgcagggacatcccgagatttccgggtctag

SEQ ID NO: 520201 - DNA, 367 bp, Homo sapiens
gtcgactacattgttatgtcatttcgggaagttccagcatctgtgtaatcttaaccgctgtagcatgcaacttggtttaaggaaaatttctttgagccttattcttgggtgctaattattgaagtacaattaggaaggggagcaaatagggagaagaaatttgtgtttactgagttcctgcaatatgctaagaatgtactggtaatgaaaaaaattggccaggcgtggtgactcatgcctgtaatcccagcactttgggaggacgagagaggtagattgcctcagctcaggagtttgagaccagcctgggcaacgtgagaaacccatctctactaaaaatagaaaaattggctgggcgtggtggtgc

SEQ ID NO: 520202 - DNA, 488 bp, Homo sapiens
tgcaatggcccactcagcgagacactaggcgaggccgacagtgaggggaggttcgacagcgtcatcgtgtgaggctaagtacaagctcatccagaaccggggacaccacagcatcattctcctcttcatctatctcatcacccatggcatcatcaatggtatcattcatcatctcctccttcatatccatgatctctgcctgcagcacaaactccatcatgatcttcaggatctggggcacacgttcagctgtccgttcatgttgcccatggccttggtgacatcgcttcatggcttgttggccatcgagtggttggacttgatgtgtctggatcttgaggagacataggcctgaatgttggcccgcatcaatacaaagttgcgcacagtagcgccgggtgcgcagccaagtctttagccatgatgcgaagggcatccatgtggccttgcttggtgatctgccttgatgtctggaacgatggtcttca

SEQ ID NO: 520203 - DNA, 256 bp, Homo sapiens
tcgagctcggtcccattggtcgagagaaattaggcctacccgtcgcagtatgatcattcttttcccctcttttgatccccacctccaatgtttcatatgcatctgacgaatcagccactcagatcatgtgtctatactctaagactatcctcgaagtaaatgataaccatacacaacactaaaggacgaacctgatctcttatactagtatccttaatcatttttattgccacaactaatttctctcggaccaatg

SEQ ID NO: 520204 - DNA, 921 bp, Homo sapiens
  misc_feature (1)..(1): n is a, c, g, or t
ncgacttcctggtgtgcagctaagggtcaaccctctggtagggatcacttctgggacacaggtgaccagatggtggtgactagattctctaagtgggaatcgtagagttccccagcccttgctttcctgagccagttgcgtgctcctacatggagtacaacggagggcatcctgtcatcctggtctcttccgattgcagctgtatcatccagtaagtggcagctgacgctgtctacaatgtcacgcaatgacagcgctgcatgggtctctactagttacatcgtggcattggaagctgggcccccataggacattccgtggtaaactgcgtggttccaggaattactcccagaccatgtacttgcaagcaaagtgtcttcatgggtaatcgagtctcctcctggaacgcaacttcaacggaacatcatcacgctcgctagtaggattgcgggagtcagaggatctgtgcaggaactcgtgtccttcctgttgcatctccagagtgccagcgtacgtcaacggggagaacattgcggatggcaggctactccagcatcggctctcgagatggagtgcaggtcggcatgcgatagctgtggtcaccaggcccaggagacctgagggggtgtctaggtgatcatttggatctggaggcagagtctgccattctgccagactagcaatttgggggcttactcatgctaggcttgaggaagaagcacgcgccttcggcattctccttaggacattatcgtgcttgtatgatttgtgctgatcacaattaacatagtggggttcattgttgtgggtcatattggagcatgaaggattttatggagctggtgctttggaggaatcattaagggaaatggagtagaagctcaggcctttgaagttacccgctgggtcctctctcgtaga

SEQ ID NO: 520205 - DNA, 982 bp, Homo sapiens
  misc_feature (13)..(13): n is a, c, g, or t
  misc_feature (96)..(96): n is a, c, g, or t
  misc_feature (138)..(138): n is a, c, g, or t
  misc_feature (489)..(489): n is a, c, g, or t
tttgatgatgttngtgtaaaaaaaatgatgtatgaataaagaaagaaataaaaaagagaaaaaaaaaaagggggtaatagaaaatttaaaaaaaanaaaatttttaaaaaaaaaaaaaagaagaaagtgttaaaaaanaagaaaaaaagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatganagacgcaatgcattgtgtagctagttttctggaaaagtcaatcttttaggaattgtttttcagatcttcaataaattttttctttaaatttcaaaaaaaaaaaatagatcaggtatacaaaaagataaattcaagagagctataaaatacctgaagaaaaggtttagaaagatgaagtaaaaaaagctgcatgttagttcttgaagggtaaaacagaggtggggagaggagcaagtctagcctatgtggacctgggttcttctggtaattggaacactttaatgcatccaatgcttaatagggatttataattgaaaagagggggtcagagagggagttttagaaggttgtgtggtgaagatctttaattgatggatggtgaaaagacctcatggggggtggaaattgggaatcagcatgataaagatgaggaggcatctgcataggagggtggggtacccattttttgggggagaagggggaagtgaaaaag

SEQ ID NO: 520206 - DNA, 490 bp, Homo sapiens
  misc_feature (398)..(398): n is a, c, g, or t
cccacgcgtccgaaaacactctacagcatatccctctgttgtccatcattgaaaacactgggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatganagacgcaatgcattgtgtagctagttttctggaaaagtcaatcttttaggaattgtttttcagatcttcaataaattttttctttaaatttc

SEQ ID NO: 520207 - DNA, 136 bp, Homo sapiens
gaggatctccaacggaacttatggaaaactatattggatggctcagaaaaatgtagaccctggaaagaaaatacagcagataatgagaaagaatgtattatgggtggggaaaagaaaccaacagatgaagagaagg

SEQ ID NO: 520208 - DNA, 926 bp, Homo sapiens
  misc_feature (4)..(4): n is a, c, g, or t
  misc_feature (29)..(29): n is a, c, g, or t
  misc_feature (38)..(38): n is a, c, g, or t
  misc_feature (42)..(42): n is a, c, g, or t
  misc_feature (46)..(46): n is a, c, g, or t
  misc_feature (49)..(49): n is a, c, g, or t
  misc_feature (62)..(63): n is a, c, g, or t
  misc_feature (66)..(66): n is a, c, g, or t
  misc_feature (76)..(76): n is a, c, g, or t
  misc_feature (433)..(433): n is a, c, g, or t
aaanaaaagggggaaatagcccccccccnccccccccncccngccnttncccatgtcaaaanngcngccagtgttntcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatganagacgcaatgcattgtgtagctagttttctggaaaagtcaatcttttaggaattgtttttcagatcttcaataaattttttctttaaatttcaaaaaaaaaaaatagatcaggtatacaaaaagataaattcaagagagctataaaatacctgaagaaaaggtttagaaagatgaagtaaaaaaagctgcatgttagttcttgaagggtaaaacagaggtggggagaggagcaagtctagcctatgtggacctgggttcttctggtaattggaacactttaatgcatccaatgcttaatagggatttataattgaaaagagggggtcagagagggagttttagaaggttgtgtggtgaagatctttaattgatggatggtgaaaagacctcatggggggtggaaattgggaatcagcatgataaagatgaggaggcatctgcataggagggtggggtacccattttttgggggagaagggggaagtgaaaaag

SEQ ID NO: 520209 - DNA, 525 bp, Homo sapiens
  misc_feature (4)..(4): n is a, c, g, or t
  misc_feature (29)..(29): n is a, c, g, or t
  misc_feature (38)..(38): n is a, c, g, or t
  misc_feature (42)..(42): n is a, c, g, or t
  misc_feature (46)..(46): n is a, c, g, or t
  misc_feature (49)..(49): n is a, c, g, or t
  misc_feature (62)..(63): n is a, c, g, or t
  misc_feature (66)..(66): n is a, c, g, or t
  misc_feature (76)..(76): n is a, c, g, or t
  misc_feature (433)..(433): n is a, c, g, or t
aaanaaaagggggaaatagcccccccccnccccccccncccngccnttncccatgtcaaaanngcngccagtgttntcaatgatggacaacagagggatatgctgtagagtgttttattgcctagttgacaaagctgcttttgaatgctggtggttctattcctttgacactacgcacttttataatacatgttaatgctatatgacaaaatgctctgattcctagtgccaaaggttcaattcagtgtatataactgaacacactcatccatttgtgcttttgtttttttttatggtgcttaaagtaaagagcccatcctttgcaagtcatccatgttgttacttaggcattttatcttggctcaaattgttgaagaatggtggcttgtttcatggtttttgtatttgtgtctaatgcacgttttaacatganagacgcaatgcattgtgtagctagttttctggaaaagtcaatcttttaggaattgtttttcagatcttcaataaattttttctttaaatttc

SEQ ID NO: 520210 - DNA, 345 bp, Homo sapiens
ttatagctaagatctaaatactgtatttaagtgcataggaaaagctcgcagggcagattctacacgtattattataggtccaaagagagctgctctaggttagattatgccccaatctgtgcaggaatttacagcaatgttattgtgccacaagtttaaacatgaaagattctgaagatgctgagagctaatgatctcttccacagttttaaggttatggtccctctcaggtctagactcatgcgaatccattcaagctgagaaatggaatagagggatagcgttccatggtcacgagctgatacagtactaacgctaattcagatatgaccatactatttcaag

SEQ ID NO: 520211 - DNA, 293 bp, Homo sapiens
gacgtcagatcagtgaactatgaactacagtatttgcttaagcctatggagtgatttattttcaaaaaaggtcgaactgcatatgcttttcttccagcacaaacaacagcaaaaactttggtaataactaacttaccttggcatgtatgaagaacggagtcatttatttccctaacttactcctctttcaagtaacagggggcagatcataaaaggaattctttatggtatctacacactccacattctttactggtgtcctactacggtatctgggctcccggcggtctcag

SEQ ID NO: 520212 - DNA, 214 bp, Homo sapiens
ttttaatggcagactgctggagcctaggagtttcactctagcgtgggcaaaatagtatgatcctatctctcaaaaaatacaaaaaaattcaccaggcatggtggcacacacctgtggtcccagctaatctggaggctgaggcaggaggatcccttgagcccaggaggtagaggctgcagtgagccatgttctgccactgccattaaaggagctg

SEQ ID NO: 520213 - DNA, 402 bp, Homo sapiens
tgcccaatagaacatcacaaggtttacttgtgaaaagtgagtatatttgctgcagtagaactaattcttacaaaagtttgtgactttccttaaaatacatccatccaacaacctgctcagcaccaggcatcgaaaggacacagcagtgaatggtccttggcctcacaatatgtgtcagggatcgcaaggtgtcaaggaatttggagaaaaataaatacacaatagaagtaacaggaatcctataacatgaagacttattttagaggcatgcatacacaaagacagacaagactagagaaaaggcatcaattagttccagctcaggaattgaaaagggggcagaaaaggaaagacttcacagaaaagacgatagaagctgtttgtaggagagatcaggactca

SEQ ID NO: 520214 - DNA, 1191 bp, Homo sapiens
cggacgcgtgggcggacgcgttggtggagacagcccccaagccgggcaaggatgtccctgcccaatgaacagacaaagcttcagcacccaagcagcaaagcaaacctgctggctgatagctggcgcaggaagatgacctgtatcctgcaccacatgccggtagcctactcgcaggggcactcctacgataactaatgcaacgacatcggcgagctaccggtcctacagcagtagccagaacaaactgctatacatactatacaagaacgtactcgcgactctactaaagcaacgcgctcgagtgtcaccgtaagcaaaccccgtagacatggcagaacccggagtcccagcgcggcttgtcggggcccaagcatccattcccaggcccccgaccccgatccctgtggccagtggtccagaagtactagtcgcattgacaaatcccgacagctaccacattctacagccaacactcgaagccgacttgcggtggctgaagctgaggacccacgaaacaacgctcatcacagcctgctcgtgcatgacctgctgcacagcttgaacaacctggacacccctggcaaccgaccgagagaaagccgcaacacacaaacccaagatacagcccaggcctgaccataggatgaaccgccagcgtacacaccttgcccatgagacaacaccaaagacaacgctcagccgtcggcaattcgtgcggggccagactctgggaaccccctaccagaccttaccacctacagatcatccgaagacctgggaacaccaaacaccccatgggcaattatgcgaatctggcacgcacacaacaagtatcaacgctaggcactagacccattgaaatatcagcgcatacagcccacatatacacacgcgtacccacacgtttgtcagaaggaaacgtccacaccggtcccgacattgcggaacggccgcgcagacgccacccgctgaccaacatcccgggcgcatacctcgatcccccatctgtccatccgccaacggctcacctatgtaactttgcacgtggcattagcgcgcccgcggaacacactcgaccgttggacatgcacaccaatccaaaatcgaacaaaacaatcaatcgtgtctcatatgaaaacgccatcccaacaatgaagaactacagaggacgagctactatagtaaaccaga

SEQ ID NO: 520215 - DNA, 352 bp, Homo sapiens
  misc_feature (223)..(223): n is a, c, g, or t
  misc_feature (324)..(324): n is a, c, g, or t
aatcgtttatatacatgaaaaaacccctggaaataatagcgctgatttcaagcattgcgaagcgcaatcattggttaaattattgtttttaaataaaatttaaaaataagaacaggtttggttgatgttgatggatggggcctgatgcgatgcctcaggctgaaagcgatccattgccacgggattcctccccataccgaccaatgcagtgttgctctgggangtcgtgatacgagggctgatggagcatcatcaacctgtctcaacagaatcgataatgcgcattgcagttcagtactgcgccgtgaaacctgtttctgcccnggggaaattgttgaaaccttggttttcc

SEQ ID NO: 520216 - DNA, 447 bp, Homo sapiens
  misc_feature (7)..(7): n is a, c, g, or t
  misc_feature (167)..(167): n is a, c, g, or t
  misc_feature (169)..(169): n is a, c, g, or t
ttaaaanaattgaaaaacagccagaacaacccaaaaacctaaataagaatccagacatccataagaatagaggttaaaagtccagggaaacttggttttgatgccctacttttgtaatttaagataatgtaatactatttaagttttgaaggtggctgggtgccagntntcacgcctgtaatcccagtactttgggaggccgagacaggtggatcacttgaggtcgggacttggagaccggcctggcccagggtggtgaagccctgtgtctgctgaagatgcaaaaatccgcccaggcgtggtggcacacgcctgtaattccggctgctcggaaggctgaggcacgagaattgctttagtccgggaggcggacgctgcagtgacccgagatggcaccactgcactctagcctggttgatggaattagattttgcctcaaaaaaaaaa

SEQ ID NO: 520217 - DNA, 141 bp, Homo sapiens
gggagatatagcccataacgggcaccaggaagtccacaccatatgcagtattggggctgtaggtctccgagcccttccactcctctctggatatatctctggacctcacctgcttgcagagttcctcctcaacctcgatct

SEQ ID NO: 520218 - DNA, 1033 bp, Homo sapiens
tcatctgattccgagctgaagacctcgtggtcctcttaaggagggagagtgcatttttagagcttttagccaaaatgtgaaaagctgatgcttggcgcctggctttggctgaacttgggctctggttctcacttactacaataactcaggtaatcgtcttaaacctgtacaaggcatggatccatttcaacaaaaacaggtaaatttaacaagtgcagaactctggctcacttggccaaaagcaacgattcagtgaaacaactttacgggttccaactatatttctgggaaaaatacgatataaagttatcagcttatggggcccttattataacccagtggttatcccatttcccattctcctatgtgttccccggcattccctataactgggataccatttctaaaccccctgtgggccaaaatccaatttcctatgtaggcaacagaccccacacgaaggcgacacacgaaacccgcaaaccaagactacttcagacaaaacaggaccaatttaagacaattttaaccacttaacttgtggcattacccacaggttgtttccaacccgttcgttaacagacactggacgcaaattttcgggaaagggcaaaacgtagtggccgacaaccgattttaacacttaactttcccaacagacaacagtgggttccactcctgggaactttatccccttattgggctaccagccactttgtctcgttcaaaacaaccttctacgtgggtacaaattccaagggaactgtgaacacttttttcaactggcttaagctgagatactgatccactccaggcggcggactgacacgccgcgtcgaccacctaccttgagggcgagttacatctctttttttgtaaaacacattgtggcaacaagggaaatactattccaggaggttatcgtaccctttcgtgtgcaccaagaatttcccacctgtgtaatgatccattcttacatacacagggggagagtttcacacgccggatgatgtcctcaaacaggattttcccg

SEQ ID NO: 520219 - DNA, 242 bp, Homo sapiens
caaatctggtatggcccatttgggtggggaaaattaaaaattttgctggctaggcagtagctttttccatttttcccccccataccccccccttcaggaaaacaaaaaaaacccctatttttatcttgtttttgtaggtttgtttcctctgggactattttttcctgttgtactattgggtgagggtggtgggaattatgcatctttaataaagttttttaggtgagaccaaaaaaaaaaaa

SEQ ID NO: 520220 - DNA, 175 bp, Homo sapiens
cttgcttcttaagcgctcctttcacacacgcgcgcgctcgctgggccgtccccttctcttccgcccttcttcttcttctggttcttgctaacggtgccgtcggggaggattgatgtcccttcagcatcatgcagccgcccggcgaggggaggtgtaaagtgtacacaagagactg

SEQ ID NO: 520221 - DNA, 525 bp, Homo sapiens
  misc_feature (102)..(102): n is a, c, g, or t
  misc_feature (250)..(250): n is a, c, g, or t
ctacggggatgattttacgaactgaaactctctctttctgattggattagtgggagaaaaccagacaaattctgacgtagcactgtacgtgtacgcaacaanatgtcatggcgccctattggattgtgtcctgaggtggtatcagtgaacggggtggtaactttgtttccaggattgttccagccccaacaaaggagcctttaacctgtgggttgaaacaggacactcgcgcgaccaatgaacccaatcnttagctttattgcagaatgtccaaggcggtttaccacgctaacactggggtttttcccccaggccaatttcccttcccaatttaacaattcctttaaatttccccctgtgggggggagggaggggcaacacacactcttctctcccccaaaaaggtgggcctcttttttggggggcaccctctcttttttcacctccttctctccctcaaaaagaggggaggagagggaggaaaatttttgttgggggccaaaaaaacaaatatgtgcttttaac

SEQ ID NO: 520222 - DNA, 398 bp, Homo sapiens
  misc_feature (71)..(71): n is a, c, g, or t
  misc_feature (187)..(187): n is a, c, g, or t
  misc_feature (215)..(215): n is a, c, g, or t
  misc_feature (234)..(234): n is a, c, g, or t
  misc_feature (250)..(250): n is a, c, g, or t
  misc_feature (258)..(258): n is a, c, g, or t
  misc_feature (374)..(374): n is a, c, g, or t
  misc_feature (388)..(388): n is a, c, g, or t
gggacctggggctggttgtcctggtggatgcacgcaggagtccagctgccctgccgctcccaggccctctnaggattgcaggtacggcaaggttgcatatcccttgggtgtgcagagcatcgtagggcccgtgtgttgctggggcttgccacatcgtgggtcttgagtagccagtccacaagcttantgtgaagattcagatggggccctgtcanagccaccttcttcttgggncttccatgagtcactnttgctctntgggcaggcacagacacttgggaaagggggcttggccatccttgggactttgggaactttatcttaaggtacttgaaaccttaaatgtgcaggcaggcccggtggtggcacctgtncaagaagggaagtnccctccttgc

SEQ ID NO: 520223 - DNA, 488 bp, Homo sapiens
tgtttccacacacacacacacacacacccagtcactgcaaagaacatttgcccaaaggagaagtcagacaaacattctccaaaaataattaagaggtaatatcaaaagtacaacagttaaagaagggagtactaatttcctcctgtttcatataaaagtaaagtaatacagtctgatattgatggaatcaaagctagagaacacattgcttatgttatacgaggaacctacagcagaacaaaaaataatacaacaacaaaaacagagaggaagagaaggaaattatgtgggagattatataaataagccaaattccttaccatggaaaaatgatatacagtcaacaatttcagttatttaaatttatggggggtaactagcaagaaaacaaaaaagagaaagatgaaatgtggtcttctctgatgagggggactataggaaggagaagaacagcgagaggctaccacatttttttcaactgtgcatgg

SEQ ID NO: 520224 - DNA, 632 bp, Homo sapiens
tgtggtagctcatgcctgtaatcccaacatttgggaggctgaggcaggcagatcacttgaggtcaggagttcgagaccagcctggccaacatgacaaaaccccatctctactaaaaatacaaaaattagctgggtgtagtggcgggcgcctgtagtcccagctactcgggaggctgaggcaggagaatagcttggacccgggaggtggaggttgcagggaggtggaggttgcagggaggtggaggttgcagtgagctgagatcacgccactgtgctacagcctgggcgacacagtgagactccgtctcaaaaaaagaaaaaaaaaaaaattttcttttggtttgggccacccctgttgttccatatccgtaaataaacttggctacttggcttccaaatttccggtgaagaacacgccaagattacgggcagtagactattgtgaacctgcggttatacattcgcaaagggctgtcggctggtggtactctggtaaccaattccaacgcaatggccacgtgacacattgacgttcgtagtccctctatctagaaatcctctcccaaatagtggcatatctttccctctgctccattaaagtctgtgctgaaatgtatctactcagagaagat

SEQ ID NO: 520225 - DNA, 757 bp, Homo sapiens
  misc_feature (64)..(64): n is a, c, g, or t
gccgtctgagagcgaccgccgcgttgtgtgtttgcactcgagccccgctttttggcccccctancattgctggtcgggtcctctttctcttgttgccccccaataggccgccgcgtggaatgcctccctcgttttctgtgtgtcgccccccaactctgcgtgctcgtcgctgcaacacctctctggtgcaagtggcgccccctctatggacattgcgtggtacctcccctggggggggggtgcgcctctcctgccgggcggctctcgcgcttgcctagatgtgtggtctcgtcagatgaagtgcgtctcgccactcgattggttcgttcgcgctctcctccgcctctccactcatgcatggcttcgctatgtttatgggtgggccgcacttgttgtaataggcaatgtgcgctcctattatcgggtgtacgaaccatgtgtaggatacatatacagaaatgtggccgcctaatatagttagtgagaggtcgatcactctactctcggtcagcgtccgtgtttgtttgaagcccgctcccccgcgttgaacctacatgcattgcttgcctctctggccgtggcgggcatatgcctcctctctgtcccctctcgcctttcaggggagtctactcctctgtgagcggactcatggtgtagctcctctctcacgagagaagtgacatgtggtccacgctctgtgtgacacacaataagggtggaaactctctctccctctgtcccatcaataaacagaaaa

SEQ ID NO: 520226 - DNA, 391 bp, Homo sapiens
tgtgtttatacgtgttgtgtgtatgtgatgtttcactaccaaaatatgtaaaagggctctaattaattggcttaaagaaaaaaggaagtgcttaaatcaaatgtgttatcacaaaaatagaaactttaattcaaatgccttgtagttcacatgactttattaatctttagtaaattaagacaatttaaaaattattggtaaaataaaaaaagtcttcagaatttaatttagacattttgtctgagtctattgattagatactatctctaccagatgttttaaggcataaaacttgcttctatgatttgttttgatacctaacttgtctataaaacttatgtctttaggatttatttatttatttaaattttttgggaggatgggagtcttg

SEQ ID NO: 520227 - DNA, 121 bp, Homo sapiens
tgagctacgagtgcgacacgtggtggaacaagtggagcagatccagaaagagcagaactaccagcggtggcgagaggagcgcttccggcagaccagtgagagcaacaaccaaccggttctg

SEQ ID NO: 520228 - DNA, 653 bp, Homo sapiens
acccgtcaacaaaccgcggagcggagggcgctccatttgtcctgaatctctaaattacgaccattgtggagatcacgactcctctgcctgggtttaggccaggacccaaccaatcccttggagcttgcacagaccataccagatgtttttggatcctaatagatcctgctcgtaaagggaggcggctctctatgattcgcagccacatcaaaggccgttaacccattgtgtgtcctagccctctgccatagtctgcgatgggagccacattaccagcataccatcccaaacttgagcatagtggagtggactgaatgccttagatattgggccgagcgcctccaaagtcgatcctgtgcatcgtaggcagttatgccttaagattgctctcactgaattctctgaggcggcacacagacacagtgcccattcatgtaatgtacctatctctgattgaagagtactatcagggctacttatccaggacagatgaaagagagtgcttcaagcgaccagcttgtccttataagagactgggagaggtgtttctgcaatgcctcttggggggcactggtacccttgaggatattgatagcagatgctcaaggctgctcatgctgggctgggcgtgaacactgaaccctgttagactg

SEQ ID NO: 520229 - DNA, 462 bp, Homo sapiens
  misc_feature (29)..(29): n is a, c, g, or t
agggcgattagacatgacagcttgcgaantaaatcaggctggtacgtcgatcggatgtcgaccgctcgaggctcggcctcgccctgcaggtgccggcaggcgccatcgcgcccgaggtggagaggggacctctgcggctgacgtggagttgcagatagtagatgacgtcgtagtggctgcattggcctgtgagcatgattcactgccgttcctcacgatgctatgacgtcacaagggaagtgaagtcgctctgcggcagattgtagatgacaggagatgctcttcgagacatgagatgactcggtttcgacgatactgcatgctccgggagctgtcgttgcaggatctccaacaacctgggaggaccgaggcgtgtgacaggtacgcgcgtcttggagcaattctagtgttgactagtgtagtccagagttttgaccgtcgtcgtacagttgtccgactgac

SEQ ID NO: 520230 - DNA, 302 bp, Homo sapiens
ccccggggaaaatccccccccccccccccccggggggggggtttcccccccagggggggggggcccaaaaaggggcccccccccccccagggttgtggggtggggccccgttcccccttaaaaaatttttggcccccccgggggggggggggcccccccccgggggggccccttttgggggcgggggggggggccccctggggggggggggccccccccccccttttttttttttttggggcttttttttttggtttttttttttttaaaaaaaggtttttttttttttttccccgccccca

SEQ ID NO: 520231 - DNA, 131 bp, Homo sapiens
ccacgagtctatgactccggaacgtggctgggtactgggctgaggagatccccaggcgatttcgaacctccgcctcaaatccagtgccaccagagtaaccaccctactgccccgatcccagccctgaccct

SEQ ID NO: 520232 - DNA, 214 bp, Homo sapiens
aggggtgggtgtggcgtgtacactagatttgacatagggtggggacgctgtacagggggatggggttggtgggctggcatctccttcttgcttgaatgtccatggcctccctggtaggcttgacctgtgcttgagtcaaatgatagcgcttatatggtcgtacaaccggatggccaccctcgggcccaggtacaggcggtcagtcagtccaccc

SEQ ID NO: 520233 - DNA, 741 bp, Homo sapiens
tggcaccacgctcacgccccgcagcacgacgtacctgagcaccgacgcaatgccccatccgtcgtgcacggtccatccaaaccacacaggaccccggacattcccgttctcctggcgcagcacaccaggcctgggtacgcgggccctcaaggttgataggaggtgccggctctttcctcgcactgccgcaggagcgtccacgccgcgcacagagtgaacgaggggcacccatggcccgtgagcacgtctagacacaagctaccaaggttccagtggcttattcgggcgcgcgcctatcggccacgatacacgtccctttggctatgagcaggctttctgcgaggccccctacccgcgaccaaccccgggggagccgaagctaggggatccaggggaggcttacgagagctgcgcgatggcataccgtggcccacacgcgaccacgcagggcagcagacgaggtccgatgcctagggaggcgagcggcggcgcgctcgcgacgtggtggggtcaggtggacgctgccctccggggctggtcgcgcatccctcagtccctcggccacccgggggtcgctccctcgtgcccaccgcacctgccgagcctctttggacccagatcagttcatgcatgttggtacttcgtcacctgcggcggggccctttgagtgtcttagtctgtattggggtggaaaaatcaccgggaatccccatacagcttcgggaaaaagttccactttaa

SEQ ID NO: 520234 - DNA, 163 bp, Homo sapiens
gtcttgtaaacaggcctcaccactcacctagggtgtcttgaaaggaggatagagccacttacagttttatttgcttcagtgtttaatgtagatattatgtgtcctgctgtttctgtgggttgtatgtctgggatgcatgagatttggcccttttttgaaagca

SEQ ID NO: 520235 - DNA, 680 bp, Homo sapiens
  misc_feature (608)..(608): n is a, c, g, or t
gccagagtgaagatccccacctgacccatcccctctccagctcccctctccatggagagccatttccattgcttaataaaattctccaccttcaccatccttcaagtgtccgggtgacctcattcttcttggatgctggacaagagcttgggacccaccgagtgtgggtacctaaaagaggctgtcacattggccctggcagagggcagccaccctaggcaacaaggcaagggacccactgagctgataacacactactgtccatagacggcggagctaagagagcactgtaacatgccctctggagcttcgggggttgcaggcacctcaatctgggcactgctgcagggcctgcacggagcttgctcctgccagctcccaaagcagctggccagatgccacactcactcacgtgctccctcccacaaggggttgagcacggcgggccaagtaaacacagcatccctgtcgcaagtccaacgaaggggtcaggaaaaatcccgcacccccatgatggtgagatcctgggcccttgttcttctctgtcctctcagtaagactccgaagcgctcttctagggacagactataagggctggatcagaaacngaaacacggagctgtgattcaccccatccctgcccacagagaggcactgctgagatctcttggctgtcgcta

SEQ ID NO: 520236 - DNA, 212 bp, Homo sapiens
accacaattactcgaacccgtaaatactgctacctgctgtaggcaacccgtgagcagcgtcaggcatcgccacttccagccgcgcaagaccgcaacaccggcgagttggtcgacgacacccagtggcaccgggtgacgtttatatgaccgcctggccgagatcgccggcgagtacctgaagaaaggccgacccgtgtatgtcgaggccaatg

SEQ ID NO: 520237 - DNA, 333 bp, Homo sapiens
  misc_feature (124)..(124): n is a, c, g, or t
  misc_feature (171)..(171): n is a, c, g, or t
tacaagttgctttggtcctattgtttcctcacagcaatagaaaacaaactaagtcaagagggggtgatagtgtatagtgttctagtccttggagcagatcagaatgtcatgtgccaccacgccntggcgggaagtttttgaacttgggtcctcatacatgcacagtaagtnctctaaccccattgggccatctccccagccatctacttccttttaataaggaatcccataagtcataaggtctattgcaagtaggacattgaaaatagacagacccccgtagagacgaaggaaaggtcatcttgcagagggccaccaggaactagggattac

SEQ ID NO: 520238 - DNA, 293 bp, Homo sapiens
  misc_feature (39)..(39): n is a, c, g, or t
  misc_feature (63)..(63): n is a, c, g, or t
  misc_feature (73)..(73): n is a, c, g, or t
  misc_feature (78)..(78): n is a, c, g, or t
  misc_feature (82)..(82): n is a, c, g, or t
  misc_feature (87)..(87): n is a, c, g, or t
  misc_feature (96)..(96): n is a, c, g, or t
  misc_feature (105)..(107): n is a, c, g, or t
  misc_feature (119)..(119): n is a, c, g, or t
  misc_feature (126)..(126): n is a, c, g, or t
  misc_feature (130)..(130): n is a, c, g, or t
  misc_feature (140)..(141): n is a, c, g, or t
  misc_feature (152)..(152): n is a, c, g, or t
  misc_feature (160)..(160): n is a, c, g, or t
  misc_feature (165)..(165): n is a, c, g, or t
  misc_feature (174)..(174): n is a, c, g, or t
  misc_feature (178)..(178): n is a, c, g, or t
  misc_feature (186)..(186): n is a, c, g, or t
  misc_feature (221)..(221): n is a, c, g, or t
  misc_feature (230)..(230): n is a, c, g, or t
  misc_feature (267)..(267): n is a, c, g, or t
  misc_feature (269)..(269): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (285)..(286): n is a, c, g, or t
aaaaaaaaaaaaaaaaaaaaaaaaagaagaaaaaaaaanaaaccaaaggtgaaaatgtttaanaagtgaaagnaattnaganatctnatctaagtnattattttnnncagactaagcantaactanacanaaaaaaaagnnaaaaaaaaaancagaacanaatanaaaaaagcnatgnggtttatnaaattagatctgctaatattgaatacagtagattnggggattgnagttctcatataagtatcttattgggataacattttnanagtttnantgantttnnaaataag

SEQ ID NO: 520239 - DNA, 246 bp, Homo sapiens
  misc_feature (179)..(179): n is a, c, g, or t
atctgcctgcatctagtcaaagcaacaatatgtatccattacttcggagggagtgagttcttgtgctgctgaggcaaacgagattgaactgtcacagggatggcaggaggggtggagtgtaggaggaggatcagcccccagtagtgagaaattaaaaactccttttgagtattttggcncctccactaagcagtacaattaaaccttcaaaccgtgaccaaggacactaccgtgagacccgtccag

SEQ ID NO: 520240 - DNA, 199 bp, Homo sapiens
ggaagtatatccagaacagaatgaacaacgaacaggctgtatgcaacaatatttagtccctttacacatatatgtacgactttcattaatgctaaaaaatagtagtggttattaacatgtctgaaaaaatcagtatgtataattaagattgttaatctctgagtataacacatattgttcatctcagagttgtttggtt

SEQ ID NO: 520241 - DNA, 485 bp, Homo sapiens
  misc_feature (70)..(70): n is a, c, g, or t
caaactacagaagaaacaggataaactaggcccctgcttgcgtagtcaatgccggcttcttgtcccctcnccgccaccccgccgcttaatggccctcacccgatccaaagaagtttagtctgagatgaaagtttactagcctgcagaatagcttgctttgtctgttcttatcagccttcccagctacttaggtcataaatcaaattcttaaagagcccccgagctgactaggattgcaatgcattgtgggctgcaacaaaatgtagcaagacaaccctaaaaaaaacacctacagcctctgcataacaatcaataggtgacatctgggaagactgtgaccccctagtactcagcctatgaggaactgggggagggacctgcacactaggggataaattgcttgttgtgactgtgctgggtgtgcctgcctactagacacccgaccttgcaaggccatcattaaaagtctcactttcgcaatacaa

SEQ ID NO: 520242 - DNA, 160 bp, Homo sapiens
gcgtctgtaatctacacctacagctcacgtgcacactgtcgaatccttaacccatgcagcaatggtcagggatactatgcccgcataacctcatggttcctagttgaattcgttaaccactgcaccatgaggaggacttcagtacccctgttgcgtatgc

SEQ ID NO: 520243 - DNA, 459 bp, Homo sapiens
gaaaagaaggaacaatggtacgtgccaaaaagggccgcgcgcacgtgcagtcctattcgctgcactaagctgtgcccgatgcgtgcccaaggacaaggccagttaagaaagttcgtcattcgaaacatagtggaggccgcagtcagtcaggggacatttctgaagcgagcgtcgttcgatgcctatgatgcttcccgaagctgtatgtgaagctacagttactgtgtgagttgtgcaatttcacgagctaaagtagtctaggaatcgatctcgtgaagcccagcaaggaccggaacgacccccaccccgagtttatgacactgcgggtgtctgccccgacgtgctcccaccaaagcccatgtcacaggcagctgaggtgcttcaaagcactgaagaagaggctattctctggagacacaaagtcacaatggaaattgtacttaagaaaaaaacaaataa

SEQ ID NO: 520244 - DNA, 243 bp, Homo sapiens
  misc_feature (5)..(5): n is a, c, g, or t
  misc_feature (7)..(7): n is a, c, g, or t
  misc_feature (10)..(10): n is a, c, g, or t
  misc_feature (27)..(27): n is a, c, g, or t
  misc_feature (29)..(29): n is a, c, g, or t
  misc_feature (67)..(67): n is a, c, g, or t
  misc_feature (104)..(104): n is a, c, g, or t
  misc_feature (114)..(114): n is a, c, g, or t
  misc_feature (121)..(121): n is a, c, g, or t
  misc_feature (126)..(126): n is a, c, g, or t
  misc_feature (208)..(208): n is a, c, g, or t
  misc_feature (224)..(224): n is a, c, g, or t
  misc_feature (234)..(234): n is a, c, g, or t
gccancnccnagtgacgccaaagcccntngttgactctaacagccccgtgggcgcgcgggaggccgngcgctctagggtctacctatcagcgcaatcgtttagngctttttcantggggcngggcnggaagcaggcgggaccaggcagccagttctcaaaggctgcggggccgactagaggccacagcccctcacccctagacgtcgncaaccagaactgacgngcgacctccngggcgctga

SEQ ID NO: 520245 - DNA, 105 bp, Homo sapiens
cagaatggcagggtgttattatcccacattactgtttacggtgtgaaaaaaagaggcacaggtaggttaagcaatcttggctatgtgtcacacagtagagtaatt

SEQ ID NO: 520246 - DNA, 167 bp, Homo sapiens
gttcatagcaaatcatagtgctctgcgatgttcacgactaacaaggatgcagagtgttgtgtgacgaggagcaagtgaggagttaggagatgaagtcagatgttggtgatgtgatcggggaagtgagaacatcagcagacagtgctattgaaacttctaaaactagg

SEQ ID NO: 520247 - DNA, 211 bp, Homo sapiens
gctcgataccccgtgaagcacaccctcggtggggcttgtgtgatcttcgctgataggcgggcgctttgcgcttttcttaactatctcccatcatctctatcaataggactaagctcagctttttttcgtgacggtcgcgattgcttgcaacttttcgagattgtttgcataatggcgtgtcagttcaggctcggtcagggtgtgcttcaca

SEQ ID NO: 520248 - DNA, 110 bp, Homo sapiens
tgtactcgggaggctatactttctgcttcctccatcagcagcatgcaaactcctgatgctgaaatttagtaggatcccggctgctcacagggaggggtgggtggagagcg

SEQ ID NO: 520249 - DNA, 286 bp, Homo sapiens
cttcgtgaacagcgttccgaacatgtacatccaggatcaggggcccggcggctcaaccgaaatctacattcgcggcctcgtggcgcaaggcggcgccgggttcccggtagccacctacttcggcgaagctgtgaccagcgtgctgaccaaccacggcggcatgacgaacctccagttggtggacatcgatcgcgtcgaggtgatacgcggcccacggggaaccctgttcggcgccaactcattagccggtgtgttgcgcgtagtgcccaacgctcccaacctgaac

SEQ ID NO: 520250 - DNA, 261 bp, Homo sapiens
gcagtacatgtgggccatatggggccctgtgtagcaatcacatgtgtgttcttaaacattcagttcttgggcttcaccccagtgtgccacaaagttcagcatgttcaagcagtgttgtcagtcaccaggtcacatgtttgaggtgtttcctcagacagcatgaatcttggccacttagccatcagtatttcaatcatttcatccagtcatttcagtagttgccctcaaaaactttcctaataagcctagtggttaagcacg

SEQ ID NO: 520251 - DNA, 633 bp, Homo sapiens
gggcacatctccgaaaggacaagcccacctatagcaagcttcatttaggagtatagtagtgtgtgggcacaaagggcatcttggttgactacagctatgtgttgctcccgccgcacctataccagcagcattgtcctggacgccggtcctcgaagggcaaataacccatcgccacattcttcttcagagaggggaagggacacccacatagtcacagtaccattctgggtcccctccatgtccagaatggctctgtgtgcccgcatgggggccccctcacacataaaccccacacgcttccggtgcaccgtgcctttaaggtgggaaacaatgccctgggctccaggaaagtcaataacagctggggggcgtttccccagtgtccatctgaggctgccctccacaggtgtagtgtgttcatcaatgtcattcccatacagacagaggcctgcctctcagaatagctgttgccaggtgaactgcccccgctaccggcaccgagttctccacaccatcctctcgtgtgtagccacagcgggtcacgcgacagccagacacgccaaacacctccatcacagcactggtcataaagcgcagtttcctcaggtcatctgccacgccggcctgtagtac

SEQ ID NO: 520252 - DNA, 653 bp, Homo sapiens
ctagtgtgaccctcggctgctgcaggtatctgcagcgactgcagccatgtgtgtggtgcccacctggtccggcgctacctggtgctgatgcctcgtgtggagccctgaccccctgcagatgccaaccttcccgccagactactggtgcttcccctgaactgcaaggatgctgctgagattggttggacacacatgcagtgagatgatggactgctgcgagctgagtgctccagcgtgctgggactacattgacgcccaccatctcatcctgtggtgctcaatggtgcaaggcgtgacatgcttccaccaagccttcctggcctgcaaggcagtgatgctggcacggagcttgggactacttgcctgagcacctggggactattgttgattgctgcattgaagggagattttgagacgtggagcggatgtgcttgatccagctgggaaggagagcggagggcatgacacgagagtgctgtgacaaggaggtatgtggccgaaattggagccagggaacaccagtagtgagcaaatttgagaacgcccagaagagttgagacacattgataggtggggttgaaaagacgtagagaaccataagtgggagcatagaaagagataagaaagacagtatcaagtggacaggtaataag

SEQ ID NO: 520253 - DNA, 1350 bp, Homo sapiens
  misc_feature (493)..(493): n is a, c, g, or t
attaatcccctggcccaagcaacgtcatctactctaccatctttgcaggcacaccgtcatcacacgggcctaagcatcgcacttggatttttctgtatcctcgaggtagggcctagagatactagaaccagtgactacgcttttagtctccaaaggttctagagcctataaaaaagtataacccgcgtcgatgaccaccacgataggcatgccgagtcgaaggtgtactttccgtacaccggcatatgcgaaatcgcactctcaatcaatccgttcataagtagcatatccttcgttcaaacgagatggacgtcgtccggcgacagatgaaacacgagtagaccaaatacataacgcaaattcccaaatacgtcgatcgaggttaaatgaatcgaatatagtgggcatataagcacatttaagaaacatatggaaattaggccgcacacatattctactttcgtaaggtgtcccgagggtaggtatatacacncgatagggaaaccgccgtctctgaacaatgtcacggaggtcttgcatatcgtgtcatccacaattggaacatatgaaagctaggcccctctcagtccgtcaaaatgtcttattagtaaccgaaataaatcttcttccacctcaagacttagggaaccgataaaagggccgttttcgtcgcagttctgacgtacgtgctttcaacacatctgtgtcattcgacatgtccaaataaaggccatgcggccacagtatttggacagagttgtgacatttaaggaagtgcagagaacgcccaggagataacggaccagaacacaagtcctttaggacattaaacttcgcctccataatttatatccccaagccaataagtggaacttgacacagttacacacttagggccaggatatactaaaccgggataacaaaagcccccttaatgagcaatttaaagccccgaatttccctctacaggttgtgttaaacgcttagcatggacattaacttgtattacctctaagtaagttaatcttaaccctgaggatattatgacccttaaacgttaaagattcaacaaacgttattaaagaagcctttccgcgaagggaagtccaacagggaaggaccgatatagattaaacacttagatgcctatcgtgaaaagccctgtagaaaacgcagaaggggctatataacagtgtggaaactttataaaacaaccaccgtgatgaaagagtgtcgtcatggtgcccaagacccagtactcgatgtgatgacacattcaaaggaaaagaggcgtgtgacgccaccccggacgtataaagaccgaggggagttgattttgtggacacccaa

SEQ ID NO: 520254 - DNA, 1222 bp, Homo sapiens
  misc_feature (22)..(22): n is a, c, g, or t
  misc_feature (62)..(62): n is a, c, g, or t
  misc_feature (85)..(85): n is a, c, g, or t
  misc_feature (90)..(90): n is a, c, g, or t
  misc_feature (111)..(111): n is a, c, g, or t
  misc_feature (191)..(191): n is a, c, g, or t
  misc_feature (196)..(196): n is a, c, g, or t
  misc_feature (198)..(198): n is a, c, g, or t
  misc_feature (201)..(201): n is a, c, g, or t
  misc_feature (250)..(250): n is a, c, g, or t
  misc_feature (325)..(325): n is a, c, g, or t
  misc_feature (432)..(432): n is a, c, g, or t
  misc_feature (595)..(595): n is a, c, g, or t
  misc_feature (609)..(609): n is a, c, g, or t
  misc_feature (612)..(612): n is a, c, g, or t
  misc_feature (614)..(614): n is a, c, g, or t
  misc_feature (616)..(616): n is a, c, g, or t
  misc_feature (620)..(620): n is a, c, g, or t
  misc_feature (622)..(622): n is a, c, g, or t
  misc_feature (633)..(634): n is a, c, g, or t
  misc_feature (636)..(636): n is a, c, g, or t
  misc_feature (639)..(642): n is a, c, g, or t
  misc_feature (742)..(742): n is a, c, g, or t
  misc_feature (811)..(811): n is a, c, g, or t
  misc_feature (920)..(920): n is a, c, g, or t
  misc_feature (928)..(928): n is a, c, g, or t
  misc_feature (940)..(940): n is a, c, g, or t
  misc_feature (944)..(944): n is a, c, g, or t
  misc_feature (947)..(947): n is a, c, g, or t
  misc_feature (954)..(954): n is a, c, g, or t
  misc_feature (963)..(963): n is a, c, g, or t
  misc_feature (968)..(968): n is a, c, g, or t
  misc_feature (972)..(972): n is a, c, g, or t
  misc_feature (975)..(975): n is a, c, g, or t
  misc_feature (978)..(978): n is a, c, g, or t
  misc_feature (985)..(985): n is a, c, g, or t
  misc_feature (987)..(987): n is a, c, g, or t
  misc_feature (989)..(989): n is a, c, g, or t
  misc_feature (992)..(992): n is a, c, g, or t
  misc_feature (996)..(996): n is a, c, g, or t
  misc_feature (1000)..(1000): n is a, c, g, or t
  misc_feature (1003)..(1003): n is a, c, g, or t
  misc_feature (1006)..(1006): n is a, c, g, or t
  misc_feature (1020)..(1020): n is a, c, g, or t
tccatccgattcaggccatcgntggagtgaagaagcagtccccaaggagatatctactccgntggggtggagcggctcccgatcntcccnggggcgccgaggcggccgggngcgcggcggtggtcgagaccagaacggcctttccaagggcggcggcggcggttacaacagctacggtggttacggcggcncggancngcngctacaatgctacggaggcggcggcggcggttcgtctacggtgggagcnactacggtaacggcttcggcggcttcggcagctacagccagcatcagtcctcctatgggcccatgaagagcggcngcggcggcggcggtggaggcagtagctggggcggtcgcagtaatagtggaccttacagaggcggctatggcggtgggggtggctatggaggcagctccttctaaaanaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttncctgccacctctcntcncncncccncngaagatgcacnngnccnnnnatacacatttttgtgtaacagtcattgatggactctatttttttattattacttggaccttggtcgtttttatactagcaaaatgtcttgttttaatttntattttttggggggagggagggagtgaacttgctgattctgtagcaaaacctgggtgggggttggggtngggggtagtttactttgttgtaaggacttgataacctggctacagcgttttctatgaaatctacttggatcccatgcctgaaatttggaagcatatgtacaaaaatcanttttacgntttatttttaanaaantantgtgttngaccgacangtctnacanttnttntcttggntncnttncggnccgnttnttnagggatatttgttnaggacttacgtgtaaatcctttattcttgatgttgtacttatagaaacttaagagctcctgaggttttttacctctctactgttgtcccgatagaagcttgttgtattatattcctaacaggcatcacttttgatgtcgttaatgatgctttttctaaccttaatcctatgtgctttcatttttagtcttaagcctatcgct

SEQ ID NO: 520255 - DNA, 446 bp, Homo sapiens
  misc_feature (11)..(11): n is a, c, g, or t
  misc_feature (55)..(55): n is a, c, g, or t
  misc_feature (62)..(62): n is a, c, g, or t
  misc_feature (438)..(438): n is a, c, g, or t
cccttttttgnaatggaaagttatatgagtttccctcaaaaagttgaaaacacgnaaccccnaagtccttccatactcccagattccagtgttcctttccccatcatgcctgccctgacacttagaaaaacaaaacctaaagaatttttaaaatctggcctggacgtggtggttccatgccttgtaatccccagcactttgggaggcccagagcagatggattgcttgagcctcaggagtttgagacccagccctgggcaacatggcaaaatcccttcactacaaaaagtgcaaaaattggccaggcatggtagtgcacgcctgtagtctcagctactcaggaggctgaaggcaggaggatcacctgagcccagggaggttgaggctgcagtgagccctgatgggccactgcactccagcctgagtgacagagtgaantctgtctc

SEQ ID NO: 520256 - DNA, 1040 bp, Homo sapiens
ggcgggctcggacccacgcggcgccgggggccagactgggctgcagcgctcacacccccggcggacggacacgatgccctttgacttcaggaggttggacatcgtacaggaaggtgcccaaggtacctatacgcagccaagcgtacagccggggccatttatctccatctgtctgctgcctcttcatcgctcttcctcttcctctcggagctcaccggagtttataacgaccagaagttgtgaacgagctcctatgtcgattgaccccagatcaaggaccagcggtggcaagatcgacgtcagatctgaacatctgtttacccaatctgcactgcgagtgggttgggcttgacattcaggatgacgcatgggcaggcacctgaagctgggccgaccatcgacaactccgatgaagattccccgtgaccaatggggcaggctgccgcttcgaggggcagcatcgagcatcaccaaggtccccggtaacgttcccacgtgtccacaccacagtgccaccagcccagccacagaacccagacatgacgcatgttccaatccacaagctctgcctttggggaacaggcgtacaggtccagaacatccacgggagctttccaatgctgctcgggggacgccagtacagactcagcctccaagcccctgtgcttccaggactaccttctgaagattgtgccaacgggtttcatgacggaccacgagtgggcaacgcagcggtactccgtaacaaggtacaccggtggccaccacgggacatacgtcgcctacagccacacgggcgcggctcatccctgcaaactgggtcgggtaacgacctcagccccatcacggagcacgaacaccagcagcagaagcgcactgccgccttacacgcatctcctccaccggaatgggggcactattgtggggacccttccccgcgccggcgacctggacctccggcattttcacgcctgacgcctgcacacgaccaggtgtgcgaagtatgtggccacccaccttggccgcggacccggccttac

SEQ ID NO: 520257 - DNA, 1112 bp, Homo sapiens
tgagacaaggtctcgctctgtcacccaggctggagtgcaggggtgtgaccacagcttactgcagccttgaactcccgggctcaagcaatcctacccacctcagcctcctgagtaggtgggactacgggcacgcaccaacatgcctggctgtgttttatttaaatttattcttgaagagatggggtctcattatgttgcccaggactggatctggtactcctgggctctagatgatcctccgtgtctaagcctactggatgtgctgggattgcgggcatgaaccactgaacccagaccaaaggtgatataacatgaatatcaggccggagtgcaggaggatacaagccgtgaaatcccaccacataagggagagccggggaagggcaggatcacggggatcggcgagcgcatgagaccagccctggccaggcatggtgaaacaccagaatactaccagaaaataccaggatgggccacggcagaggaggagacacacatgctggcccggcaacaacgggagcgctgacagacgaagaagcacatagcaacgaacaccacggcgccgcccacacgcgcaccgcagacaaggacggcagacgcacacacaacgccaccgcaacgcacgggcatgccaccgaaagagcaccactcccaccagcaacaccaacaagaagcacccaaaagcaaaagaaagacagcagaagagggagccaaatgaggacagaagccgacgacagacagaacagcgcggagagggagcacgaaccaaggacaccacgagagagacgcagagaacgagacaaagcccgcaccggaggaccacacaaaagagacgtgagcacggaagagagacgagcagagcgagagaggaacacacgggacagcaggagcacgaggggcgagagacgcacggcggagaagacagagaagagaggagacacaggggagcgacagccacgggcggagcgggagggcacacagagcacggcgggagaggagaggcagtgcggaacgagtacagagaaagagagaagaaggcggaaggaaggacagacgacaggatggagagacacgagaagcggagggggagtcgcgcgtagcacggcaggaga

SEQ ID NO: 520258 - DNA, 1275 bp, Homo sapiens
ttatctttctgcttcagtgattttactgtaacattttcaaatattgtgttctttactgtaccatttaagtatagttgatatatgtgaggcaacaacatacatggtttcagcatggtaggtagacgggaaaataggagctatagaatagtcccacgttggactagcagcactggggccaaagaccgcctatgactccacctcagggtcgttaacgtggctactagttacacatcagggaatcctcaagaatcatgacgtggcactctagcctccatccattacttgcgcgtggcaggggcaactggtggggcttgcttcgtcacgtagatcccttactgcgataacggaccaatatttggtaatagtcgtttacttggacggtgtattggtgaatttccctgtaagatggcttcgggtgatattgcacaggaacaacgaaaagacctcgtgctccctaggagaagctaggacctaagtgatgaatcatagatctcactctttcataattggacgagcacaaagttcttagactttttcgtttgtcgcccctagccttattcgtgcaaactaagacacccaaataatttgcgcgcatcgccataggattttccttgtcattaggttggccttgaaagggggcccattgtgtgagacggcacaacatttaactgtggcaacaaaggcgctttgtcttgcccccttccaaacttgtcagggctaaattccgtggtaccttgggtggggaccccccaagtggacgaagccccccaagaacaaaaattcacaaacgtttcatttaacagcttaccacttggttttttaccttttaaaaacactagcggagtaacttaaagaaccccttcccctttgaagaagcagaacttctcacacgacgttgtcttctacaagacacacatcccaagacgagactaactttgtgagaggcgcaaaaacaacttcccttcttggttgcaacacgcgcgggggccaagggcttcccctttcccaagacggcattattgggaataaatttttaggccttgttatgggccatgggtatgactttgttttctcggcggaaccaaacggaaaaaacgcgtggcggaaccctgaaaccaccccttggtggaacggggagtaaccaactcaaggggggccattccccctatgggattggatattgcgggggattcttttttctcactatccaccattggtctcctttgggaccccccgggggacacaagaaattttcctttttcccctttcctttaa

SEQ ID NO: 520259 - DNA, 206 bp, Homo sapiens
  misc_feature (75)..(75): n is a, c, g, or t
  misc_feature (112)..(112): n is a, c, g, or t
  misc_feature (177)..(177): n is a, c, g, or t
agggggcgcccagaaggacactttcctcctttggtgttgtccccacgtcttccagcagcgctcaggcactgagtnctcaggtgtgacctcttcagacacgctggagacttanagattggcaagtctcagtagggcctgccaacctgagcggagtaagcatgaagcaggctgggctgntttcagcccctaccagcttttcctcatgc

SEQ ID NO: 520260 - DNA, 302 bp, Homo sapiens
ctattaaaaatgtattttccaaaagcaaggtaaatgctgacccaaaaagccgaaagccaaaagaccctgcggaacgggctggatggggctaaaacctgacacagccaggcggggcaaacctcggggggctcggattctatgggagaatagatagagcttcatcggtggccttgcatattccaccgggctgtgttcaagcaggctgcactggatgctcttgtgcaagaggcgctcactcatcacccgcagggagacacacctgcagtggaacaacttggccttacgccacaacaacctgtcag

SEQ ID NO: 520261 - DNA, 324 bp, Homo sapiens
  misc_feature (168)..(168): n is a, c, g, or t
  misc_feature (292)..(292): n is a, c, g, or t
  misc_feature (301)..(301): n is a, c, g, or t
ctttacaacgcctgggaagctttgttgtttgcaataaattttaatacttgtctgtttcggtctgcactgcctttatgagctgtaacactcacggggtaggtttgcagcttcactcctgaagccagtaagacaacgaacccactgggagaaacaaacaactccagacgngccgacttaagagctataatactcgctgtgacggtctgcagcttcactcctgagccagcgagaccacgaacccaccagaaggaagaaactccgaacacatctgaacatcagaagggacagactncggacacgncgcctttaagaactgtaacactt

SEQ ID NO: 520262 - DNA, 166 bp, Homo sapiens
gacatccacgatgcagcgtctattacaggttcgttttgttcatcgattaaagtcctacgtgatctgagttcatgaccggatggaatccaggtcggtttctatctacttcaacattcctccctgttacgtaaggacaatgagaaataagtcctacgatctctgattg

SEQ ID NO: 520263 - DNA, 514 bp, Homo sapiens
  misc_feature (21)..(21): n is a, c, g, or t
  misc_feature (121)..(121): n is a, c, g, or t
  misc_feature (409)..(409): n is a, c, g, or t
  misc_feature (488)..(488): n is a, c, g, or t
  misc_feature (499)..(499): n is a, c, g, or t
ttttccttcttacagtgtctnggcttctaaatcgtctttaattttaccacctttctaaaatatatttatttgttctttaacttacaagcttatttattcatcaagttttcattgagggttnacacttgtgccaagttctgtgttagcctccaggtgtagaaagataaagctttgaaggagctaatggaatccgtgttttgggagtcctcagggcaaccccagcgtttggagattacctggaaggactcacgggacttggcatcaggttgttcttcctcgtgtgcaggacgcactgcagccgtagtgaaggatgcacagtccgactggcagatcggaagggagaagatgtaggcggaacatggaggaaccccatatgccagccgtctgtatgctctgtccctcccacganggtcacacagagcacacgctgtcctcagcaataaaaacgcagcaagctctgtgcgacatttccattcaggctcatcggngactccggttntcagggtttttactt

SEQ ID NO: 520264 - DNA, 200 bp, Homo sapiens
tacacgatccacacaacatctgtaaaacgcatacctatttctccacatcactctccagcatctgtagttacctgactttttaatgattgccattctaactggtgtgagatggtatctcattgtggttttgatttgcatttctctaatgaccagtgatgatgagcttatatttcatatgttcgtgggcacacataatggag

SEQ ID NO: 520265 - DNA, 133 bp, Homo sapiens
aaggcggatattggactgaatgcgtcaggttagagccatttgttgactggagttggcagggctgcttggtcgtctgttgttcttggtctcgtctggaacctgccttcacattctctctgggtttggcccttat

SEQ ID NO: 520266 - DNA, 217 bp, Homo sapiens
ttttaactttagattgctccttcactgagacccacggatgatacatttcaagagtatgtaagcaattacaactctatatcaaatcttagttccaaaatccaattgtactggaaatacacttcagtttacctaaataaagtggcactgcaaagggcaaagaagggttttctatagggatggctacaatagagagttacatctgctggtgtctactgca

SEQ ID NO: 520267 - DNA, 460 bp, Homo sapiens
  misc_feature (71)..(72): n is a, c, g, or t
ggaggacagctggacgtctgcagagttggccttggacacgtgcttgctcacatggctggggctggtttaanngggtaatgaggcattgattacacgaaaaaagatgaaatggcctttgctcattcgttattttaatctcctagctgtggaggcagaaaattgttcataggaatggtttcgaggagatgtattaggagcgacatcagggtgatgtgctctcatttggccagatagaggagtgccggatcctccggggacctgatgggctgagtcgaggtaagtgtctgtctggaaagctctccctcagtgctaattggagctctgtgtacagtcgagcaaatgtaggcaccgacacgcagaggtcacctgtattcatccatgtataagtatcacctgactttcaccatagctgaatcatcacctttatttctccagttcagaggccttgggcacatatagc

SEQ ID NO: 520268 - DNA, 453 bp, Homo sapiens
gctcgacgtccaggccgagccgaaaagcgtgtgtagcgatgcaatggtggggcgcccgaaaaaaccagctgctgcgaagaaaaccacgcgcaaatcctcaactgccctgcccgatcagctcaccccacaattggcgacgctggtggaccgtgcaccggacggcgactgggtgtacgagatcaaattcgacggctaccgcatcctcacgcgtattcgtgacggcgaggtacggctattcactcgcaatggtcatgactggactgatcggctaccgcgccaggtcaaggccctggaggcgcttaagctcaaggacagctggctcgacggcgaggtggtcagcctgaacgcggatgggttaccggacttccaggcattgcaaaatgcctttgatatcggtcgcagcctggacattgtctattacctgtttgatgcgccgtttctggaaggtcgtga

SEQ ID NO: 520269 - DNA, 148 bp, Homo sapiens
  misc_feature (148)..(148): n is a, c, g, or t
ggctgggcgcggagtgtgcgtggcctgagccgtgcagggtgatgcttcagggttcttccgaggacctggacccgggctgccgctcgaaggcacggccctcccattcggcactggtttgtttgggggtcatcatggaaggcgcttcggn

SEQ ID NO: 520270 - DNA, 114 bp, Homo sapiens
cttgggcaaccacagtgtgcatgtgcaatgcacaagcagcaacagtttcccaaggcagggggggcagcaaacagcgtggccactcgcactcatggcacatccaagttccatggc

SEQ ID NO: 520271 - DNA, 97 bp, Homo sapiens
ggatttgctggtgcagtacaactaggcttaatagggacatgttggcttttctcttgacgtgggagaaattgaaaagaaggggaaggggaagaaaaaa

SEQ ID NO: 520272 - DNA, 135 bp, Homo sapiens
tagggaggctgaggctggcttggaggttgcagtgagccaaggtcacgccacttcactccagcctgggcaacaagagtgaaactccgtctaaaacaaacaaaaaaaaaagacgttcatttccttatattcttttac

SEQ ID NO: 520273 - DNA, 390 bp, Homo sapiens
  misc_feature (1)..(1): n is a, c, g, or t
nggctattgtgggaaggcataacccacagatagatcaacctttgtatcctggcccttctccactctccaccatgcaggacatacatcttctcaagcagtcaacgtcgaacgcttgagaaatagtcataattacccacatatagtaattaatagatgcgaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggc

SEQ ID NO: 520274 - DNA, 170 bp, Homo sapiens
acctttactacaacaagtacatcaatgtgaggaaggggaacatcttggggatcaccatggtgctggcatgctacatgctcttaagctactccttttcctacatgcatcttaagcactagcggctccgctaattcccctgaagaggacacactctggacccctccacccca

SEQ ID NO: 520275 - DNA, 139 bp, Homo sapiens
ggggcccctaaagggttcccccctttttcccccccccgggggggggggggggttttttttgtccccccctttttttggggggggttttttgtttcccccccccccgggcccccccctggttttaaggggggttttttta

SEQ ID NO: 520276 - DNA, 326 bp, Homo sapiens
aacacgataaaccatggccaattcagtttccctttggggccaattacttgaagtatccccagaaaatgtaaactgctcgccttattccccccaactttttgttcatgtggcagggagcaggaccccactatggaatagatttttaaaactgaacttgaagctaacgttaaaatagtggttaacaaagctaaaaaataaggctaaccctcgaaaagaacatgggccccgggttaactagctttgctctttaaatgcaagtggctgaggcccataggggcctagtaaatgttaactgtttttggaaaaaataaaaacctcagtaccca

SEQ ID NO: 520277 - DNA, 2858 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520278 - DNA, 945 bp, Homo sapiens
ggcatcttggcctggaggacacgcctgggtgcagcgtgtctgtgctcagtgagggccggtgaaagaaagtgcgtttccttgtttgcatttaattcagtttagtgttaatgggtgtgaacaaagctctggtgctagagggaaagttaggaataggcctcccagaggatactccagacagttgacaagacatctgcagcgccctgtcgagtgtcaaggaatttataacctgtggagactcctgaaaatcagtctaatgtcttggggtgcagctgtgcgcatgaggtgctgtgcagatgttgtatggccttgggtcacagactccctactggggctgcagtctattagaccctggggtactgtggataccacgtcgtaggtgaccacatctggacttacagtgcatcacactccaggaccccctgaaccatcacttgccacgatactccgggtcattggactgagactatgaactcttgcaatccatggtgacaggaggtgggcaagtgacatacatacaaggtcgagagcggtaaattcctaacaggagaacataaaggtttcacttctaaaagatccatccaaatatgcgagaaagaagggtacatataaattccaatgtgttacaaaacacaatgttgcctaccgtgtaaaatgagaatccagagtcaattggtgacgtgcagattccgaaggtaagtatttacaacaatcgcagaatttgcacattcctggaacaatgattaaacaagtagattagattgaattaattcctggtagaagtgactttaactgtctggtcccgcgaatgtaccgaagttgtatatacgacaaggcctcgaaactggtgaaacgagctgggaaagtggacataaaaaccattcaatattatatgtacataaaattacatcaataaacaactaggaacccgagaccagggaagcccta

SEQ ID NO: 520279 - DNA, 3390 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520280 - DNA, 552 bp, Homo sapiens
gaagttcttggagaaaactggttttaagttagcatgatctttcctcaaaaaacttatagtcctgataagaacttcccccagaattccagataaggcagcccaggccttgctgtttgcccatgcccatgcggtcagcttttttgggtaccgtggcatgcaaatgcaaacgctcacccaagaccccctgtagtgctgattactggctgaagaccctgaaaatttgaaaaagtttggaggtttgacccccccaaatttcatgttgaaactaaattcccagtgttggaggtggggcccggtgggaggggtttggattgtgggattggatcccttatggccatcttggggccatccttgtggtaatgagcaagttctttatttactagttcctgagcgatttggttgctaaaaaaagtttagaagcatcatccgctccctttcctccttttttaccatgtgatatgcacccccggggtacccttcccctattgttccagccccccgctttatggacagcctgtaaaactttgagccaaataaacctctttttttttt

SEQ ID NO: 520281 - DNA, 403 bp, Homo sapiens
ccaattttactgggtacagatctttcccctcaccacacatatgcttttcttttttgttcttgactttctccttttctatatgaaattttatgatcatagtgtcaagttttctccaagacagctcttgcacaaggccaggagtggtggcccacgcctataatcccagcactttgggaggccaaggtggttggattgcttgagctcaggagttccgaccagcctgggcaacatggggaagccctgtctctacaaaaattagccaggtgtggtggtgcacccctgtggtcccagctacttgggaggctgaagtgggagcattgcttgagcccagtaggtcaaggctacagtgagccatgatgatgccactgccactccagcctgggggacagtgagaccctgtctc

SEQ ID NO: 520282 - DNA, 2739 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctgcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520283 - DNA, 255 bp, Homo sapiens
aggatctccccagtgtagactatccaggaatgaagagtcattacgaatatgtgttgcactctaattcctagaactgtaatcaactggccttttgatttgagtgatgtctaaggagcattaagagtcctgaattggaaaaccgttctttccacagggggcagtcaaaagaaaagccctgaaacatcactctttgtccaactagaaaggagtgtgactgttaataaggcgcaggagtaagttgttaggtctacctgg

SEQ ID NO: 520284 - DNA, 2640 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctgagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520285 - DNA, 1079 bp, Homo sapiens
tattcccggttttgatcacatacgggactaggggttatcacggtcacaccatatgcggaagtgccctctagatattatgtgatagaatagatatcatcattctctggccgtttcatgagacgttaaagctactacgtctgcccctagcggctcgattccaagtttacttgcccttcttgtaattcaaagcactggaaagtgacgagctcacgcagattcggaggctccttggacaatgattcctgcagcttgcagatccttgatcgccggaaaaccactggccagggaccaatgggcaaagggaaatccaggtgagtcagtcttccgagcccttgacgcagttcgataaactacgcaggagtcaggggagcttcagccgctcaactcttcagaactctcatcagctggtgtcagggaactggatctagacaaagggccattgaagaaagcagagccccataccataagacgacaccttatcctgattgcgctgtcctgctgctagatgtgcgtgatagagagtcttaccagcagtgtcacattgttggagcttacagttacccagattgcaagctctgtctagaactaatgaacccgttattcaaatgatattcttgaatatagataattgcccatggcaagatcatcagtctgttaatcgacgatgatgaaaggctggccagtcaggcggccaaccaccatgtgcgagcgtggatattgaaaacctcttcatgctttaccggaggtgagccaaggtctaaaagtcttagctcagaaattcccggaaggactgattacatggttccctgaccagcatcttgccagcatggcaccattcctctctgggtcttgcccggaaatcgatgccagccccaaagggccacccataccagctgagaataaatggagatttaccccagaagacttaacaagaagatagaatatcatctggaagaggagcaagggcctgcagatcatcctagcagactgaacacaagctaactgcctccggaagagagtccaaggtgcctggtgcgccgaagcgctcagaatctgccaggtggctgccccgccagcaa

SEQ ID NO: 520286 - DNA, 2597 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcactcactacaacccggtggacagcagcactatactggcctcctcttatcgaccctggctacacctatcacccagcttccgtttagcactccccgaccatt

SEQ ID NO: 520287 - DNA, 3463 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcagcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520288 - DNA, 377 bp, Homo sapiens
  misc_feature (196)..(196): n is a, c, g, or t
  misc_feature (232)..(232): n is a, c, g, or t
  misc_feature (281)..(281): n is a, c, g, or t
ggtgcggtggctcatgcttgtaatcccagcactttggaaggctgaggcgggaggttcacctgaggtcaggagttcaagaccagcctggccagcatggtgaaaccatctctactaaaaatacaaaaattagccaggcgtggtggtgggtgcctgtaatcccaactattcggggaggctgaggcagaagaatcgcttnaagccaggaggcagaggttgtggtgagctgagattnagccactgcactccagcctgagctacagagcaagactctgtctcagaantaacaataaataatctgtccctttgtccttacatgggagaaattaatacatgccaagtcgcttctgtatcccctcattgtctgaatttaggggata

SEQ ID NO: 520289 - DNA, 2492 bp, Homo sapiens
  misc_feature (2335)..(2335): n is a, c, g, or t
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaaggtgagagccagctgcagccttcctactgcagtgcntgctgggccaagagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520290 - DNA, 355 bp, Homo sapiens
gagctcggtaccccatgcactttgtcacagctactagatagtgctgaggcagagaattgcttgaatccgggaggcggaggttgcagtgagccgagatcgtgccactgaactccaacctgccaatagagcgagactccgtctcaaaaaaaaaaaaaaaaaaaaaagaattagctttgaaaaaaatcccgcacttcagaggaaagctttttttctgcttggtgtctttccaaagaatagaaatatttgaagcctatgtttcctagccgattgtgtggatgggggtgagctggctgaggcatcgctcaagctggggggtggtgtgtaaaaagcacttgaagcccacaagaggcccccc

SEQ ID NO: 520291 - DNA, 197 bp, Homo sapiens
cccaaagaagggaacaatagttacctattcagggtgggggtgggaagagggtaaggaatgacaaaccattcttgggtactacgctcactatctgagtgatgaaaaacaaaactccagtgacacacaatttacacatgtacaaacctgcacatgtaccctaaaacttaaagtataattaaaaaaaaagtactgtaacc

SEQ ID NO: 520292 - DNA, 397 bp, Homo sapiens
  misc_feature (14)..(14): n is a, c, g, or t
  misc_feature (37)..(37): n is a, c, g, or t
gcacacactataangtggatcatacattaatcacggngcataaacactgaatagtttggggattcggacgccgagctcttagtagcagcctgtttactacccactaggagatttacacacacagtccttcatttgactgagatactcatttcatctctaaacacctctatgcacacaaactagaaatctagagagacaagaaattcctagactctacaccatctcaagactgaaccaagaagaaattgattccctgaacagaccaataatgagctccaaaactgaataaaaataaatagcctaccaaccaaaaaaatcccagaaccggatagatccatagccaaattctactagatgtacaaagaagagctggtaccatccctgttgaaactacccg

SEQ ID NO: 520293 - DNA, 3123 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcagcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520294 - DNA, 2684 bp, Homo sapiens
  misc_feature (2527)..(2527): n is a, c, g, or t
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcntgctgggccaagagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520295 - DNA, 2886 bp, Homo sapiens
tcggcacgaggctgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520296 - DNA, 393 bp, Homo sapiens
  misc_feature (217)..(217): n is a, c, g, or t
  misc_feature (220)..(220): n is a, c, g, or t
  misc_feature (222)..(222): n is a, c, g, or t
  misc_feature (244)..(244): n is a, c, g, or t
  misc_feature (252)..(252): n is a, c, g, or t
  misc_feature (283)..(283): n is a, c, g, or t
  misc_feature (310)..(310): n is a, c, g, or t
  misc_feature (317)..(317): n is a, c, g, or t
  misc_feature (320)..(320): n is a, c, g, or t
  misc_feature (348)..(348): n is a, c, g, or t
  misc_feature (370)..(370): n is a, c, g, or t
  misc_feature (387)..(387): n is a, c, g, or t
ccatgaatccacagggttgcgcaccgccgaggagccagatgcggcaggggcgttaactttcgcgtgccgatttggcgcaacgggtcgcgaccgaccattgctaggggctggttctggagggtggaaccgaccgttcccgcttggattggtgcgggaaggcgccgggccgatcttcaggcggctgcttgcctcaggcgaagtactggccgccattggntgnantggtggagccggtgatgaagcnggtatccncggacgcaaggaagaccacgcagcggcgaanttcctccggttcgcccagccggccganccggatnttncgggatgattgcgtttcgttcagcaatnttttcgttcgaaaacctttgancattttcggtgggcgantttaag

SEQ ID NO: 520297 - DNA, 781 bp, Homo sapiens
ttcccatatgagcctggcaagcaagtccggagcgcggtgaggatcaagaacgtcggcaagtcccatgtggcgttcaagttccaaacaacagcaccaaagagctgcttcatgaggcctcccggcggcatacttgctccaggagaaaccatcatagctacagtgttcaagtttgtggagcatcctgagaacaacgagaagcctttagatcagaagtgcaaggtcaagttcaagattgttagcctgaaagttaaagggcctgtggagtatgttccagaatgttcgatgagcagaaagaccaggttgcagttgagcaaattctgcgggttattttcttggatgctgagcgtcctagcgcacaactggacaggctcaagcgtcagctcgctgaagctgaagcagctcttgaggcacgcaagaagcctccagaagacactagtccccctatcgttggtgaagggcttgtgatcgatgaatggaaggaacgaagagagagatatcttgctcgtcagcaggttgaagaggttgattcggtataaacacggtgccaaaaactctgcaaaacatcggttcctgtccatgggttttagctcccgcgaacaaaaatgaggctttgtgtaattaagatttagcttcttcctgggccctacatgtagatagccagtcagtgcttgataataatatcctccgggataaatcttgtacgtggtgttctagatttagatgtgtgatttgtgtccatttcctaccgtgtttcagtcagtgctggttccaatcaattaca

SEQ ID NO: 520298 - DNA, 280 bp, Homo sapiens
gtccggtcttgagttcatgtgactgcaggtactggagatccacagcaaagatccaggacccgctgaaagcctagaaatggtgagattgccagttccgacatctggagaggggcaagggctggttggaactggtgggaagcagctgtggtgggactcaggcctccccgcagtcagctccacaatctgcaccctgagttctccttgcccaggttggcatctgtcccctgcagccataagatggcagctaggctgacagccgggcccccgggcgtcctgtctt

SEQ ID NO: 520299 - DNA, 408 bp, Homo sapiens
  misc_feature (5)..(5): n is a, c, g, or t
  misc_feature (24)..(24): n is a, c, g, or t
  misc_feature (45)..(45): n is a, c, g, or t
  misc_feature (54)..(54): n is a, c, g, or t
  misc_feature (89)..(89): n is a, c, g, or t
  misc_feature (153)..(153): n is a, c, g, or t
  misc_feature (170)..(170): n is a, c, g, or t
  misc_feature (225)..(225): n is a, c, g, or t
  misc_feature (243)..(243): n is a, c, g, or t
  misc_feature (286)..(286): n is a, c, g, or t
accanatttaaagggtacctattngaaaagttttccacaccctgnggagaacangcatacctacaattaagagagtgaacataccccancatcccctcaaagtgtcacaatgctccctcctgatgactccctcccccagaaaacccacccaancggctttcaatttgcantttgtagttttatgtgaatggaatcatatagtatgtcctttttttttgtctggcntctttcactttgcataantattttgagattcatatgtctccatcttgatgctcgtatgaantcattcttttaaatgttgaatattcccttgtatggatataccacaattcatttacccatttacttgttgatgacatttgggtttttttagttttgggatattacaaataaagctgctgtgaa

SEQ ID NO: 520300 - DNA, 272 bp, Homo sapiens
ccgcagtctgcggcgcttggtcagtgaggggttagaggccaaatagtgcagagtacacgatccttcccagtataaacatctctggtttcctgagagtcaggatccaaaataagtgaatttctttcgcgttaaagaccacatcaaggcctggtgaatataaactaaggtagcactcaaaggaatagcctccatatttctgctactgggctgcgggcacagaacagttttagataccctccctttcccctatgggtttgaatgatactggcttg

SEQ ID NO: 520301 - DNA, 551 bp, Homo sapiens
cggtagctacaacgaagtctcacggtaatgcgtggggcgcatatgatgctcagtccccaccagcatggatgccaagtgtgggagggcaagcttgtgcctcaccatacaccatcctggaaggaagaatccgctgattttcctctcttcctctggtaggaggcctggggatgagagcatagtttgtgcccaggaccctgtcaagacaacagtgctcccttccagcataggatgcgaactggtatgactcatgacagagtgtgggtaggacacaggcctgggagccggagccttggaagggcgtgaggaaagaaggagatagggcagtgagcctcttaggcctctctctcctacccgaactctgcctgtgccaagggctggggaggggctacctgggcagtggcagggccaagtgctctccaaccccacagcaccgctgctttgctccgcccatcctctgcctgtgctctcacggtagtgctggggcgcatatgctgctcagtccccaccagcatggatgccaagtgtgggagggcaagcttgtgcctcaccat

SEQ ID NO: 520302 - DNA, 533 bp, Homo sapiens
  misc_feature (212)..(212): n is a, c, g, or t
gaagcatattgaacgaagagaacttgattgacgaagactttcaaaatctaaaactgcggtcgacaggcttcaccaatcttggagcagaagggagcgtctttcctaaggtcaggataacggcctccagagacagccagatgcaaaatcccgtagtttcaagacacagcagcatgccccgccctgactattagaatcataagaatgtggaaccncgccatggcccccaaccatatgtacatatctattattctagcagtgtttagacaagactgcatggagaagtgagcaccacgtaaagactctggcctccgggagtttcttcttccatctagacatactgccagtcctcatctgcaatggcaacgttgtgcaatgtcttgcaaacgacatccacgctcacttgctaaataagaatctatgacattaacatgtagctcgatgctattagcgcttgtcagagcagcgtgcgttccctctcaactcaagctacaaacagtacctgcagacaactcggcttcaccggctacgccaca

SEQ ID NO: 520303 - DNA, 528 bp, Homo sapiens
accggacggacagtgtagcatggaacttagggccactagaacttaacgataattacgttaatacgtacaggtcgattcctgatctgaaatgttcgggatcagaatgtatcagatatcagatgggtggggataaaagaatatttgcgtatacataatgagatatcttgggggcgagacctaagtctaaacacgaaatttatttgtccttcatatgcaccttatatgcatagcctgaagataattatgtattttcactaattttgtgcatgaaacaaaggttgtggacacgaggtcgcgtatgaattactttagtggtggtatcatgtaggtactcaaaatttaacaaattgggagcatattggacttgatgtttggattagggatgctcaacttgcatctaatactcggctagcattattttaatagtttgctaatcacctcaaaatgtcttttatcatagccagtgtgttagagtgcaaaaaaataagtattcacatggcaacacggtctcgcagggtaccgagctcg

SEQ ID NO: 520304 - DNA, 212 bp, Homo sapiens
aatcagccggccctgagttagaggcaaataatagcaatacatgtattgtatcactcatataagtacatacaactgtagtgaggcaatataaatagccatctctagagaaacaataagccaaaatatagctagaacaattaaataggtaagaaaactaatgccaagttaggatagaaaattctacaccgtactatgtcaaaacaacgctggcc

SEQ ID NO: 520305 - DNA, 1098 bp, Homo sapiens
gggaaacatggccggcattgagcggagtcctgctggctgacccgagcgctggtctccgccggtgaaccctgtgggcatggagagtgtctgagtacctcgtgccgctggatgcacgctgcatcgcggagccaggccgaggacgtgagggtggatgggctcctttcccgtgaccatgcttccgggagacggagtggggcctgagctagatgcacgccgtcaaggaggtgtcaagggctgcgatgtacccagtggagttccaggagcaccacctgagtgcggtgcagaatatggatctgaggagaagctggagcaggtgctgagttcccatgaaggagaacaaagtggacatcattggaacagattcataccccgatggagtataagggcggagctagcctagctatgatatgcgggtgaagggtacagttggactctatttgggcaacagtacgtaccatgtgcaaggtcactatcccttgggttataatgaactacgggcaacaaacagatcctagaacctgggctgcatcattacggagaagacacgaccagacactgggggcagcaccagcctcctcctggaaaccatgacgcagttgccacaggcgcgcttgatgacaactggaagctggcaaaggaaaccgcatcggcaacgcacagacacccgacgctccacaaggcgggacagggcacacgggcaacgcgcccaagggaacgccaagcgcccaccccacgacacagggggccgcgggacacacggaacaacaaggctgagcaccaccccagcggcccgagcagacaaaggaacaacctggaggacgagaggtggggccgcccgtggcaggcgggcgaggcaagcaagaggcaaagcgcgtgccgggacgagacgggcagccgaccacacacagatccaaaagaactacggcagaggagaaagggacgtccacatcgaacccaacacgtcggcggtgcccatcgagcgcggcggagcggccagaaagcacggaaaacacagagaactgacatgaatgagaggagaaaggcagccacaacaattcacgtgcgagaaacagtcaacaggaacggaacgagcaagca

SEQ ID NO: 520306 - DNA, 840 bp, Homo sapiens
agccatggcggagctgggcagccctaggttagagtggagacggaggccaggcgcaggggtcacacctcatctggtttccttcccatctcacagcttagcttgtgcttctcaacaccaagtcttctaagagcaataaataactacaccatgaatgtgcgaagtagctattcttatatagggggggggcagggctggactttatgctgtttcatccagaaggacacaaggggaggagagcatcctcttacagtcttttgataacacttacacttcataaaatcccgagaaccagctccatcttctcattaccctattatcaccctttacaacccctacactctcatggagacgttaactatcaagctctgactgttaattgttcgcacaaatttacagagacgtgagggtgcgtcaaaggcttgatacgcacaagcctctgggtagccccacaagtcccgctgacatgagcaacacacaatagctcagcgcggtgacggcaacacttcctacgagagcaatgagcgaactcagcatgcagtgaccccatccagggccaacacccgcagaacactatagacgcaacaaagcgccacagaaaagaacacaggaaaagggagcaatcatgaatggagaccgtagaatacagcatcccaatggtaaaaacacaacaacagccaaaagaaagcccaagggacagaccaacaaacaataggaaagggaatcacccaaaagccggagaagggagccccaaaaggcacaaaccaccaacaggagaagaacttagagcacgggaaccaaagcaatccccaacggcattggggcccagagcatcactccctg

SEQ ID NO: 520307 - DNA, 344 bp, Homo sapiens
ggctgtgaatgtcgatgcctggtcgtatgctgtcccgggttacaactgagtgcgcgtttaccggaatctggtacggtaacggctggcggggcgttatcctgagccacgatgtgcatgagtatggcaatgagagccctggggtttctatgtggagaacagattaaagggagcaaggtcagaagtggggacaagtgttaagaggctctcataaacatccagccgagacataataaaagtttgggccagaataacagtagaggtatggtcagattcagtatatatcaaaattaggatataggtaggaacataaagagatgagagcctgagccctgggagagtccact

SEQ ID NO: 520308 - DNA, 345 bp, Homo sapiens
tagtcacccatagccatcagttctactatcgaacattactaataaggtggcgtcctctataacctctccaccctgtatcagcaagcacaggaccccctctgattactcctgccatcatgtagcccttagggcatagtatgatctatctgcacagtagcagagagcacgcgagcccccttcgaccttggccgatggggagtccgaactagtctcaggcttcaagaccgaatacgccgcaggccccttcgccctattcttcatagccgagttcacgcgcctgattgatatctcgacacgcctacacgagtacgttcttcctaggaacaatctatttcgctacgctga

SEQ ID NO: 520309 - DNA, 165 bp, Homo sapiens
  misc_feature (29)..(29): n is a, c, g, or t
tacttttccacaggttgccacagtatgtnaatgcaatatctgcacagcacaattaagccaagtgcagtaaaatggattgcctgtacttctgtattctaaaataaatgcttatgctgtgatttttagaacaatatgcaaactgcagacatttgctcttaattcctg

SEQ ID NO: 520310 - DNA, 150 bp, Homo sapiens
tggaaataccatgagagtagagggcactgggatcgccgtgccccacggcaggcccctgacaggaaaaatagaggccctatgggtcacctcgactatgtacaacgtcgttgtatggctagctccctaccacagctatactgcaagacagac

SEQ ID NO: 520311 - DNA, 335 bp, Homo sapiens
tattgtaaactaagcaaagtgtccaatttattttatattttagttttattatctttagagatggggtcttactctgtcgtacagactggagtgcagtggtgcaatcatagctcactgcggccttgaactcctgggctcaaacgattctctacctcagcctcccaagtagctagggcaacaggcactcgccatcatgcctgattttttttttttttaagacatggagtcatgctatttggcacaggctggttttaaacccctagcctcaagcgatcctcctatcttggcctcccaaagtgctgggattacaggcgtaagccaccatgctagccttg

SEQ ID NO: 520312 - DNA, 151 bp, Homo sapiens
gaccccgtcgacaaaggccggcggatagccttgcttgagcaaatactcgtggttcgactcacaaccaccgatcagggccagtgccagcaccgcccaagcattacgccacatccacaaactccccggcttcacttgagtgaagtctagaagg

SEQ ID NO: 520313 - DNA, 328 bp, Homo sapiens
catatatataatatataaatactatataatgtgtgtattatatatcatcaaaatatattaataatatgtgtatgtcatgtatatattatcttttatatataaacataaaatttacatacacaaatttaattaaaatataaatatattcattgtgtatcataaacatatcagctcattatatcacagtatacaatttaatcagctcattacaatcatgcaatcattacatatcactgtcacaatttcatattgtatatcacgtataaatcaaacagacatacacatatcatatatatcatgtgttacttaatgattgggtagtcacaga

SEQ ID NO: 520314 - DNA, 510 bp, Homo sapiens
gctgagttgaatggtaattctgagttctttgaggaatcaccaacctgctttccacagtggctaaactaatttacactcccaccaacaggtgtatgtgttccattttctccacaaccttgccagcatctgttatttattgactttctagtaacagccattctgactggtgtgagatggtatgcatttctgtagtgattagtgatgatgagtgattttatatgctttttaaatgcatatatgtcttcttttgaaatgtgttcatgttctttgcccactttctttttaatggggttgcttgtttttcgcttgtaaattttttgaagcttcttatagattctggatattagatcttgttggatgcatagttggcaaatattttctaccattctgtaggttgtctgttacttgttaatgtttcatttgtttgttgtttttgagacggggtctcgctttgacgcccaggctggagtgcagtagcacaaacatgggtcattgtagcctcaacctccc

SEQ ID NO: 520315 - DNA, 175 bp, Homo sapiens
ctccattcctgactgctttcgtgggctggtgttgcatgtctgtggcttttccagcgacacagtgcaagttgttggaagatctaccattctagcgtctggaggatggtggccctcttctcacagctcccaattatatgctggatatacaagagactcatgccccaaactgggacac

SEQ ID NO: 520316 - DNA, 122 bp, Homo sapiens
atatatccaggggacagctctatgctctcatactttgagccaagactgtgcgcggttactccttctttgtgcgacagcttcgtttatgtagctagtatcgaagacggagttagatcgagcta

SEQ ID NO: 520317 - DNA, 345 bp, Homo sapiens
  misc_feature (20)..(20): n is a, c, g, or t
aaattgattatgagctacgnaatgggcagtcagaatgttgagcctatattccataaagatctagatttgggtggtagaggggagtctaacacaattggatgaagggaaagggtgtaaacagcgcttgcccaaggtgagacctcatgaggctctgacttgctgaagaacctacccattgctgtacatcctgaacactttattgggctggccacttgtctaccactgtacgttgctgactgcctggccatgcagcctggtgtgctcccatttcctttgaccgtgagcagcttaggcgagggcgttgtgggtctctacacaggaaggggcttgcaatcggctattctg

SEQ ID NO: 520318 - DNA, 810 bp, Homo sapiens
  misc_feature (810)..(810): n is a, c, g, or t
gagacgttcttcgccgagagtcgtcggggtttcctgcttcaacagtgcttggacggaacccggtgctcgttccccaccccggcggccgcccatagccagccctccgtcacctctctcaccgcaccctcggactggccccaaggcccccaccgccgctccagctggcctggcgcagccaccggctgcgtcgtcggctctccttagtcgccgccatgaagaccgcgtcccacctcgcaggtgcgccagaaattaccaccaggactcagaggcccgccattcaacccgccagatcaacctggaggcttctacgcctcctagcgttttacctgtccatgttcttactacttgagaccgcgatgatgtggcttgtgaaggaacttttgccaaaaatactttcttcaccaatctcatgagggagagggaaccatgctgagaaactgatgaagctggcagaacccaaggaaggtgggcccgaatcttccttcaggatttcagagaagaccaggacgtggtgactgactggggaagaagcgggttgaaatgcaaattgggagttgttgcatttacatttgtgggacaacaaccaaaacttgtccattcagtcacctaacgtgtgattggcaacaaaaatggccacgtggacaataaaatgaaccccccaattgggtgtggacttcatttgagcaccacatttacccttgaatgaagcagggtgaaaagccatcaaaatcaatggggttgacccacggtgacccatttgcgcaagaggtggagcgccgaattctggttggggaaatatttctttgacan

SEQ ID NO: 520319 - DNA, 1709 bp, Homo sapiens
  misc_feature (1616)..(1616): n is a, c, g, or t
tgggtcttggtccaaaattttataaagggtctttagaagagcaacatctccagactctccagaaattacagcgtgccaggggagacccggtgttagtgcgtggtggggacgtggcgtggggcatgtggcagggggctctcgggctttcccaccctttcgtgtccgtgaaagatggggggtggggggcagtatatctctctcattcttgtggggttctccacaagtgcctccgcggtggtctcggggcgagggggccctctcatatagggggcccaatctcttatcaccgagtgtgtgggtctcccgaggggccagccgatgtgatctctatacagcgctgtggtgagtggccacaggagaaacacccgcgtggtgcggtggagcacacaacgagcgggtggggcggccaaacgagagacgagtgtgtgcccacacgccgtgatagggatagtgttattaacgcgggggcgggctccctccgccggacgtgtgtgagaaactaccatctgcggagggcgcacatctcgcgaaacgaagagcctgtcctacgaggtggggggatgttaatgaagacgccgcgctgctgtgttgctcccgctgcgggggaggtgcttctcccgcagagagagcagcacgcccaaagaacacgccgtgcgcgccgagcgccgtgtggggtggcgccccccgagatgcttctcctcgccgagtgagatgtgaaacagcgcgggggaagaccaaaaccaccccaatataagaaacggagggggctctccctccgcgtgccaaacgaagagaaaagaggcgccctctccctaataggagagaagctctggtggggtcacacgcggaccgaggagagagaacccctgcggtgggccgcggtggggggcccaacagtgggggccaccccaacgaagagaaacccctccttcctatgtaggtgtgggggccaccaccccctgtttttctccacagggacatatataaaagagggcctccataaaccagggggggcccgcctctgcgcgtgagaaaaagagtccccaaaaaaaccccctccttctgcctgggaaaaccctaaacacacgaccaagggtcccacaagatctccccccgagcatacatcacgcgggcgggggcgcccgcctattttcttacacaccacaagagggaaacacaaatctcctcggggggcaaccacgggggggggggacaaaacaacaaaaagcgggagatttcacgggcggccccgggggggtggggggggagaaacatctgcgcgcacaccccttaaaagttctccgaaagagaatgaagaccccatacttcttaggaagcacacaagagaccccccccggagatgtaagaaaaacaaagctcagaatcatctcaaggcatacacgccgtcttgtgggaggagatgatcgcacactagagggagacaaaaagacttctcccccctctccggcggagaatagtggggcgagctgcgcacaatgatgtgagcgggcgaggaccgcaccggcgcgagatcaccacacgacgaagggttggaccaccccagcgaattaagtgcgagcagatgatagaaacgcagcaccgcgtgcgtaacatantccagacggaagagacgaggagcccccgtgggcggaggagacaacacactcacgcgcgcagagaaaacaagcatcaggcgaccgcactcgaaa

SEQ ID NO: 520320 - DNA, 221 bp, Homo sapiens
tctaaaaaaaaaaaaaaaattctatagtatgtattcttattttaaaaatctgcttcctttactgagcatagattatccatgttgttttgtggatccatactttattcctttctactgtatggcattaaatttgtttatccatttacctgttggtagacactttcattgcttctgatttttggatatgacaaataaagctgttataaatatccatgtataaa

SEQ ID NO: 520321 - DNA, 3188 bp, Homo sapiens
ataatttactttgtattcttgaataaaaaacatttgtacattcctgatactgggtttatagagccatgtaccagtgtactgctttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520322 - DNA, 300 bp, Homo sapiens
atagctggaatcctcaggcagtggagctgcattctgaacccaggatgacttggggctaagtaggagaggagtagcttcgtgtccggtttggattcttcataatagcaacccagacctgtatctcaatcaaaaaataatctcagctccaaccacatttcgggtcagcaccatatttaacttcagctctggtcctgagacatagcactgacataagaatctccctcccttatctccaccgaccagagtcatgtcctcatgacgtgctgtcatgtagtgaggaccgatccgggcgggggggtg

SEQ ID NO: 520323 - DNA, 300 bp, Homo sapiens
ttccccaaaggggggggggggggggcggggggggggtttttttaaccccgcctttttttttggccccccgggtggctggggggccccccccccctttttttttcccccttttaaaccccggggccgccccccccccccggttttttttttggcggggggggggggtttcttttttccccggggccccctttttcccttttgcccttttttggggccccttttaacccgttttttcccaaaaaccggggggggccgggccgggttttcccgggttttttttcccccccgggccgggtttta

SEQ ID NO: 520324 - DNA, 3518 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcaggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520325 - DNA, 3014 bp, Homo sapiens
ataatttactttgtattcttgaataaaaaacatttgtacattcctgatactgggtttatagagccatgtaccagtgtactgctttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520326 - DNA, 3318 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520327 - DNA, 2147 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctcctgtgtgccggaagggctgaatgaacaaccccacagccatgggtggctggaggactacgggtgatattaccaattttctgcccccaaggcttgggattcaggggccaacttccaatttgaaccggtccataaggtcccttgccc

SEQ ID NO: 520328 - DNA, 2095 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacagaggcagtgtgtgtagtcgtaggtgggatagatgcaccatttgtcgcctgtgcggtggtgtggtgtatactgactcagataggctactaggtccatctg

SEQ ID NO: 520329 - DNA, 316 bp, Homo sapiens
tagaggatcttcaaacacgcagtctaaagaaaagaaaactttaggctgggcgcagtggctcacgcctgtagtcccagaggctgaggcgggcggatactgaggtcaggagttcgggatcagcctgaccaaacatagagaaaccctgctggagatacagagttagccaggcatagtggtgcatgcctgtgatcccagctgctcaggagcctggcaacaagagcaaaactccagctcacaaaaaaaaaggaacgaaggagaagctggcgctggtggataaggccataacccttcctttgggtggaactactttacaaac

SEQ ID NO: 520330 - DNA, 85 bp, Homo sapiens
tactactaaattctgcgacacgtcgacatgaaattgtggaaatttttatttcttctgattttcttaaaatgagtatattacttgt

SEQ ID NO: 520331 - DNA, 3012 bp, Homo sapiens
agcggagaatagtcagagcaaaaccacgcctgtgtcttcctcctgcctcagggacgaacaccttccttccagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520332 - DNA, 574 bp, Homo sapiens
acctgcatgctctctctgatgccttcctagatgtccccgtcgctgcgtcccccgtatgctggctacatgactgcgcaatgcccgactcaatcaattcagtgccaggtgcaagtctgatcatcttttctctctcaggaagcccttcacaggagccagacagccaagcaggcaggccaggcccgaggagcaccaaccttcagcaggtgcagggcatgggtgacaccgtggaatttgtacagatcactggtgctgtccgggacaagttccactgggatgtgccactcggggagagtgctggtgacagaacatggcgagtgtgctggggaacaagcagaagccagaggtcaaggtcgtgtggttacttagtttgcaagagatcgagtcgccctggaccaagcctgcagcctgacctaatggggcaccatgtgccagcagcatgctcccagagaacgagtcatcccagtgacctgtggggtctcctggcagagctgggaccagctcaccttggggtcaggggcttgctcagctccaagtcctgctctgtagccgaaattgtgtagcttgggtggtcata

SEQ ID NO: 520333 - DNA, 1203 bp, Homo sapiens
actgcgcaaaccagacttcgctcgtactcgtgcgcctcgcttcgcttttcctccgcaaccatgtcctgacaacacccgactactggctgacgcactcgacgacacactccgcactaagctcgaacacctgaacgacagcacagagcacgcacagcagacaacatccacatgcctctccacaagacaaccgactcgcaaccaggacgaacgcacagccacggcgaactcgctcaatgcacggcgtgcgcccgcccaactactgccacctgctcacacttcccaccacagcccactctgcgccctctccttcactcctataccctatccctccctctagcccctgctctctacaccctcccctggctacacgcaactgccacacaccgggacgcggctcgcgccacttccacacgccctctccaaccacacgctgaaccacaatgggctgacccactgggccccaccacttttcccaacccaactccaaccacgcaacaagccttaacccctgtaccccacacccgcaacacggggcccgggccgcccccactgggccgcacctctcgacccacaacactccccttggtttcccctaacgcctcccctaaccctacccctcggcgcgcccctcggagccccaacgctggcgcacacaaccgccgacacacccacgcgaaacacgccacctactcgggcccacctaggcatacccggcggaccccggaaccacccgccggcacaccccgaaccaacgcgccatggaacggagaccagccttgcgacgagcacacgccgcgaagccaccgccgttcggcgccgccgcccgtcggccgccccaccccggacacacccacgcccccgccagcaccagcgtcccgataaaccgccacggcactaacgaccaccaccccccccactaacccgcgcgctctgcgcggcaccccctcccaacacagcacgccggaccgactcggatcacaccgccgatagggcgaccagaacgtacggaccacgtcggcgcccttcacccaccctgggcgctccaaacacggactgacactcacaccacaccccccacagacacgaaacacgagttaggaacagccccacagcctgacgtaccaacaccagcctaccgaccgcaccgcacgcggacgcctacaccaccagagaacgactctgggccgcaggacgacccgcacc

SEQ ID NO: 520334 - DNA, 254 bp, Homo sapiens
aattgccaatacatcaacaactgagaagggtttttttagaaatacatttagtaaagtccccaggacgatagtcttacatttaaacttttttcattaaaacatgggggtgatgaataacttttacacagttatgagtactgttaatatctggaaagtatcttgagatatcagtggaaagctaaacagtctaaattacaatgaagtacttcattttgattgcgaaaataaaaacagattttatcaatgtctttaca

SEQ ID NO: 520335 - DNA, 3061 bp, Homo sapiens
  misc_feature (15)..(15): n is a, c, g, or t
agccaggtgtacccngggttatgggatcacattgacaaagctacgggatctgttatctggcttgttttccgactcagggataccggcgtctctcccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcaggctccttgtgcctatgcttctaggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520336 - DNA, 342 bp, Homo sapiens
gtcatacaatattgtccttttgtgtctggcttctttcacttggcatgtttttaatgttcatccatgttgtcacatttattagtgctgcttttctttttttagctgaataatattccattgtatggatgttccacattttgtccatctgttgatggacatttgggttgtttctattttttgcctattgtcaataaagtttcaacaaacatcctgtataagtttttgtttcaacacctgtttccagttcttttgggtatatacctaggagtggaatcaatggtcatatggtacagtggtccccaaatttttggcaccagtgaccagatttgtggagacaatttt

SEQ ID NO: 520337 - DNA, 1965 bp, Homo sapiens
  misc_feature (1608)..(1608): n is a, c, g, or t
  misc_feature (1615)..(1615): n is a, c, g, or t
  misc_feature (1636)..(1636): n is a, c, g, or t
  misc_feature (1640)..(1640): n is a, c, g, or t
  misc_feature (1643)..(1645): n is a, c, g, or t
  misc_feature (1647)..(1647): n is a, c, g, or t
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagnataaccnaaacaccggaagggggcacangggngcnnnanatccactaagagtaacagccggctcttgtgaatccacgagaggcacttactcacaacacatctggccaagggatcagaggccgagggcctgcacaagactgaggttggacggccggagagcatacgccggcaggcgagagaagtaggccacaccggaaaaaggggatcaaaagaagacacctacacacaggggaccagaacgaccggaaaacatgcgcaacagtgagccacacgacaaactgcggggggtgagaacaacaccaactacgggcaaccacgagtaaaaacaggctagcagactgcgtagtatatctgcat

SEQ ID NO: 520338 - DNA, 158 bp, Homo sapiens
  misc_feature (142)..(142): n is a, c, g, or t
ccggaccttcgctgggcgggcacttagaggtggggagcagagcaatctcttcatcccaaccatccaaccatctgggtccagcattgcaactcttcaatctctggcactcaaagcttgttaagatagttaagcgtgcataagntgcccgcccaatcgaa

SEQ ID NO: 520339 - DNA, 2394 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagccatcaatttcaactttggctatgccaaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcataggtagttagcacgcaggacgctagactgataccaggtcgactagaatggttgcatctatctcgagctacagactatcacacattggcctctgttgactccagtcgatgcacattcactcgagctgcacttgctagcacccaaggagattccatgagccccggacgctctatgccatactatcctggggggctttagcacaatttctaacgtgggcaccggtccttaatttgcacctgcttgcacgctgcgagcaggttaattgggcacgctcttcaatacgccgtggctacctaatggaccttgatatagtgcgtacttaacgcaagggtagatgaattcccttcccaagggttcgctaagcccatgcgctagggtggaccttgtttagccgaaggtaccagttgcggagaaattagaaataccgcaagcacgagggcttcgttttctcaacaaacattcaacctgaggtaccgccgtgagctgcaacacgggcagaagagggcattttcccccattacctttgacagtgagccggatcaaggctaaagagtttctcccaagagtaggccccccaatggagcatggggagaagtcttagaacatcggataggggagcagcaataaagtccagcataattgggaagagccgcacgcaatacttttagctaagcaacagcgcctttggtcagtgccgttagaatggatcagcttaaaaatagaccaacaggtgacacccttcggtaagggcccacatcgagattggggggatttggggagtgtccacta

SEQ ID NO: 520340 - DNA, 264 bp, Homo sapiens
ttccccccgggggggggttttttaaattttcccccggggtggccggttgggttcccccccccccccggggggggccccaaaaagaccaaaaacttttttttggggttttgaaccaaaaggcttttttggggggccgggggtttaaaaaaattggtttttggttttttccccccccccccccggtttccccccaaaggaattgggaaaaataaagggatttttgaaaagttttttcccaaggaaaatttaaggggccccttttta

SEQ ID NO: 520341 - DNA, 286 bp, Homo sapiens
agtacggaatgaggatcttatagaccttcagtaacaaggtgggtagataatttctttatggccagtttttacacagaaaagcagaagaaaaattagagtaatattttcagattttatggctggctatggggaaaaggaatagtggtttctataacccacgttggagaacagggcatctagtttcttatagctagcctcaggggaaaatgagactgagaggctgacaggtcagcaagatgcagaggaaacaattttcacttctagaggttgttttttttttgttttt

SEQ ID NO: 520342 - DNA, 177 bp, Homo sapiens
tatgaggtagggaggacaggtgagtctcagtttggtcctgggccgggtgactcagcgggctgggagctgggagccgtggtgtgagaagccagagctgtgtgtcccctcgcttccctgagaccaccctagtgccgctgttcgggaactcgcgccttggtccagttccactatcaccaa

SEQ ID NO: 520343 - DNA, 199 bp, Homo sapiens
agatgcccctcggaaccacccccttctctttgtatccatcagaataaccaaaagcatttcaacgtgttaccattaactccatccagtgtagactccagaaacaaaaatcaacacaaatctttcttttttagatttaaacagatataacaaacaaattctgagggcagagtattccattatggccaggtgtcatgtccaa

SEQ ID NO: 520344 - DNA, 262 bp, Homo sapiens
  misc_feature (34)..(34): n is a, c, g, or t
  misc_feature (93)..(93): n is a, c, g, or t
gggggggggaaaaagggatttggcccccgggaanggtttagcttttttttttcccgcgccccccggggaatccccccccccctggggtttttnccccccggaaagggaggggggggcccccccccccgggggggggccgggtttccggggttttttttttacccccgggggggggacccggcccccttttgttttttttgccccctttaccttttgggccccccaaattttttttttttaaaatttttgggggttttttggg

SEQ ID NO: 520345 - DNA, 918 bp, Homo sapiens
  misc_feature (7)..(7): n is a, c, g, or t
  misc_feature (191)..(191): n is a, c, g, or t
  misc_feature (793)..(793): n is a, c, g, or t
  misc_feature (832)..(832): n is a, c, g, or t
ccccacncctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctntgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactagaactgggaggagaataacccagatcttaaggaccccaaagtcaggatgttgtttgatcttatcaaacatctagttccctacttgatgggagaaacctaatgaaatacctgaaacatatattggcatttatcaatggctcaaatcttcatttatctctggccttaaccctggctcctgaggctgcggccagcagagcccaggccagggctctgttcttgccccacctgcttgatcctcaaatgtggagggaggtaggcactgcctcagtcttcatccaaacacctttccctttgccctgagacctcagaattttccctttaacccaagaccctgccttttccactccccccttttccagggacccttagatcacatcactccccccctgccaggccccaggttaggaatagtggtgggaggaaggggaaagggntgggcctccccgctcccagcaactgaaaggacaaccctntttggagcccccccctgaaaggggtgcaggcatgggctgtacccaagctgatttttcatttggtcaataaagctgtttagccccga

SEQ ID NO: 520346 - DNA, 657 bp, Homo sapiens
ctggagatagtctgagagcacgagtgatctctcggatcgcattgtgtggcacagttgtcttgcaagtaccaggccgatgcagtgctgtgaatgtgggggttagggacagccgggtgtggtgaagggatgcagagggatgctggtcaccaggccatgggtgggagagtccaccctcgtgaaggaatcagcaagtggggccaaggaagccgaaggggacggtgggctgggcagggtacatatctgtgccccatgctactcatgcgactgagcattgcctttccatatagctgtatcctaatggccctgatcctgtttgcatcttctcctttccaagaatttaccgcaggggggacccagaatctcccccagttgtgaggagagacgcctccattgaaggaagtagaagagaccatgcctgctccattctctaagacagtggtgaagggctccctctgattgcttcctggaagaggacatgtccgtctccacagaggaagggggtatccagggggcaaagcttcaatctctagctcaaagagcttgagacacagggctttcttcctccagtgtcagctcctcaggctgttctccattgctttcagcatctatgcggcagggggcaggggttctctgacagtaacgatggtgcactatgcg

SEQ ID NO: 520347 - DNA, 554 bp, Homo sapiens
tagcgaatctaaatcggaaggtagcacacagacatatgccagccaatccagctcagaaggcagcactcagacatatgccagccaaaccagatcagaaagcagcagtcaagctgatactagcaagtaagtgaattagggggcattttttttatataataagtatatgttaaaaattgagatgaacaaattgataattaacaattacttgctaactattaactgagtagccacaattagtaaagtactgtaccttaaaacaacctatttgctgatctagtaacttgcgagtatttgtctaaataagacaatatcttctttcctgcagtttagttaatatgtgttgggagtttatttttgggaaacaaaggaaaacatttttggtgaaatgtttaaggagctaattcataaaaaggatctttttgtattctttttcttggagtacaccaaggggaagtttacttttttatttggagatggcacaactagaaactaatatgtatgctgatgaataactgagtgaatgctcgcatagatcacctgggaagaatttgttg

SEQ ID NO: 520348 - DNA, 246 bp, Homo sapiens
cacgaggggtgtcacctcaacatgacgtccttgcgctccggtccacaaggtgctcacacaaaatgagggaatgaacggtatcccattgcccccacccaagcaggagctggtcctggtgccaaccccatccatgctagcctcccgattaaaggcatggtttccaaatgttgagtgtgagcatcatcccccaaggtaaggaagccacagaaccatcatgccctgttggggaggcttcccacagctgct

SEQ ID NO: 520349 - DNA, 426 bp, Homo sapiens
cgcacacccgcacacttacataaacgtatactaggcagctgtaacagagcttactcctcattttttctttcttttttgaaatggagtttcgctctcgtcatccaggctggagcgcaatggcacaatcttggctcactacaacctccgcctgctgggttcaagtgattctcctgcctcggcctcccaagtagctgggattacaggcacctgccaccacgcccggctaatttttgtatttttaatggagatggggttccgccatgttggccaggctggtctcgaactccggacctcaggtgatccatccatcttggcctcccaaagtgctgggattacaggaactcctgacctcaggtgatccacccatcttggcctcccaaagtgctggaattacaggcatgagccaccgcgcccagcctactcctc

SEQ ID NO: 520350 - DNA, 197 bp, Homo sapiens
agactgcatagaggtgggaaggctattttgaggaatatgtctgcttaagggaagagggactgcgtggccttcgtgagaccctgccggaaaggcctctacctatctagtgaaaatgtctacttagactaagagtgattttagtttttgtgactcggggcatgtagagtaaagctaatttgccagtcctgggcgggggc

SEQ ID NO: 520351 - DNA, 669 bp, Homo sapiens
  misc_feature (23)..(24): n is a, c, g, or t
  misc_feature (26)..(26): n is a, c, g, or t
  misc_feature (160)..(160): n is a, c, g, or t
  misc_feature (165)..(165): n is a, c, g, or t
  misc_feature (173)..(173): n is a, c, g, or t
  misc_feature (178)..(178): n is a, c, g, or t
  misc_feature (188)..(188): n is a, c, g, or t
  misc_feature (203)..(203): n is a, c, g, or t
  misc_feature (209)..(209): n is a, c, g, or t
  misc_feature (226)..(226): n is a, c, g, or t
  misc_feature (228)..(228): n is a, c, g, or t
  misc_feature (244)..(244): n is a, c, g, or t
  misc_feature (276)..(276): n is a, c, g, or t
  misc_feature (288)..(289): n is a, c, g, or t
  misc_feature (303)..(304): n is a, c, g, or t
  misc_feature (323)..(323): n is a, c, g, or t
  misc_feature (325)..(325): n is a, c, g, or t
  misc_feature (344)..(345): n is a, c, g, or t
  misc_feature (365)..(367): n is a, c, g, or t
  misc_feature (371)..(371): n is a, c, g, or t
  misc_feature (374)..(375): n is a, c, g, or t
  misc_feature (378)..(378): n is a, c, g, or t
  misc_feature (381)..(381): n is a, c, g, or t
  misc_feature (386)..(386): n is a, c, g, or t
  misc_feature (400)..(400): n is a, c, g, or t
  misc_feature (421)..(421): n is a, c, g, or t
  misc_feature (441)..(442): n is a, c, g, or t
  misc_feature (453)..(454): n is a, c, g, or t
  misc_feature (462)..(462): n is a, c, g, or t
  misc_feature (467)..(467): n is a, c, g, or t
  misc_feature (469)..(469): n is a, c, g, or t
  misc_feature (477)..(477): n is a, c, g, or t
  misc_feature (492)..(492): n is a, c, g, or t
  misc_feature (500)..(500): n is a, c, g, or t
  misc_feature (512)..(512): n is a, c, g, or t
  misc_feature (541)..(541): n is a, c, g, or t
  misc_feature (591)..(591): n is a, c, g, or t
  misc_feature (639)..(639): n is a, c, g, or t
tgggactagtttctttttttctnntnactgaaatgccaacttcagcccagggttttttcacaaccaaactaaaaatgacttactacatgggaacatcaatgcaacaagtagaatttgtaaactcaagccacaaacttagttaataatcatggttaagggncattnccaaagancaacngatgcctcantgaagtttgaaaganactctnctttctgtgacggcagngnagaaatatgcaagcgnttctgcttcaaagaaatttgcatagaaatggnaaaaagccagannctttaacacaagtnnaattgcaaagcctcaacangntcaactcaatccacagggnnccaaatgtttaatgggggcnnnggtnggnntgngcnttgancttccagctatgcnactcgcggggcacaatttcangtgtgggaccatctgtgggnnagctcttttannaacatggnttttngncaccgtanattctaatgcgggcncttttgcnttactgtttgantttcagaggggcacacaaggcaccagagntcttttcaaagttcacctcacaggcaacaatttgcattttttttcccagnccttgggtagccccttttcagttggtctaggcctctgcactgtggggncaccactggacattaaaatccagtcatggg

SEQ ID NO: 520352 - DNA, 703 bp, Homo sapiens
tatagtctgatatcaatatctgtatgtgtaactaatagtgatttacgtgaatctctactggattttgcgcagttcaatgacagtctagtagagtcagtactatgaagagagagatttagttctcgtacgatgagacaacagagtattagcattagatatgttgagagagatatgaaacccaatgaagcagtgtgttggtgagacttgtttttggtactagcctgtccttcagtagcttatctgactaaaggactcatgatgaagtaaatgtagttgagaccttctattctaaagcacagtgttgatttctccgcctcaaactttagtgtgataatttgggatgaggaaagttaggttggatttcatattgctctcagtgtatttagggagatactctattgtctcaggtagagtctgacagacttgtactgtaaggggccgcatggtaaatgttgtaagtcttgtgggctatgcattctctgttgtacctgctactcagctttgctgtcgtagtgaaacgggcagacataggcagtgtgtaagcagatggatgtggctacggttcaatgaaaatttgacaataaacaggcagtagccaggatatggctgttggggccatagtttaccaactactatcctgagcttcagtgttgctgttcagatgtttgaagtatcgttgaccaggtatgtagtataaaatgaa

SEQ ID NO: 520353 - DNA, 148 bp, Homo sapiens
gccccggctcacttcagttcggctcataagtatttaactctcacacctagataacatattaagatttgaaaccagatatatatgaagcgcacgaagtcttatctgttaagtatcattcccctctcaacaagaaaaaaaacaaaacaca

SEQ ID NO: 520354 - DNA, 206 bp, Homo sapiens
ggaggtatgggtacggttcctgatggcgagtggagacgggtgtgctcaaacccggtatggggtcagcttgctccagtcaacgttacaacggaagtaaaatctgtcgaaagtgcaccagtgaagcttggacgtgaagctcttccggggagacaatggtgggcttcaagtgtcaacgaatgtgtcgtgtcaagggatgttcgtcggtg

SEQ ID NO: 520355 - DNA, 1018 bp, Homo sapiens
atcccagcaccttgggaggcctagatgggaggatcacttgagctcaggagttcaagaccagcctggacaacatggtgaaaccccatctccactaaaaacacaaaaaaattaccagggcatggtggctcgtgcccgtagtctcagctacttgggaggctgaggcaggagaaccgcccgaacctgggtgacagagcgggactccgctctcgaaatacacaaacaaacaaacaaacacactaagtggtgggattacaggcgtgagccactgagcccaaccagtcccttcaattttacatcgactggaataatggctcatacttccactggatactggactacgacacactggaaccgctccagtccactctcggtcaagtccgcactggactgctccgggcatcaggcatcacaaccacatgggccgccctactcccatcgaccttaccatggtaggaatacatcggcaccccggctattcggacgctcgctgcaccctgccacacctctaccccagccctaccctacctctgtgcacatcattcatccctcaccgacacctgggacactctcgccacaacggagccactccatcgccgtaaacccatcctcaaaatcaatatcccaacccccccatgcacgcccacgccaccattagggcttaaccccctgcgccatccccaacccaagcctgcgagaacacccacaaactcacgcgaacttccccctcttctacccaccacactccagacggcgaacttgacaccggcgccccttcccgcatccacaattccataccgtcagccaccccttttcaactctctacgccccgcaagccagtccactttagtggacgttgccccaccgcgcgcccccctcccacgcgaccatacctaagtgtccaccctaccacttatagggacgatctcatgtaacacgcgagcgtgcacccacatcttccacaacttgtgcaggctctccagactacactttcggggacacaccatccacacccgcctca

SEQ ID NO: 520356 - DNA, 244 bp, Homo sapiens
cttgtatcagcacgctggagtcctgaggctggggcagttacaaggtcaggagttcgagaccagcctgacgaccaacatggtgaaacctcgtccctactaaaaatacaaaaattagccaggcctggtggcacgcgcctgtaatcccagttacacagaagactgaggcaggagaatcgcttgaacgcaggaggcagaggttgcgggagctgagatcgcgccattgcactccagcgtgctgatacaa

SEQ ID NO: 520357 - DNA, 127 bp, Homo sapiens
tcgatacgacttttcttccttcttttctcttattctttctttctcacttccttgctttctttccttttttctcccgtcctccctccctccttttcttccttcctccctcccttctgtcgtcttctcg

SEQ ID NO: 520358 - DNA, 174 bp, Homo sapiens
acgcatttatagccttgaggatattaagtttgaagtaatactgttaggttagcaataggtttacgatgtatcactatcatgcatgctaccattgataggtactgcagctcttcgagtacatttctgagtcatatcaatgatagttcatccctattttgaccccatgagaaatgc

SEQ ID NO: 520359 - DNA, 306 bp, Homo sapiens
tttccggaattggtcccctttagttttttttagtccagaacctgagtggttttggcaccttcttttttcctctaatgaacttaaggtttgttggtttttcccctttaaggatttttcccccctaggcccttaaggataggttttcccgccccccgaataaggttaagtccccccaaatgggctgtggtttttttttaaaaactttacccctttttttttccccccatttccccaaaaaaacttaaaaaaccaaaacttttggcccgggggttaattccccctttaaattaatgttttttaaaggga

SEQ ID NO: 520360 - DNA, 2350 bp, Homo sapiens
gcaacatggtgaaaccccatctctactaaaaatacaaaagttagctggccatggtggcacacgcttgtagtttcagctactgggaagctgaggcaggagaaacccaggaggtggaggctgcagtgagccaagatggtgcaagataatcaagactccatctcaaaaaaaaagaaaattctgacatgagagtgctctgtgaatatcctagtttgataaacaggattgtggggctgatggatgatgtgggagttcacagatggtgcaactttcctaggccaacaatggcatctgttttctgcgttttgatgacaccaaccctgagaaggaggaagcaaagttcttcacggccatctgtgacatggtagcctggctaggctacacaccttacaaagtcacatatgcgtctgactattttgaccagctatatgcgtgggctgtggagctcatccgcaggggtctggcttatgtgtgccaccagcgaggagaggagctcaaaggccataatactctgccttcaccctggagagaccgtcccatggaggagtcactgctgctctttgaggcaatgcgcaagggcaagttttcagagggcgaggccacactacggatgaagctggtgatggaggatggcaagatggaccctgtagcctatcgagtcaagtatacaccacaccaccgcacaggggacaaatggtgcatctatcccacctacgactacacacactgcctctgtgactccatcgagcacatcactcactcactctgcaccaaggaattccaggcccgacgctcttcctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520361 - DNA, 1582 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtcattgtgaccccagagcagattgaggaggctgtggaggctgctattaacaggcaccggccccagctcctggtggaacgttaccatttcaacatggggctgctgatgggagaggctcgggctgtgctgaagtgggcagatggcaaaatgatcaagaatgaagtggacatgcaggtcctccaccttctgggccccaagttggaggctgatctggagaagaagttcaaggtggcaaaagctcggctagaagaaacagaccggaggacggcaaaggatgtggtggagaatggcgagactgctgaccagaccctgtctctgatggagcagctccggggggaggcccttaagttccacaagcctggtgagaactacaagaccccaggctatgtggtcactcccacacaccatgaatctactaaagcagcacctggagattactggtgggcaggtacgtacccggttcccgccagaacccaatggaatcctgcatattggacatgccaaagttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctc

SEQ ID NO: 520362 - DNA, 597 bp, Homo sapiens
cccactcctatagatcagtgtattacaaaagctggtttcccaagaccgtcacacaaaaccatacaaaaggcggggcacagtggctcagacacaacattattaagaaaaatcaggaaaaaacaatttgaggccaggcgcagtagctcacgcctgtaattccagaactctgggaggccaaggcaggtggatcacctaaggtcaggaattcaagaccagcctcgccaacatggcgaaaccctgtctctactaaaaatataaaaattagccgggcatggtggtgagcacctgtgatcccagttactggggaggctaaggcagagagttgcttgaacccgggaggtggaggttgtggtgagctgagatcgcaccactgcagtccagcttgggcaacagagcaagactccgtctcaaaaaagaaaaaaaaatactgatctataggagtggtgcaccactcctatagatcagtctcctatagatcagttggttggaggtgtgcagctgtatctctaagttctctattctcttccagtggtctacatgtctatttttgtactagtaccatgctgttttggttgctactgatctataggagtggtg

SEQ ID NO: 520363 - DNA, 582 bp, Homo sapiens
tgcggtggctcacacctataatcccaacacttggggaggccgaagcaggaggatcacttaaggtcaggaattggagaccagcctgctaacatggcaaaaccactgtaatcccagctactgggggaggctgggcacaagaatggctgtgagcccaggaggcagaggtggcagtgactgtgagatcgcatcattatactccagcctggtgacagagggagaccctggtctcaaaaaaaattccccttaaacgtagaattaccctatgttccaccaatgccattctaggtatttatccaaaagaaatgaacatcactgggtgcagtgtgctcatgcctgtaatcccagcacttgtgggaggccgaagcaggcagaccacctgaggtcaggagttcgaaccagcctggcaacatggtgaaacccaatctctactaaaaataccaaagttagctaggcgtggtgtatatgcctgtaatcccagctacttgaaaggtgaggcagaatgtttgtgagccaggaggcagaggttacagtgaactgagatggtgccatgtgcattcggcctgggcaacaaagagcgaaatc

SEQ ID NO: 520364 - DNA, 1933 bp, Homo sapiens
agcggagaatagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagctacttctggctttgcaatgcactggacgtctattgccctgtgcagtgggagtatggccgcctcaacctgcactatgctgttgtctctaagaggaagatcctccagcttgtagcaactggtgctgtgcgggactgggatgacccacggctctttacactcacggccctgcgacggcggggcttcccacctgaggccatcaacaacttctgtgcccgggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaagtccttggacatccaggtgcccaacttcccagctgatgagaccaaaggcttccatcaggttccctttgcacccattgtcttcattgagaggactgacttcaaggaggagccagagccaggatttaagcgcctggcttggggccagcctgtgggcctgaggcatacaggctacgtcattgagctgcagcatgttgtcaagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctggcatcactacacgtggtggatgcagcattagtggactgctctgtggccctggcaaaacccttcgacaagttccagtttgagcgtcttggatatttctccgtggatccagacagccatcagggaaagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagaaaaaaaaaaaaaaaaaaaaaaaaaaaaaaaaaaaaaaaaaaaaaaaaaaaaagggggggggcgccaaaaaaaatcccccgggggggcccccaagatcatagcggaccacccgacgacttatttgacaacaaagggggcccccataatgagggacgccactaataaaacacgacagagaacgacggccgccgctggtataaccacgacaggcgaggagcacgaggagaaacagcggcaaacgaggggaactatgatggaaaagaccaccatacactacggagggggggagaacacaaataggcgcgcagcgaaacacactaccacaaacaaggaaagaatataaaagagccgccccagacagggaacatcatacatacacacaacaaagaaacaacgaccaaaagaggggggggacgtaaccaaaccgagaagtaaagaggataaggcagggcagaagaaaaaagacggcgcacaacaacgaggaggaccaccaccacagagcaacagatgctccaagcacgggaggg

SEQ ID NO: 520365 - DNA, 1603 bp, Homo sapiens
tacggtttggcgggggaccgggtgggaccctgggccggggtatctggaccccttgtcctactaccgtacacggctacgggtgacgtggtacgagacacgttttttacctcacggacggtggtactgacgtgggtccgtcacggcggacactcgggggtactgccggttcgacacttcctacacacacccgcgggcacggttaccaccgtacgggttctgggtggaccacacacactactgtgtggtgtgtacacacgtcccacggggagacacacgtgggtgtcactactgcgttggtggccctacgagacacacacttgtgtgccgtggtgtgcgacggggtgtgttcacattactcacacatacctggagacgcgaggtctccgcgggcgctaactagacacacacactacgggggcccacacggtgggcgacccttgtgcggcgagatacctacgggacgcgtgtgtgccacacgctcgtgagctcaccatacatcgtctcggcgccacctcccccctaatctccgcgcgcacccggggctcccccacggggggtatctccgacgatgtgcgcacttcccgcgacacccaccgatggcgagcagcacatcacccctcacataccctctaaacgcgatggcccacaaaggggagaacacacacaagatctaaggagacacagagaactgatacacattccaacgcaacgggataaggatacaccctcaacgacgcgccaaacgacacgcaccaaacaccagctcgtataggaacagaacagaagtacacacacacacgcggaccgccacaccatcaaaaaataaaacaggcacaacatcgggtcaaagcacacacaaatacgaacataagaacgaagggcaataacacagagttgcgcacctcaccccctccctctccccacccccctgctctcctgctctcccctatcaccctctgccctcgactcgactcgtacgtcccgccctcacacccgccacgacacactctccgccgaggtgacgcgctgcgcccccacccctcggcttcttcacaggccttcgcccgttccccctgctcgtctccttgccccaccccgcatgtggctctgacccccaccacacccgtccgtgctgtcctacggcttttccccgggtgtaccgacccgtccgacactctacggccccgcgccgcgcctcgccgcggctcctcccctgacgcacaaccaccatcggtctatcgccatcacaacgctcggcctacgcgcgccctagccgccgcttcctcccgctccccgccctcctactccgcccccttgcttccaccgcgcgtcgcccccgccccgccatcgcgttcccgcgcgagcgcgcactatcgcgatcagcccggctcgtctgatctcgcaccaacgacgctccgcgcccgccaatcccggcgacatgcagaacacatacccgccgcgacgacgcgcgcgaaacgcgccggaatccacacgcaatccgagccgtcacgacgacgacgcacgcccgacacgcgctctaccgacacgacaaacaccgcgtctccgcaacgcaccagcgcaccccatccgtcaacctctccca

SEQ ID NO: 520366 - DNA, 233 bp, Homo sapiens
tatccaccacgtaatctgggtcacttttacatgtgtatgatgcgttcactgcagggttacaagcacacaacaagttagctggatacacgtggaagaaacgttactgagaagtacacactgactttatggtgagattagtgcttgggatgaactacagcagaattccagaaactatctggacaccatcagtcatgggtggatggcgaccactctcaaattccaagttcaactga

SEQ ID NO: 520367 - DNA, 600 bp, Homo sapiens
gagggctgtagacaggcacccgctcccctccggcgggacactcttgcagcctcccaggtctttcacagctgcgcttctcagcacgcccaccacccccacctccagattcagtgcctgtctattttgaacaggttctctaggctgggtcaggtctccctcagctccaagttaatggtggtggtggtgagttgtcttcccccagagagggttcaaggcagaggaagtagagccttgcgggatccctgggcacagccctcctgcgcactttagacttacccaagggcgtatactcttgtgggttaaaggaacaggctttcggatcagacagacttggttttcgattctgactgccactcaccagcagagcatcttcacctcttggagcctgcctgccacagtggaggcgagtagcaccagggctgagaggcaggaaggccttcccagagcctcgctgtgcatttgggagggcccgcggtttgattgtgagaccgcacagcagcctttggagggggtatggtttttatcaccccacttcacaggtggggagatggagtccttgggcatgactggctagaggtcccacagccaaatggagagctg

SEQ ID NO: 520368 - DNA, 231 bp, Homo sapiens
cggtccattcgcggcgcgtcgtacatccgtggtatcatcagaggtgatctgccgggcctgcagcgggctgatcaccgtctcgccgttgagatcgcggcgtgattggccagatagacgaagctgcgcgccagctccacgcagctcatgcgcagcgcgcagtagtggaaataggtttgcaggacggtgatcacgtcgttctcgaagttgccgaacgacttcatcaggtaggcg

SEQ ID NO: 520369 - DNA, 476 bp, Homo sapiens
  misc_feature (17)..(17): n is a, c, g, or t
  misc_feature (24)..(24): n is a, c, g, or t
  misc_feature (404)..(404): n is a, c, g, or t
  misc_feature (431)..(431): n is a, c, g, or t
  misc_feature (438)..(438): n is a, c, g, or t
attcggcacagggttgngagaaanaaggagcaggtagaggaatagtcaatgatatatttgtctcacgcccagtaaatcagctctttatataagataaggtgagcatagagtagctacctgtagagatatttaaccttttatctgtagctttctgcttaggaacaaaaggaagggtatcttcttgcatgaaagcgtccagcttattttttttcctttggcatagtaaattgaggcaccaagtttttattttccgttcacatttcttcccctccccttttaaaaaaagtcttcagaaaatggcattttagaagaaaatgcgtctctagtcttggggttttgtctgggtctcttgtggactaagacagtttatttctaggacaggtcccacgtgggttaagaaagcnccattttagcaggttgtaaagtctccnggacccngaagggaaaaaataggtgggagggagagagagagaaac

SEQ ID NO: 520370 - DNA, 205 bp, Homo sapiens
tcatcatatcctaagcctggacatgggctcttgacaagagggctaataaaaacataaaagccgtgagaatatcaggaataaagacattcctttctaagaacagttgacaactttatagccacttaaaatacaagaaataactcacataatagtatgcaatttatgatgcagataatattattagtcaagattttttgtcttctag

SEQ ID NO: 520371 - DNA, 312 bp, Homo sapiens
  misc_feature (73)..(73): n is a, c, g, or t
gaattctggatcctccctctcaccccgtattttagctcttggctcgatgacactccctcaacttctatcttanttctcaatattttcaacatacttatccttcaatatactgatccttcaaacactaaggcctccaattacattaactcatctcctccgatggcctttctttcatccttcctcagccactcactcccatggtcacactctagactttacttgccattaccaaaaactcctttttctcaatttcatgcatctcactttatggccactatattctagtcttcctgttcagtccctcataaacac

SEQ ID NO: 520372 - DNA, 459 bp, Homo sapiens
gtagtaagtgtatggaaagggcgtcccacacagtatgctctgaagtagatgtgaagaaagcatttagtaaaggggttccaaaaaacattttttgaccaagatatctgatccaggatcttatgagattatataatatcaaggtagaaaaattaccaattcttatttagtaggtctggaaggagaataacattttgcatttctggctgggtgtggtggctcacacctgcaatcccagtactttaggaggccgagactggtagatcacttgaggtcaggagttcaagaccagccttgccaacatggtgaaaccccacctctaccaaattagccaggtgtggtgcacacctgttagtcccagctacttgggaagctgaggcaggagaatctcttgaaccagggaggagcgaggttgcagtaagccgagatggcgcccctgaactccagcctgggtgacagagt

SEQ ID NO: 520373 - DNA, 857 bp, Homo sapiens
tacaagagccacaaagacatggaacactatacctattattcggggcatgagctggagtcctaggcacagctctaagcctccttattcgagtccgagctgggccgagccgaggcaaccttctaggtaagcgacactatctgacgaaacgtttatcgtcacagcccatgcatttgtaataatcttcttcatatgtaatacccatcataatcggaggcttggcaactgactagttcccctaataattgtgtgcccccgatatggcgttaccccgcataaaacaacataagcgttctgactcttacctccctctctccatactccgtgctcgcatctgcatatagtggaggccggagcaggaacaggttgaacagtctagcctccattagcagggaactactcgcagcctggagcctccggagacctaagccatcttctccttatacctagcaggtgtctcctctatcttaggggccatcaattgcatcacaacaattgatcagtataaagacccctgccataagcccaataccaaagcccctcttcgtctgatccgtcctaatcacagcagtcctacttctcctatctctcccagtcctagctgctgggaatcactatactactaagagaccgaactcaaaaacacgttcttcgaccccgcggaggaggagacccattctatacagcagctatctgaatgtttcggtcacccggaagtgaatattcttatcctacagggtcggatagtctcccatattgtaatagtacggcgaaaagaccttggttctaggatggcgggaggcagaaaccagggtccaaggtcggggggccccacattttgaggataggctgagaggatt

SEQ ID NO: 520374 - DNA, 224 bp, Homo sapiens
tctctggacagcccttcccctaggtcagtcgctgacccctggcacatcatgtgagcctctctgatcctaaatatctttaggctcgtgtaaggcctctggggtaccgcaggtctctccttcacccttgtaatctggtcgcttgatattcgctctgtcttagccacacacttactgctctattctacttaactcatgacttctatctcatagtccacgcgggtacc

SEQ ID NO: 520375 - DNA, 654 bp, Homo sapiens
  misc_feature (31)..(31): n is a, c, g, or t
cagtgcacaaatttcttgaagagcttagcancaagtcgttatgatagttcaggctcccacgtacggtgccatctcgtgactcatcctttagatcgcgaggtttctcggattcatgaagtcgtcctaaggtaacttccagagaactctgtgcatcttgacaaggtttcaatgatcagttctaaagtactctgatcagcgctagtttcatgttcatgagaccaaacctcatgacaatgcagtatctgggtacactcccaaacggtgtgtatatgtaagtctctatgctgaccatgttcctcgggctgaatctttcaggtagtaccttcgcagactctgtccagtactatgggtcacgttaaagagcatagcttggactcttcatcgccaccccagtgggaatgatcatcccattgatctcatcatctctttgacagaccctctcaagtctcatagcaattggaaataatctgagcgtttcattccccaccatgtcaagatgctccatctgtagctcagtatcataggtgggtggtgccttactgggtagacctgcatcaatttcctactgcagtctctgctggccatcagggtgagtgtccagttcatacatattgaagcacagatcactgctcgtggtttcatagccagcgcaag

SEQ ID NO: 520376 - DNA, 243 bp, Homo sapiens
  misc_feature (33)..(33): n is a, c, g, or t
  misc_feature (40)..(41): n is a, c, g, or t
  misc_feature (59)..(59): n is a, c, g, or t
  misc_feature (62)..(62): n is a, c, g, or t
  misc_feature (80)..(80): n is a, c, g, or t
tacaggatggaagcggagagtatgcggtgggcngagactnngtcactgcactccagccnggncgacagagtgggactctntctcaaaaaaagaaataaattattaggtgtcaacagcggtgttctgaacttaactttgtcctaactatacagatatacaaaatttatgtaatgaaggattatttcgtcggcaaaatacgttaagagggaaacaaaacagagatttccttcctcttaactaagg

SEQ ID NO: 520377 - DNA, 303 bp, Homo sapiens
cgagcctcacttatccaccagcttgaggctcctatgtagagcgattgctgacaagtgtctgtgctacaatcctgatattgcaatggcgcttcttgccatactatgtttacaatcatcatcgtgtggacttgatgaagaactgaaagggggctgtagacagttttgatccaataagttcttacgagagagtactccttcatggctggaggttcacaaagtgccatgctacaggccctgcttgacaaccaggttgcttgtcagaacattcataatgtgtcgcatgttccgctgtcctcggacaga

SEQ ID NO: 520378 - DNA, 404 bp, Homo sapiens
gatgacatcaagacattcgtccagcgtctggttgcgtttcagggtaatcatctgggagcgggggatcatgatgctccgaacgcgttggtctgcgatgtccatcaccccttcgagcatatcgcgcgtatcttcgtcgataaggtcgttctgcccggaatcacggatcagcgccagcagttcgtcacggtttttcggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatccgt

SEQ ID NO: 520379 - DNA, 133 bp, Homo sapiens
cctgaacgccaccgcccccgcacccaccccgccacaaacccctcgaccaacgcacgccacgacccatcccaaacacagcataaagaaaaagcaaaaacagaaaaaagtaaaatatgaaaaaaaaataaagaaa

SEQ ID NO: 520380 - DNA, 354 bp, Homo sapiens
ttgcccccccgccccccaaaaccctggggggtggaacttttcctccccccagccgcctttttttccccccccctaggattggggctttgccggttaggcccattaaagggcccgagggtttcctttttccccggggcactatataaacccaaatttcccatataaaactggtttggggtttggggggggaaatttttgaatatttatttttttttaaaaaacccagatagggccttgggccatggttttttgggaatgcctttccaaaaatccggctttgggggggcctctccccccccccccccattgttaaaaggccttttagggggtttaataaaggggttttttttttta

SEQ ID NO: 520381 - DNA, 338 bp, Homo sapiens
ctgtaacactggcctagagcaggtgcttttctccatgaaaacttccaccttggtagctcagccgacatagacaacacgcaagcgcagtctagacttctgtccttatcttcacacagtgacattcacaccaggtgggccaacagaagagaaggcagaggcgccccatgagctgatgctgcgcagtccttgggggatcatacctcccgtctcactggggacgaaaccaggttctggaggctctaccctgacagacagcttgtcaccggcacttatgggtcctctgggatttcagacaatacccaacttctgtaggttcagaaagtgcttcaaagacattt

SEQ ID NO: 520382 - DNA, 313 bp, Homo sapiens
gccgaattcggcacgagggcacgtgggaaaacagcagtcaccagtgaaatgcactgtggcttgccgttctcaccagttctgcctgacaactgatgttccagaggcccttgagctgtgctccctatattctctccagtcctccagccctagagctgccccttgtccacaccactggtacaaaacattagaggcggagaacagaaaacagcaagagacagtatttcttgttgactgtgtaggtgaaactaaaggctgaggctagtcactagcaaagtttcttggtccttagttcttgtgcttccattgggtcaag

SEQ ID NO: 520383 - DNA, 298 bp, Homo sapiens
gtgatactgaagatctgattctctcttgccacttaataactagtaacaggtttaacataggaactaatttagtctgttcatttgctatgcacatggctggcttcaccagtaaagtgaacgtgtctctcatttagttatctaaatgatctggatagactatccagtctaactacattccaactcagcaggatgttcttcggacgagagtgaagacacaggcattgtagagacacatttcaccttcaaggacctatacttcaagtaggcattagccttctgctaggggtgcaaatcaagg

SEQ ID NO: 520384 - DNA, 218 bp, Homo sapiens
tacccgtggcctggcaggtttcgacggtgctgctgggaaacagggagcgagtgaccggggcaaccagcgcgacgtcatccccgaccttgaacacctgttcgacgtccagcgcggagaagctccaaaagcttttggcccactcgtcaaaggtgttcaagcaatcgcgaaagtcacggaagacgccctcgacgtcgaccgtttccacgttcattggcgtc

SEQ ID NO: 520385 - DNA, 419 bp, Homo sapiens
  misc_feature (1)..(1): n is a, c, g, or t
nggaagcagcagccaatacccagcagacacttactttctatgaactggaccttggcttaaatcatgtggttcggaaatacagtgaacccgatcaggaacatggcaacttccttattacagttcctggagggtcagatatttccaagtggagtgctaatctgctctgagaattatatcacctacaagaactttggtgaccagccagacatccgatgtccaattcccaggagacggaatgacctggatgaccctgaacgaggaatgatttttgtttgctctgccacccataagaccaagtccatgttcttctttctggcccaaacggagcagggagatatctttaagatcactttagagacagatgaagatatggtaaccgagatccgcctcaagtattttgatactgtgcctgttgctgc

SEQ ID NO: 520386 - DNA, 131 bp, Homo sapiens
ccagaggatccccggaagcacacggcaacaacatctgataaaaggtagaaccaagatgccaatacagatctgtttagcttcaaacaccacctcctcccaggctaaatcctttatgttgcagtgtgcttccg

SEQ ID NO: 520387 - DNA, 397 bp, Homo sapiens
tgacggtacccaaagaaatgaagtagaagtgcactaaaaaggtcggaaaagtgtcataacagcatggttggtaatagtcccagacgggaaacaacccaaatgtccattaacagtgaaatgaataaataaactgtggtatattcacatagtaaaacgctgcatagcaatgaaggtttaaaaatgctacagatggtgtggtggctcacgcttgtaatcccagcacttggggaggctgaggcgagtggaacacctgaagtcaggagttcgggaccagcctggccaacgtggtgaaaccccatctctactaaaaatacaaaaattagccaggctgggtggtggacgcctgtaatcacagttacttgggaggctgaggcaggagaatcgcttgaacccagga

SEQ ID NO: 520388 - DNA, 140 bp, Homo sapiens
ttattaaccccacgatcacagcatcacccttctgctatacttatctgcccacttctctcacaaggctggcaaggggtcacacctctgctgttcactagcagtatcccatagcacacagacaatgaacattttcatgagca

SEQ ID NO: 520389 - DNA, 263 bp, Homo sapiens
  misc_feature (76)..(76): n is a, c, g, or t
  misc_feature (172)..(172): n is a, c, g, or t
  misc_feature (196)..(196): n is a, c, g, or t
  misc_feature (215)..(215): n is a, c, g, or t
gcaggcccacgggcaccccagacactggaactccctgcctttgagcccccaactggacccctttcaagaacacccnccgccaccacctcccacatccctgaggttggggactgtttacactcctcccccgagaccaccccccccctggggaagggttgattactgtcccctnccttggaccatcccgggtaggggnggcagcccccagctccccncagtgttgctgtcagtgtagcaaataaagtcatgatattttcctggca

SEQ ID NO: 520390 - DNA, 119 bp, Homo sapiens
tgtcgcgtgcatgtttcacttttaaaaaaggacaaaatggaggacaagaatggtggctcactcctgtaatcttagcactttgggaggccgaggcaggaggatcgggtaccgacgctcga

SEQ ID NO: 520391 - DNA, 287 bp, Homo sapiens
tacccagtcctgttgcagaggttatcccgagacgcttacagagaatggaaccttgactctgatatatgtcattatcgcgaattgagcattacgagacattattcagaacgaatataacatttctgctctagagctcccacagagctacaagcagctgacatataggatgaagcataaaaagctgtataacttcagaatctgggccgtagcggagtatctctagccagggaagctcacactccaagagaggtcacgggctgtcttccctcctttggactgagaaacac

SEQ ID NO: 520392 - DNA, 304 bp, Homo sapiens
  misc_feature (110)..(110): n is a, c, g, or t
agtatttgttgatgctcctctgcatgtttgtgaacagagggatgtcaaaggactgcactccagcctgggcgacagagcgaaactccatctcaaaataaataaataaatanataaataaataaataaataataaagctgtttttttgagacagacagggattgtcagaatgaataaaaaagcaagacttcctatatgctgcctacaagaaacaccgctttaaacataaaggacacaaataggcttaatccttgtttccttggtttaggaaaaaaaattgcagctcactgccagcggttcatttac

SEQ ID NO: 520393 - DNA, 742 bp, Homo sapiens
  misc_feature (2)..(2): n is a, c, g, or t
  misc_feature (20)..(20): n is a, c, g, or t
  misc_feature (42)..(42): n is a, c, g, or t
  misc_feature (67)..(67): n is a, c, g, or t
  misc_feature (118)..(118): n is a, c, g, or t
  misc_feature (151)..(151): n is a, c, g, or t
  misc_feature (213)..(213): n is a, c, g, or t
  misc_feature (220)..(220): n is a, c, g, or t
  misc_feature (225)..(226): n is a, c, g, or t
  misc_feature (233)..(234): n is a, c, g, or t
  misc_feature (255)..(255): n is a, c, g, or t
  misc_feature (261)..(261): n is a, c, g, or t
  misc_feature (282)..(282): n is a, c, g, or t
  misc_feature (294)..(294): n is a, c, g, or t
  misc_feature (296)..(296): n is a, c, g, or t
anactcttagaagaaaatgngtaaatcttcatgaacttgggnttggccagcattctaagatatgacnttcaaaacacaagcagcaaaagaagagaatttggacttcattgaaatttanagcttttgtgctttgaaggataccatcaagaangggaaaagacaccctacagaattggagaaaatattggtgaatcatatctaatacagactcangaaatanctttnnaactggnncaaaggatctgattagacatnttcccnaaatatatcaacatggccaantaagcacatgananagatgcttgacatcattagtcatcagggaaatgcaaagcaacaacacaatgagatatcacttcacacccactaagttggctaaaataaacaagatagtcacaagtgtagaccaagagatcgtaaagagatcggaaaccacagatactgctggtgagactgtcaaatggtgcagacactttaggaaaacagttgcaatttctcaataatgattattcccgagctaagctatacctataaatcctctcctaggtattaaccaagtacatgatcactatgtccaccggaaactgtaactgatctttaacaacatgtcgaataaccataagtggaacggtcacattactcatggtgatgatctgactgagatatttaaaggaattatctcccaatgaggagaactgtactgccacctctaccctcctcataatcccactgggatcacatg

SEQ ID NO: 520394 - DNA, 689 bp, Homo sapiens
  misc_feature (2)..(2): n is a, c, g, or t
  misc_feature (20)..(20): n is a, c, g, or t
  misc_feature (42)..(42): n is a, c, g, or t
  misc_feature (67)..(67): n is a, c, g, or t
  misc_feature (118)..(118): n is a, c, g, or t
  misc_feature (151)..(151): n is a, c, g, or t
  misc_feature (213)..(213): n is a, c, g, or t
  misc_feature (220)..(220): n is a, c, g, or t
  misc_feature (225)..(226): n is a, c, g, or t
  misc_feature (233)..(234): n is a, c, g, or t
  misc_feature (255)..(255): n is a, c, g, or t
  misc_feature (261)..(261): n is a, c, g, or t
  misc_feature (282)..(282): n is a, c, g, or t
  misc_feature (294)..(294): n is a, c, g, or t
  misc_feature (296)..(296): n is a, c, g, or t
anactcttagaagaaaatgngtaaatcttcatgaacttgggnttggccagcattctaagatatgacnttcaaaacacaagcagcaaaagaagagaatttggacttcattgaaatttanagcttttgtgctttgaaggataccatcaagaangggaaaagacaccctacagaattggagaaaatattggtgaatcatatctaatacagactcangaaatanctttnnaactggnncaaaggatctgattagacatnttcccnaaatatatcaacatggccaantaagcacatgananagatgcttgacatcattagtcatcagggaaatgcaaaagcataaaaccaacaattgacgaatactcatctttcaacatgcccaactaaagtttaggcttacgagtaataacagagactagataatcaacgctgtttgaccaatgatgacttgtcagacgagagttggaaaggccaccagaatacctgactggatgacgaactgtcacaatgggtgcaagccatctataggaaaaacaagttgctaatttctcaaaatgaattcaaacacaagagataagccatattaacctaagaaattccgtctcctaaggtatataaaccaagttaaaatgaacaacaaatgtcctcacagaaaactttgtaaataagctctaactgtttgtttccgctgg

SEQ ID NO: 520395 - DNA, 162 bp, Homo sapiens
cctcaaggtcgcaggaagcaacgtgtttactgtcgcatccaaaagaataaaatacctaggagtaaacttacctaaagagacaaaagacctgtactctgaaaactataaggaactgatgaaagcaaccagagatgacacaaatagatgcctgcgaacctatga

SEQ ID NO: 520396 - DNA, 108 bp, Homo sapiens
cggagcccagagactggacagagccagtgagacaggcttgtataggaggggtgaagcccagctgctcatgagcgagtttgagtcagccaagggtgactccgagaaagt

SEQ ID NO: 520397 - DNA, 340 bp, Homo sapiens
ctggagaatattcctgtgaagcccgcaattctgttggatatcgcaggtgtcctgggaaacgaatgcaagtagatgatctcaacataagtggcatcatagcaaccgtagtagttgtggccttagtgatttccgtttgtggccttggggtatgctatgctcaaaggaaaggctacttttcaaaagaaacctccttccagaagagtaatttttcatctaaagccccgccaatgagtgaaaatgatttcaagcccccaaaatcctttataatttaaaggctcccctttaaagataccccaaagcccccgttgttacccaagttattaaactattataaaactca

SEQ ID NO: 520398 - DNA, 835 bp, Homo sapiens
  misc_feature (170)..(170): n is a, c, g, or t
cacgtgcttctttttctgtttaaagcccatgtaattggggaaggcttggatgctctaactgtattctactattatgaaactcaggttttctaaaacaatctcaagtgtgcggcagtgccctgtgagaatagggggccccctcattccccaaacataagaggtatatgctnttcttctttttatctatcccgcgagagatatgtctatctatatcggacactaccccgtatctcattcgacacacagcttttagcatttttaacaatgatgacccaactgtcattctcacagcttagatacacctaatgggactatgtgagccacttaaaagccattaaaaaccaagggttgtggaatctatggctgtgaggggtgccttcagataacaaaagaaaagttcaggtatcagtaggatagaggtagacatgtaatgaatatatccagcagatcttacatcccataaaaaccagtaggtgtgtcgtatacatacggttaggggtaaagtaccaaagaagtttgatacgaaaagcactacagagggaagcatacatctcttgggaataggatttgtccactcccttagagccttaaaagtatacctttaagaacttacttcccgccgctggcctaaagacagaacgccacttagggcctggaaatagttgctatgttccagtgttgctgcgggccataggccacggtgcgcccccccagtctggcagacagccccgttacattttccattgcacccaggcccggtgcccggctaaaacccctaaacccctttcaacatttgccccggggacgtcacttatacagggcctataatccctcc

SEQ ID NO: 520399 - DNA, 851 bp, Homo sapiens
  misc_feature (214)..(214): n is a, c, g, or t
  misc_feature (261)..(261): n is a, c, g, or t
  misc_feature (321)..(321): n is a, c, g, or t
  misc_feature (636)..(636): n is a, c, g, or t
gggcctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagtttncagttgtcggcaacatgaggaatttatctggcttcatgattcctttngttgaaaatgaagactatgcaggttatatcattccaccagcaccaccaagacctgatttngatgcttcaagggaaaaactacagaagcttggtgaaaggacgaacggggtcaatgaccgacaggaaagacttcaccatagatgacccaggaactggcagctgaattattttggcaaatattccaacgaaggacagttgcgactgctgaacgtgttccttgtgtcgtgtggccagcacatcctatttgtgagaagagatttacattcccatgtcttcttggaatataatccaagatttgagtggtgcgaggaaaaaataaaaaagagaaacttgaagacttctttaaaaacatggttaaatcagcagatggagtanccgcccggagtacgggtgtacattgattcctgtgagcagaacgaaattcttgggggatctaacgggtaagggcatcgcgaatctggtgatgcagatccccaaagtggggcgatgctacagagatggccccatttgttcggcccgtctaagtttgcgttccaagcccaacgggcaaaaaatacgcggtctggggccccaccgttaatacaaccagg

SEQ ID NO: 520400 - DNA, 284 bp, Homo sapiens
tagagttgccagaaacttatgcagcagcactgaccatgagagactaggtgggccctcactaatacatttctccctctctctctctctcttttttttttttaatttggtttcagagacaaggttggctcggtctcctaaaacgggagtataggggcacgatcatagctcacagcagacttgaactccggggctcaaaggatccttcctccgtgcctcagccccccaagtattaaatagcggggataccaggtgctgaaggtggagtaaatgcagatgttgagaaa

SEQ ID NO: 520401 - DNA, 880 bp, Homo sapiens
  misc_feature (214)..(214): n is a, c, g, or t
  misc_feature (261)..(261): n is a, c, g, or t
  misc_feature (321)..(321): n is a, c, g, or t
  misc_feature (465)..(465): n is a, c, g, or t
  misc_feature (511)..(511): n is a, c, g, or t
  misc_feature (665)..(665): n is a, c, g, or t
gggcctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagtttncagttgtcggcaacatgaggaatttatctggcttcatgattcctttngttgaaaatgaagactatgcaggttatatcattccaccagcaccaccaagacctgatttngatgcttcaagggaaaaactacagaagcttggtgaaggagaagggtcaatgacgaagggaacgcaaatttccaaccaaaaggaattggaaataccaagggaaacctgggaagctgaatatttggcaatattcaagaagacagtntgcgatgcattgaaagtggttatcccctttttgggttggttccagntggtgggcaagcaacaatcctatttgtgagaagagatttacattcccatgtcttcttggaatataatccaagatttgagtggtgcgaggaaaaaataaaaaagagaaacttgaagacttctttaaaaacatggttaaatcagcagatggagtanccgcccggagtacgggtgtacattgattcctgtgagcagaacgaaattcttgggggatctaacgggtaagggcatcgcgaatctggtgatgcagatccccaaagtggggcgatgctacagagatggccccatttgttcggcccgtctaagtttgcgttccaagcccaacgggcaaaaaatacgcggtctggggccccaccgttaatacaaccagg

SEQ ID NO: 520402 - DNA, 272 bp, Homo sapiens
ttcagcacgctgaggttaaccgacgggtggaaacgcagcccgcccttgtacgggccaatggcgctgctcatctggatgcggtaaccgcgattgacctgcaccttgccctggtcatcgacccaggacacgcggaacagtacagcgcgctcgggctcgaccatgcgctcgaggatgccggattgcaggtagtgagggttggcttcaaggaatggccacagggtgcgcaacacctcttccaccgcctggtggaattccggttggccagggtcacg

SEQ ID NO: 520403 - DNA, 480 bp, Homo sapiens
tctgctgctattctccgagacttcgcaatgccggctaagtgacgacaagaagaagaaggacgctgggaaagtcggccagagaaagacaaagagccagttgaactaatccgggggcaaggccatagaaagaagaagtggtccacaggcaaagttcgggacaagctcaattaacttagtcttgtttgacaagagctacctatgataaactctggtaagggaagttcccatactaggtaaacttataaccccaggctgtggtctctgatgcagacgtgaagattcgatggtctccctggccaggggagcccttcaggagctccttagtaaaggacttatcagactggtttcaaagcacagagctcaagtaattttacgaaccagaaatacctaagggtggagatgctccagctgctgtgtgaagatgcagtgaataggtccaaccagctgtacatttggaaaaataaagactttagttagaat

SEQ ID NO: 520404 - DNA, 322 bp, Homo sapiens
tgctgcaggtcatctaaggatcccgtttggcgtgaggccaacaaatcaagtcgtatacctgaggtgcaccggaggtgaagtcggtgcacttctgccctggccccaagatcggcccctgggtctgtctcaaaaaaaggtgggtgatgacattggccaaggcacgggtgactggaaagggctgaggattacagtgaaactgaccattcagaacagacaggcccagattgaggtggtgctttcttgcctctgccctaatcatcaaagccctcagggaaacaccaaagagacagaaagaaacagaaaaaaattaaacacgtgtgga

SEQ ID NO: 520405 - DNA, 649 bp, Homo sapiens
tgtagtgcatatattaagtagctagatttgttctatccacgatgtatatttactatctaaaccatcatgtatgttacattgacgataatcacagctttgatcctgttagctcagtttttaaacaatgtcaaatattccaactagactctctgttgtagtttttgaaattacaacttggaggctttgaggaactgattagaggtctcttttctgtttcaggctttcatatccaaaccatagatctttagaagtaacatctgttaattaattattaataaatagtttgagtctttattaattcatggataacttgaccattttctctctccttttgcttagataatcccagatcatggccgggcacagttagtcacgcctgtattcccagcagtttgggaggccgaggcaggcagatcacttgaactcaggagtttgagaccagcttgggcaacatggcaaaaccctgtctctattaaaaatacaaaaattagctgggcatggtagtgcatgcctgtagtcccagctacctgggaggctgaggtgggaggatcgcttgagcctgggaggttgaggcttctgtgcgcgatgattgctccagtgatcacgccattgcactccagcctgggtgacagagtgagaccctgtctcc

SEQ ID NO: 520406 - DNA, 571 bp, Homo sapiens
  misc_feature (4)..(4): n is a, c, g, or t
  misc_feature (84)..(84): n is a, c, g, or t
  misc_feature (116)..(116): n is a, c, g, or t
  misc_feature (137)..(137): n is a, c, g, or t
  misc_feature (139)..(139): n is a, c, g, or t
  misc_feature (143)..(145): n is a, c, g, or t
  misc_feature (148)..(148): n is a, c, g, or t
  misc_feature (152)..(152): n is a, c, g, or t
  misc_feature (171)..(171): n is a, c, g, or t
  misc_feature (176)..(176): n is a, c, g, or t
  misc_feature (178)..(178): n is a, c, g, or t
  misc_feature (182)..(182): n is a, c, g, or t
  misc_feature (184)..(184): n is a, c, g, or t
  misc_feature (314)..(314): n is a, c, g, or t
  misc_feature (319)..(319): n is a, c, g, or t
  misc_feature (321)..(321): n is a, c, g, or t
  misc_feature (336)..(336): n is a, c, g, or t
  misc_feature (364)..(364): n is a, c, g, or t
  misc_feature (366)..(366): n is a, c, g, or t
  misc_feature (390)..(390): n is a, c, g, or t
  misc_feature (402)..(402): n is a, c, g, or t
  misc_feature (405)..(405): n is a, c, g, or t
  misc_feature (451)..(451): n is a, c, g, or t
  misc_feature (456)..(456): n is a, c, g, or t
  misc_feature (461)..(461): n is a, c, g, or t
  misc_feature (467)..(467): n is a, c, g, or t
  misc_feature (533)..(533): n is a, c, g, or t
cagncaggtccccacggtggagccgagtgagctgggagggatgggtgcttacttcgtttcaaagagatctacatatctacaganaggatggagaccagaaaggaattgggaaatgnaatcatgagggctgcccctcncncccnnnacncccngcccaccccccacgccaangcatnanaaananacttcacaggatgcacagaggaagccagaggtgtgggcgggcccggggggccggggctgcgagggacctcaagggcgaatgccactggcctgtccaaacgaggcaggagaaaaaataaaaagaggaaaanaattnanaacataacgattttnatttcgtcagccgttcccccgacgcctntngaaactggccatttcgttttttantaagggcaaaangtntcctgctcaagccacccctccgctcagggaaggtcactgcccggcnaagcntcgtnttttanggcggtgccttccctgggcagaaaggggctgccccggccctggggctccatggcagggcacaaaangaaaggtaaaacccaaaaaaggaagggggctcctgggg

SEQ ID NO: 520407 - DNA, 950 bp, Homo sapiens
ggtcaacccaacacagagcatgctcataaggaaaggtttcaaaaaagtaaaaggagactcggcaaatctgaccccgcctgtttaccaacaaagcatcacctctcagcatcagccagtattagatgcgcagcgccggcccagtgacacatgtgtaacggccgcggtaccctaaccgtgccaaaggtagcataatcactggtgccttaaatagggagctgtatgaatggcatccactgagggttcgagctgtctcttacttattaagcacagatgaaagtttgatctgcaccagtgaagaggcgggcatgacacagctaagacgagaaagaccctatggagctttaatccattaatgcaaacagatacctaacaaaaaccacaggatccgtaccatgtagctcgaatagtctcgcacttaaaaaacatcttccgcgttcgcgggcggagccttccagggatggcgaggaacctctaaaatcgtcacgatgctaggtgacatgctataaggatcttcaaccagtgcaaaagacgaactagtatactcaatcgatccactgacttgaccgagcggaacaagttaccctaggggatgacagcgcatatcctagttctagaagtccatactcaatcgaatatgggtctcacggacgctcgatgttggatcagggacatgcccgatggtggcagcgttatgtacatggttcgttagtttcaacgagtacaagtcctacgtgatcctgggtgcagaatcggagtaatccaggtcggttctatctagttcaaaggctccctgtactaaacggcctgagcaataaggcacttcaaaaaggccttccccggaatgtttctctcactgggttatgccaacccccggaaccgttgttagtgggagccggaatccataaataaacttgcagcgtcatcctttaacaccgggaccttcttttgca

SEQ ID NO: 520408 - DNA, 140 bp, Homo sapiens
  misc_feature (135)..(135): n is a, c, g, or t
gatactgcaacttgaattctgggttatagtaatcctcccacctcggctccccagcagctgagactacaggtgcacatctcaatgcctaggtaatttttaaattttttgtagagatggagtcttgtctatgttacnccagc

SEQ ID NO: 520409 - DNA, 1079 bp, Homo sapiens
  misc_feature (405)..(405): n is a, c, g, or t
  misc_feature (408)..(408): n is a, c, g, or t
tctacccagtattttcctgtttcctgtccatgtcatatgtagcactagatttacatatttatacatatctgttgggtatataattgaaagtagaattgctgagataaaaatgcatgcttaattatgattaacttcttgactttttttttcttaatttttaatttttttaagttttatttatttattatatttattttattttttttggaaacagaattttgcccttgttggccaggcaggagtgcaatggcatgatcttggctcactgcatcatccaactcccaggttcaagcgatggctcacgcctgtaatcccagcactttgggaggccaaggcgggtggatgttctgaggtcaggagttcaagaccagcctgaccaacatggtgaatccctgtctctactanaantacaaaattggtggacatggtggtgcatgcttgtaatcccagctactggggaggctgaggcaggactttaaatttttttgaagtgtattttcttaatttccaaaattaaagatattttagttacattttttaaatttcccttacttctactaaggctggatcatatattctttatgatattgaatcttttcaaatttactgagtcttgatttatgtcccaccacatgtcacttcaaataattattaacaattcaatatgctctaagaaaatgtcttttagttgatatatatgatacatatatatatgcatgcgtgtgtgtgtatcgtgttacaagtttccattcgttaactgtgttcttctaatgttctatggcattactcattatttgctcctctttttaaagtttgtttagatttaatggaagtatctgtgtatttacatttaaataaaccaccttattttatatttcttttatattggtccaacctgttttattgtacaacctgttttaaaagtattcctttaggtgatggctgtcttacatgaaaacattattgatagtagttataaatgctgaactgatggtagctggagtgggtagacattttgcatgttgtatcctttggagtataaataaatcaattattaaaaatttaacttattaaaatta

SEQ ID NO: 520410 - DNA, 174 bp, Homo sapiens
cgtctgtggggtgatggttgctctaaggtctgggtagcctgcgtagtgccccaccatggtctcgtgtaggatggtggctttagacctcaagctcaggaacaggccggctctcctgaacctctgcttctcacttgcggagtgctccacgccgcagtctgccaggggccttgcgtg

SEQ ID NO: 520411 - DNA, 364 bp, Homo sapiens
ctctcgtactctagagatcacgaacattgtggtctatagtcatagatattgatagtatgctgggatggcgctaatgaacccaaccaatttccgaggtgagaccactcgaaccccacagtgccactggggagccagccagtgtgccagagcagccacaaaagaaactccggggaataatcaaatcggaacatgttgtcatcatcttccacatagttctcattcaggagggtgtacagttcttatagcacaccacgatcgcccagtgccaaagcatcccaggtgaagcccctgggccagggttgtaagggcttcctggcggaatatagtcctatgtcaggctccacggggccatggggtgtcacca

SEQ ID NO: 520412 - DNA, 651 bp, Homo sapiens
  misc_feature (52)..(52): n is a, c, g, or t
  misc_feature (70)..(70): n is a, c, g, or t
  misc_feature (119)..(119): n is a, c, g, or t
  misc_feature (168)..(169): n is a, c, g, or t
  misc_feature (172)..(173): n is a, c, g, or t
  misc_feature (181)..(182): n is a, c, g, or t
agttaggagggaaaaaccgaattagcttaaaacctgtgtgcatttaagagtnactaatgttggtaacttntatgccttcactttacaaattcaagccttagataaaagaaccgagcaantttctgctaaaaagtccttgatttagcactatttacatacagccatacnnacnnagctattnncgtgaagtggaggacctattatgagcttgaatttattgttatatcatctttcacttatacgtttaactgtctggttgcgtttctagtcaccctcttctaaatcttcttaaatgtatttgtctacgcaattcttggggctaagaactttttttattgacgtactacttatctctcttgacagtttctacgcgggtcaacttatgcctttctttttaattgaaacatcgttgaaagtctcatactgattgggcatactggcaaaaccaaagagaccaactacagaagaaagaacaaaagacccaccgacaacaaaaggcgagggaagcgagcacgaacctactaaaaagaattcaccaaccgcaagggagcacaccaagacgattagcccgaggcaacgacagcagacacacgtgagaaaacaaagcggggcccaccccaaagaggacgcacgacaaaaaaacagcaaagg

SEQ ID NO: 520413 - DNA, 992 bp, Homo sapiens
  misc_feature (22)..(22): n is a, c, g, or t
gggagggcggtgctccgcgggncggtggaggttgcgtatcgcttcgcagaatctactcaggcatgcagctgagaatgagttgagggaaagtgctggtagctagggctctgcaatacgccaaggataacgtgcagccgaaaataatgatatcgcccacctatctagcttcagtgtgaagatggccacgttgcaagatgcttgctgcctcgctactttgcctaggagtacgttcattcatgctaagagctcagacgttcattgtcgtgttaaggaggatattatcaagcgtccattgtctaacaacagctagttcatgctcagtccgttaatcgttggtggttggaccatctgcattacactacgtacatcccactagattgatttgagcaggattgcgatggcagcggcggtgtacagtcacatttggtgcataatcggctattgccgtgattttgtcgccgactcgggagcgcccttaatgtgtaaccgttagaagacttgcctgatagccaattccacagccggctcgcttaaccactaaacaacggccgtgatgacggtgacgaggaaacagcaaggttttgctaaggtcttattaataatgcattttcaaggtcatgacgtaacataacggtacttgagagcgtatttgctgatattgtactttggggatggaaaccaatcaacctctctgagttccaagcactgtcaatctccccgttctccagactttgccagctcctttaagatttgtcctgtgacagcagccccgagcgttgtgtcctggtcacccctgtccgaagaacctttctactgctgagctgtgggcaaaggtcaagcctgtgttgccagtgcgggccaagactgggccaagctggaggctggctgctgaagcaggctcaccggggcaaggaccggcccttcgttgtcaggggcactacctcactggtgggggtcatgccccggaggaggcttgacccaaccacaaaacg

SEQ ID NO: 520414 - DNA, 2720 bp, Homo sapiens
cgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagccttcatgtggttctcagacattaccaaacataagcaaacccatactggagagaaaccctacaaatgtgacgaatgtggcaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatggaaaaataagcaaaatccaatttaagtaaacaatggaggatttgaaggagaaaggaatagagcacggacacgttcagaaatgacactgaatccctgtgttgagtctacagagacatctagacttaaaatagatcatttatatttaagtttaaaaggaggatgagactgagtttttgtagagttataattacattcaaaatatacttttttgcattgaaaaaatgttaaatttttgaaaagcgaatattgatgtcattctattctcaaatcagtagatgctgtgtcttcatttctagtgctgatgtgaaaacacatggtcagttgttgctgcgtcagagatatgagaaattcttttctcttaggtgtgcatcactgatatacttgtccgtgaaaggtgaaagacactgaaatgtaagatgcgtgagtaaaatcttggtagagagaaaa

SEQ ID NO: 520415 - DNA, 638 bp, Homo sapiens
tgcaaaaaactcgtttgagaaatcactttcattccgttagatagaaagattattgactatcatctatctagcccagcatgtagccactgctgatttcacatatttattacatgcctcctaagtgctaggcgctactctagatgatgtgactataccataacataagactgacttggacatactaacctatatcaatcagccagcacatatgttcacatggtgacaactgctatgctcagaattagaatgaatgatgtcatcatcagtgactgggtatctagattgtacggccagaaatgccctctctaaaatgatggcatttagcatgggctctggctagcaagcaggagccgaccatacacagagtggtatcagtgcactccagtgtcccagtgggcccgataatggatgtaagcattaatgcaaacttatgctgttgtagagacagaggacgtgtgcacctgcagcatagtagggtagcagatagacagtacgcagtggtcttagacaggcgtccacaactgcttcatgcagagctgggtgtgatggttcacccctacaatccaagccctttggaaagccaaggtggtcgaatagcttcagtctcggagttcctaaagccgaattcctgcagcccg

SEQ ID NO: 520416 - DNA, 204 bp, Homo sapiens
ctggatacacacgtgtgctacatacctgggtattttgcattctcagtggagagggagtttcaccatgttggccaggttggtcttgaactcctgacctcaggtgatcctcctgcctcggcctcccaaagtgctgggattacaggcattagccaccgtgctcagccgcaaaattctttatgaattttacacttgtgggcgctcgtg

SEQ ID NO: 520417 - DNA, 226 bp, Homo sapiens
ccaggactggaagaaagcacaagtctcgtgtgccagggcagcgagggcgccgtcggccacggagggggccctctgccaggactccggccccgcgccgaccgtgtgcagcaccaccgtgccagggaccgggccatggaggccaggaagacagcgaggcgccgagacagcgcatccggtgacgcagccaaggcagaggccaagaaagagacagaaccggctgcggccg

SEQ ID NO: 520418 - DNA, 332 bp, Homo sapiens
  misc_feature (24)..(24): n is a, c, g, or t
  misc_feature (28)..(28): n is a, c, g, or t
  misc_feature (46)..(46): n is a, c, g, or t
  misc_feature (51)..(51): n is a, c, g, or t
  misc_feature (59)..(59): n is a, c, g, or t
  misc_feature (74)..(74): n is a, c, g, or t
ccgtgtcccctcccccagtaaagncacnaaaagaggactgtcgacngccgnaaattagntttaccctatgtccntaaaattttaacaattgaattacctcagtatgtactcttttgtcttcctttctctcaataaagtgccctatgagattcatcctaccttgttcccatgtgtcagtagttcataatttttattgttgtctagtatccccttgtatcaatgcactacaatttatttatccattctcctattgagggacatttgtgttgtttccagttgttggatatatgcattgtcaatctcttcaatcagtctgtggcttgtcttttcac

SEQ ID NO: 520419 - DNA, 193 bp, Homo sapiens
acctagtgccacattaagctcactctgtcttactgaggaggagtaggtagtggacgtgagtcttcctatgggtaggagtaggatttctagctgccacctccagcacataatctcctctgtatatgtctttacctaccctgtgtataggatcccgcaattctatatactataagagttaaataccaatgtacat

SEQ ID NO: 520420 - DNA, 392 bp, Homo sapiens
ttcattacgcacatctgacataggaatgtctccaacatggcagtgcctcactttcctccctcccttaagaccacaccagataaccagactccacaagcacaaatacttgcacccattttctctgtaagggtgggggtgggaccttcaggctgctatctttgccatctgatgttctaacttgtgttttacgctcctcttgatcgcggattgtgtcttttatagatttgatctcttttattgtctcatctgacttgttcttcattttgcccgctgcccgtctctgtggttttcttggggattcttatcaggtcgcacttcttgtttgcggtgtgcttgctatccggaatgttcttcttgcaccagcttgagatccctttattctcctgcctgaa

SEQ ID NO: 520421 - DNA, 139 bp, Homo sapiens
aagtgcagaagggctcttcaacttttctttagacgatatcctctgtgccccaagttagaaaaagagttgcagtgatagtagtcctccttaaacagtcacagactcaatctggaaagagtggcagaaacccctctccccc

SEQ ID NO: 520422 - DNA, 326 bp, Homo sapiens
taagataaacatatgctatcattttttcttctgtgaacctgaaagatatcatttgggtcatagctctgctctgttcagattatgttaactctgagtctgtccaaatgagtatacacttccattctccacatttaaacgcaatcatattttcaatttatactatagtatttcttactattatgaccaagaattttatcggcattaattatttcacgtgtcgcttagttgctccaaatcactgtaatcatcaaaatgatgcatattgtcacactactattaactaggcttcagtatatcagtgtacatttcattgtgttaaatgtata

SEQ ID NO: 520423 - DNA, 101 bp, Homo sapiens
tggtcttactagaggatccccagcgctgcgcaataccatgtatttggggaggaggtccctctactggtcatggagaccagattctcccctcgcagcagcac

SEQ ID NO: 520424 - DNA, 880 bp, Homo sapiens
agccggaggtgcgcggggcggcgcgcgcgcgtgcagtgtcgcagctgtgtgctcgagtgtgctggcagtgtgctggcgggactggctggggatcgccgtggactagcgtcatgtgggctgcctgcattccctgcatcagagccgcgagtgtgaccagactaaatcctgtgcctgtcctgtgccctgcttccatccatctgtggcctgctgccctgtgatccagctgctgggtgcctggctgttgctcccttcgagcgtacatcgtgcaggccaacctgcggagaattacggcggcgctttgactcccgggctcagtgattacacgactgtaccccacgtggttagccccgtgcactagccctagtacggtccgtattcctcgagctcagaaccgtaggcacccgtgagccatttggcgcccttggcctagcatatgaacacgctgtatcatttgggccaccccactaggagctacacgcctggcacagcaagattaagagcacaggagcaagacaagaccaaacaaaagaagaaggataatacatgcacagacgaggaagactaatgcgcacctcacaataaataagacacagagagtagcactgcacagccacactagaactagcccagcaccacatattgcgtcacacatgattcactaaaccgaacaaatacacaccaccaggaagatcagacccaacgactcgacgaaatatgcagacccatcgtgataccaacgacacagtccacaatattctgagaagaatacgcaagacacagcaacaacatgaaatacagaccacttatgggcacaccaccttcacacaagcacccaatagaacactacaggaaacactcaagtacacctagcaaacaatcg

SEQ ID NO: 520425 - DNA, 108 bp, Homo sapiens
agattgcgcgcttggttgatgagcatctgcgcttcgttctgagctggcggatctggttgttgatctgctccagtgtgcgaaccgccgtgagcgtgttctgcactagat

SEQ ID NO: 520426 - DNA, 433 bp, Homo sapiens
tttacaaccccttgatcacactctacattctatgaggtgactacagtcacctactagtattcccaagtacctagcacagtgcctagtacaagatatacattcaatattttcttttttaaaaaaaacattttccccccgggtgcggtggcttcgcgcttgtaatgccagcactttgcggaggccgatggcgggcagatcacgagttctagagatcgagaccatcctgggcgacatggtgtaaccccttttctactatatctacaataattagctgggcgtgctgccgggtgcctgcagtgccagccacttggagattacaggcataagcgacaatgcctggaccccttaaatattttctaaattattaacccaaattggtacttaattactttggatggaactcagaacctcagaagacacaaaaaaattcaag

SEQ ID NO: 520427 - DNA, 146 bp, Homo sapiens
agggtaagtctgaagaggtgtaggtaaatgtaaggagcacctcccggcagatcaacgacatccagttatccagggacatgaccatgtgagtgaccgcgtccaaggacaacacagccaagctttttgactccacaactcttgaacat

SEQ ID NO: 520428 - DNA, 382 bp, Homo sapiens
ctcctgttgggtcacaaggcctggctgtggtggctgacatctgttggtatccctgtcacaggctgaatgtttgtgctcccccaaattcagatgtggaagccccgaccctcagggtggctgtatttggaaatggagcctctaaggaaatagttatggttaagtgaggttctcagggtgggcccctgctctgctaggattagtgtcctcacaggaggagaccccagagagtgcgctgtctccgtcacgtgagctctcggccagaaggcagccgtctgcaatccaagcagggagccctccacggaaatcaaccctgccagcaccttgatcttggccttccagccttaagaactatgagaaaataaatttctgtgtttaagccaaa

SEQ ID NO: 520429 - DNA, 558 bp, Homo sapiens
  misc_feature (82)..(83): n is a, c, g, or t
  misc_feature (270)..(270): n is a, c, g, or t
  misc_feature (325)..(325): n is a, c, g, or t
  misc_feature (332)..(332): n is a, c, g, or t
  misc_feature (385)..(385): n is a, c, g, or t
  misc_feature (436)..(436): n is a, c, g, or t
  misc_feature (458)..(458): n is a, c, g, or t
  misc_feature (483)..(483): n is a, c, g, or t
  misc_feature (490)..(490): n is a, c, g, or t
  misc_feature (544)..(545): n is a, c, g, or t
ctcgttcccggcctgtttggtggccgcgatccttcgggcaaccctcttgatggattcggcgtcggcgaccgaggacccgccnnatttctggacgactcgcgtcatcgctcctcctgcatgtgcggacactgcagtttaacctctcctgacggatgagacgggaaccacctcgcccagcacggatattgacgggcagaatcgtgttctcccacatgggatgttccggcatcgtgagcagtttggccgaactggcctcgagccgtcggccanttcacttacagtgtccccatgagcaccgttggtaggagcattctccatgcctganttctcantgacgtggcagcggggcatacacgccgtcaacggcgatcgcaccggtgacttnttctcatggtcgacggacggatcaccgcccagatcacctgttaacagctgngcccgggccttgtgggtctgantggtggtgctgatccaccccagctnaccgagnacctgcacacatttctcatggaacgtgtgctcaccagctgcgctcggagggctnnaagtgcatgcctc

SEQ ID NO: 520430 - DNA, 319 bp, Homo sapiens
  misc_feature (310)..(310): n is a, c, g, or t
aatgtatcaaaaagcatcacagagattggggctggttcattggaagaggcaggtaggcttttgatgtcaggcttacggggaactgaaaaggatccttctgggacttggctaggtaattagcattttagtgtgcgcatgtgatgatattatccgtaatgaatgtatttcaggccaaatggcggtggccctcacatccaacagctcacatctttgaaaccagtggtaattgatctatgggtattctataagtttctatttatttaggcagcacccatttatttctgtggtatcatctgctgaacgattttgngggtagatg

SEQ ID NO: 520431 - DNA, 237 bp, Homo sapiens
ggtcgactatactaatacctttttttaaaataaattgaattagctccaagtctagtaacattaacaacaagatgctagttcaatttattttaaaaaaaggtattagtataaatgatagaaggtatgtcactatcctaaaatttagaattcatgatagtggatactatttgctatgtattcatattttccaggtaaatcaaggaacggcagctagcatgccttatttcaatgtcgacg

SEQ ID NO: 520432 - DNA, 991 bp, Homo sapiens
gttacacgtatctgaaaactggagggcttcaaggctctcatcggtgctcagtacagcggggctcagtgtccgcgtgctctccagtcaccatcccacttccattgttggtccaaagcaactcgcagccctgaaatttctcacgctaaatttcctgccggcaaggtacccagtgatttagagggtgatgataggattactgtagtgtttgagagcaacggctcgattgcctacttatgatgtagctaatgaagaggagtcgtgcaggggaaggtacttccagtaggcagcaagtccctagagtgtgttgctagctggagtgaagtcttttgcatgactctctcgattatacgctgcccctcagtcctagtaccttggtggtgttccctcgagcattggggcatcatgtgaccacaacaaaacaggcgcgacatgaggaatgccatggaggacggaaggtgagggcgaacttcgttggtgagcttgctaggtatttgcatataactattgcatacgaacggagtgcaacgtatttatcttgcggtgggggcagagaaccggagttggacagtgtgtgcgttgaactagtcgacaagattgttgtcttagcgacgctcctggtttgtgggcatctaagttaatgcgacggttttcatacgtaggccctttcttttccgtcccaagtggcctttattctcgcaaaattatctcaatagcccgcattgggtttttcgcctcctaacgcgtgggctatttaaccaccaaggcacccaaggtttcccggggccgtggatcttgtgcggggggaaacgctgggagataactttgttggttggatgacatggaattcgcggccccaaggtttttcgaattgggtgttagaaagaaaggctcttttgcaatgaagggagcccccaaaatggcttaattacataaagggatgaactaagccacgcgggtgtcacatcggatggacacggggctttccaccgtg

SEQ ID NO: 520433 - DNA, 1108 bp, Homo sapiens
ggagagagacactgtctcaaagaaaaaaagaaagaaattaaaggccagccataggtgtttctttttttctttgagacagtgtctctctctgtcacccaggctagagtgcagtggagcgatctcggctcactgaaacttctgcctcccgggtacaagtgattctcctgcctcaacctcccgagtagttaaaattacaggagtctggctaatttttttttttttttttttcctgaaagggacgcctggcttctggtcgcccaggctggagttgcagtgtgattgcaatcttcggctctaaacgtgaaacctctccgccttcccgggtttcacgtgtgatttccccataccttcagacctcccgaagttagcgtgggactacgggcggcccggccacaaaacccggaactaagttcattcggagatttacagctaaaggggggggttcacaccaatgtggcgctagagagtgcgctctctcgactctcctgtgattcgggtatatccacccggcctcggagctcccaaagctgcgtggagaattacaagcggcatatgtatccacaccagggccacagccaaattccgcgagattacacacgataaacgagcaaggggctacttcacccaatcgatggcgccacggcttgttcctacgaaacgtccctaaacagattcacgagaccgactcttgtgcctcgccctttgggcattcccccaaagtgctgcctgcggcaccatccacggagcccctgcaacactcatacggggacccctggacccagccggggccccccgtcaacaccgcgcacggacaccaccacgcggacataaaggccccccgggccatcaagcgaaccatcccacagtcggcaatccaaccgcgcaccatacaacacggacaggagacacacatcggggcacaaacaccacaacccacgcccaacccccaccaccccgcacacgaacaacaaacgccaccacgaccacccaaccacccccgcgccgccccaccccccacccacccacgctcacagcacaccgcgcccccccgccaagccagcaaccgccaagaaccaaacacccccgacaccaacacggcccacgaccc

SEQ ID NO: 520434 - DNA, 223 bp, Homo sapiens
ttcctttaaaccaccacaatgaatgaaaatgtatgcatgagtgaataaatgagccaatatatttattaaaaatggcaaagattccatgttgatatgctatcaattgcaatctaagaggtgcatgcaattggggagggtcgcagtggtgtgccaccacctactatcttgggttaccccagagtatttttccattcaggcttcttcttgaaagcgcttgtaaacc

SEQ ID NO: 520435 - DNA, 367 bp, Homo sapiens
  misc_feature (211)..(211): n is a, c, g, or t
ggggcgacctagaggacccggctatcacatatcccaaagtatatttacttgcataccttgaaattgccctacaaagtctctgtgggaaaaatccatattctatagagaatcccctttccctttggtttccttccttccttcccagatacaagagatataatcaactaagagccaggcacccttttaagtctgataagaaatattttacaanctgctctctctgaagtctgctatctgagagcttcctctgcacaataaaacttggtctccacaatcctttatcttaacctgaacatttcctttctgttgatcccaggtcttcagataaactcaaccaattgtcaaccgtcaaccagaaaatgtgata

SEQ ID NO: 520436 - DNA, 176 bp, Homo sapiens
acgcgtgattccatgtcagacaagtctgaaaatctatgaacagatgccgagttcttgactcagctcacgttttcacgtcgatgaatatgaatctacgtcacaaatttagcgacgtgaattagacgttaagcatggggacgtcgacttttggcagcagcctcgaagtgaagtagcgg

SEQ ID NO: 520437 - DNA, 464 bp, Homo sapiens
tcgactctaaggatcccctctagtagttctagatacttgagctattacttcctgcattctttgtcttgcagattcacctactaaccttgatgaatctccatctggtacagtcaatggccatgacttttggctatctgattctcaagatgtctaacttcgtcttataactctttctcaacaacttctctctccaatttaaattctttctgcgtgagcagtctgaatagccttcactctttttcacaacttaagcttctgaattatttgtccttagtcatagctccctacgtcgggagtctgtgactaacccaggatggacacatctgttacatgacaaggcatacaggtgacatgacaaccactgagttacgctttgggacagactggagagaagtggcatatggattaagctagtcactaaaaatcaactcagtctagcacccacattcacactcagaccctca

SEQ ID NO: 520438 - DNA, 318 bp, Homo sapiens
ttcggtctcactctgttactcacgcggggatgcacaggcacagattcggttcactgtaacctcaccttccaagctcttgcatttctcctgtctcagcctcccaagtagctgggattacaggcacacaccaccatgcctggctagtttttgcatttttagtagaaatgaggtttcaccatgttggccaggctggtgtcaaactcctgaccttaaatgatccgcccgcctctgcctcccaaagtgctgggattacaggtgtgagccattgcacccaccccaaaagatgggtgtttaatgatactctgctaaactgtgaat

SEQ ID NO: 520439 - DNA, 273 bp, Homo sapiens
  misc_feature (44)..(44): n is a, c, g, or t
accgtcgcacagcttctccagcctgggcacagagcgagactccngtctcaaaaaaataaaaataaaataatatttggggccacagctggacttggtagctcacgccgtgtaatcccaacactttgagaggcccaggcggggcaatcacttgaggccaggagttcgagaccagcctgaccaagatggtgaaaccccgttactacaagagatataaaaattagccgggcgtggtgacacacgcctgtagtcccagctacttgagaagctgtggcg

SEQ ID NO: 520440 - DNA, 889 bp, Homo sapiens
gtgttgtgccgtttttgtctgcgcttttgttcgggtggttcctctcttggctgtttgtcggtgggccacagggtccaagggccggtccttctcacagaggactttttggggaggtcacacgtcccgccattgtgtccgtagtacccaggccccaccaattgtttgggcccgccgcttcctccgagtattttgggaccttgatatgcccaggccccgggggatcttcacgcactttacgtgcccccccgacccccaggacggcattcgtgtttgacccgtccccgatgtcatcctccaggaccacctgaaggctgcgcctcttctgagggcacggggccttgcgggatgggccccccccgactttgtacccccccacgccctgaggaagatgggggccagaagatcacgctccccgcctgttccccccccgcttttctcctctttcctctctgttgttctcagctccccctgtcccctcagctcccgacgtaggggaggggttcccccggcctccctgtttgaagcctgcccttgtctgagatgctggtgatggccctggtacccccttctgggcatctgttctggtttttaacccttgtcttgttctgtgatgaaggggaaggggggcacacttctgagtctcccaggctgcgtcttgaggggcccctgcttctccacgcctggacccccacgctttgccccacaccccgcccctgccccaacgccccagtcccaaagtttacagggagcctcctgccccgtccccccaccccagccgctcggaggcccccaagggaaaagcaccagaagcgtgagacgccccccatcctgggaacccccgtccccctgctcatttctcgtagctttttaaaaaaatgaaagttaagga

SEQ ID NO: 520441 - DNA, 138 bp, Homo sapiens
agggcggcaagcactggctaaggcactgggccgctcaacgtgtttgcaagccagaggcactgaggtttccccaaaaagggacactgtctgtatggaggactctgcccggagatcgcacctggggtacgagctcaattt

SEQ ID NO: 520442 - DNA, 263 bp, Homo sapiens
cctgagatcagccactgcactctagcctgggcgaaagtgcgagactccgtctcaaagaaaaaaaaaaaaaaaaaaaaaatttacccgggttggggggcttgtgcctgtagccccagcaacccggggggcgggggcatgagactccttgggcccggggggggggggtttgcggtgagccaaaattgagccattgcactcaagcgggggtgacagagcaagattctctcaaaaaaacaaaaaacaaggccattttcaacccaaat

SEQ ID NO: 520443 - DNA, 1548 bp, Homo sapiens
  misc_feature (1)..(1): n is a, c, g, or t
  misc_feature (26)..(26): n is a, c, g, or t
  misc_feature (829)..(829): n is a, c, g, or t
  misc_feature (1146)..(1146): n is a, c, g, or t
  misc_feature (1230)..(1230): n is a, c, g, or t
naacgttgttctctcgtgggggagtnaaagatggttgttctcagcgtggttgtgctgtttggtgtgcggccccccccgcaggagtgggtggttcgttcttgtacagtggtcgtctcgttccattactctctagtgcctgcttgtggtgctggggtagttgcctccctcatactacttctcctcgccctgggggggcgcccatcagtttgtggtcaaaacggtgtagttttctcccttcttcttccttgttgcgggggcccgctacttacgtcctccacccccccgccgggtgtgttgctcaggcccgcctccctgttgtgttgtctttttgggggtgccgccctccgagagcggtcgggcaccaccatcttctcggatgagtgatcctcctccccgccgggggcttgtattttatttgtcgccacgcagtgtgtttcgcgccagcacgccgtgtgctttaggacaacaaacaaccgcccttgtggttggtcgtcatacaccatgatcgtggatggcgtctcttactcttccctcgcatatctcccgctgttgtttccaccaaagggttcttcttcgcgagattttaatatttttgggggcgcccctcgctccccccccactagggggttgtacctcaccaatcttggggggctctctctctccgaggagtggcgtcgtcctccccccttggggaggggcgccccctcgtggggctcttttgagcaccaccgcggttcgtcatctgggggagctcgtcttcgcgttgttcgcccccccctcgtggtgtctctccccgcggatttttttttcacgcgccccacacccgcgngggtagcgcacctctcttcttgggagacactcctgtgtcccccactcgggggatttccctctgataaaacttcgcgcactctctctgtagccccctctcttttcgccgctctgggggcgtcttgcacacacggagacgcctctgttgtgtgtgtgttttgtccccaccgtgtaaccccacaaacccctctgggaagagccccacagcgcacccctcagacacacacacgcacactcttgtgtcccacagagagagaaagagaaataaaatgccccctcttataactcatctatagaaaaccgcgcgagaagaatatntgagaaccacatatatcacactctcaccgaggggagattctctctttggggaacacctcgggcttatatttctttctctaaagnccaccccgccccacaattgtgccctataaccgcaaatatattttttttataaggagaaaattaaaacaccttatgttaaccacaaattttttttttctttataatgtatagagatgtaaaaattatcccacaggaattctccccttggtctcttggtttttttaagcgtttttttgcaaaatgttttgtaaagccaccaatttttttgtaataaaagtctcccgtgtcttcttccgcgtaatttcttgctgcctgttccctaagagctgagcgccttgccatttctttgatccacccgatgatttaaccttgttttta

SEQ ID NO: 520444 - DNA, 577 bp, Homo sapiens
tcagcctttttgtggctggattatttcactgaacatgatgttctcgaggttcatccgtgttgcagcatggtgtcagaatttccgtcagttttaaggctgaatacttgtccattgtatgtataaagcacattttattagtccatttctccatgatagacacttgggttgcttccaccgttttgtagactgccttttgtgattgctttcatgaacgatgctgctgtgaacgtggctgtgcacatatctcttcaagaccctgctttcactctttttggtcatataaccagtagtagaattgctggatcatattttaattctgtttttagttttttgaggagctgccatattgttccccacagcagtggctattttacattaccgtggacacaagggtcccaatttctgcatatcctcatcaatacattttattttctgggtatattttctttttgtagtagtcatcctaagggatactgaagtctgaagggtccttataattataagtttgctctaaactgaaacaaaaaacagaatcatccacttttacctccattcaccacaaaggaatttaaaactg

SEQ ID NO: 520445 - DNA, 249 bp, Homo sapiens
gtaattcgcataatatttaaaacgtttttcattattattatgtctgttatggtgatctctgatcagagatttttgatgttaccattacgattgtttttcaggcagaatgaactgtgcctatataagatagcaagcttaatttttttaagataaatcactttaagttctcctttctatactgaatcctctactactgacttttatcagttattccattgtttcttaataaaatattatattggctatatt

SEQ ID NO: 520446 - DNA, 483 bp, Homo sapiens
tgggcggaaaaacacaacacagtatcaccctataacaaacgccacaaaaaaaaaaaagggggaccgggggaaaaaaaaaaaaaaaccaacccaccccccccgcccccctaaccaaaataaactacagctctgaccaacaaaatccccgccccccaacaacagcttaaccccccaaattccccacaaagcgccccaaaacccaaccacgcccccgcgaaacacaccccacccccccccctccaccccctcccacacacacttacaccaccccacaacacactcacctcctccgccgccccccccacccacgcaaacctcccacaccccctccccctacccaacacccccccacaaagcgacactctgccccagtccaccctcatccaactccacccccccaccacaccacatcacccccacccgaccccccaccccaccctgtcccgccccacccctacccaccccacccgcgcaccccccccg

SEQ ID NO: 520447 - DNA, 927 bp, Homo sapiens
gtccttgcgcgccgatatctctgccgggtgactagctgcttcctttctctctcgcgcgcggtgtgggtggcagcagtgcgcagccagcctcgaaagtgcacgaatcgacgccggcgatttcgtggacctgtacgtgccgcggaaatgctccggtgggcaatcgcatcatcggtgccagggaccaggccatccattccagatgaagggtggccgagggttgaacaagggtcaccatggcaggttttgacgtggccaagtcgttacacacacctaatgcgtacttcgtggggagtgcccaactcaccgctacgcgcagtggcggctggaagcctcagaattgcattgtccccaattttcctgtccccggaattagtgcgtcccgaagggcgcccgtgaatgtggccaattcggtcctttccaatagagcaacgctttcttgcgacactgggcaccggaaaggcacagttccaccaagggcatttgttgggacacactaaagttgcgggcaccaattacacgttttcagaccatttacagcttggacacataaccccaaagaagacataaggcacaggaggacagagacaggggccaagactaccatatgaatcgcgaaccccgctggcacgatcgacggcacacacatccttggcgacaccaggtctgtgcagacggagagacgtatgtcgtaaccaaaccacacaaatatggcgtaggatgaagcgacgcccaccggtgacgccacagaaggggaccagtagacaaagtgaacacaaggctatgatccccatacaacgtgcgaaggccatcacccggacaagcgacagccaacctcacggcagcgcaacatactcaccagacgccggcgagctgagactactcccacgaacgagaaattaaacacaaacacacgccacctagtggtga

SEQ ID NO: 520448 - DNA, 760 bp, Homo sapiens
  misc_feature (2)..(2): n is a, c, g, or t
  misc_feature (73)..(74): n is a, c, g, or t
  misc_feature (80)..(80): n is a, c, g, or t
  misc_feature (100)..(100): n is a, c, g, or t
  misc_feature (117)..(117): n is a, c, g, or t
  misc_feature (135)..(135): n is a, c, g, or t
  misc_feature (144)..(144): n is a, c, g, or t
  misc_feature (176)..(176): n is a, c, g, or t
  misc_feature (240)..(240): n is a, c, g, or t
  misc_feature (243)..(243): n is a, c, g, or t
  misc_feature (269)..(269): n is a, c, g, or t
  misc_feature (333)..(333): n is a, c, g, or t
  misc_feature (346)..(346): n is a, c, g, or t
  misc_feature (357)..(357): n is a, c, g, or t
  misc_feature (407)..(407): n is a, c, g, or t
  misc_feature (412)..(412): n is a, c, g, or t
  misc_feature (440)..(440): n is a, c, g, or t
  misc_feature (451)..(451): n is a, c, g, or t
  misc_feature (469)..(469): n is a, c, g, or t
  misc_feature (484)..(484): n is a, c, g, or t
  misc_feature (493)..(493): n is a, c, g, or t
  misc_feature (505)..(505): n is a, c, g, or t
  misc_feature (530)..(530): n is a, c, g, or t
  misc_feature (592)..(593): n is a, c, g, or t
  misc_feature (598)..(598): n is a, c, g, or t
  misc_feature (610)..(610): n is a, c, g, or t
  misc_feature (625)..(625): n is a, c, g, or t
  misc_feature (742)..(742): n is a, c, g, or t
gncagaccactccaaaataggaaaagacaatctagtgcaaatagacagacacagtctaggcattgaggaaacnngctgtnttcccagacaagaaaaactncaccccccatgaccgancagctcaggcttcccttncctagccancctaagtagcgtcctagcgaaactctggatcncagcctcagctccagctttgcctggaccttgctagggggggggagggacaggacgcacagaggnggngaggagagggatgtgatgtctttctnaggaaagaaaaaaaggcacagtgatgagccataagaggtgagtcactgagacgcaacaagaggnagtgatgaaagcnaggaataattntcattcacacaccaaatcctagcggcaagctttgacaatgtaacatcttnatctngtggttaggaaaatggacctagagagangatgtggtgtngcccaaaatcacatagcnactaagtgcagtagnactttctanaacgaccaactngcctatccacttggttggaaaattnaaaaaccaaacctgtcgtaatctatctgtgctgccccacccgcctgtttcatgagaagactnnaaatnccaggaggccanaaactcaaacaagancctagccgttggcttatgacgcggtggctactacaaacctacagaccagagcccagggtagtatagagtcccaactctgggccctgactgcaggtcattcaggtcccagtcacagtnaaagcagactcattcagc

SEQ ID NO: 520449 - DNA, 290 bp, Homo sapiens
gcaggaggaatggctttgtgctggcagtgtctcccacaagaagcttctaaatatgacttcacagagatttcttatatctgcaaagatggtacttttttgcatttaatacgtgaagaatttgcttgttcttgtgctcaacgacagacaagacatttttacttgttgtgtgttgttgttcttatgagattggagtgtcgctcgtgtcgcccaagactggagtacagctggcatgatctacggctcactgcaacctctcgcttcccaggttcaatgtgattctctctgactta

SEQ ID NO: 520450 - DNA, 343 bp, Homo sapiens
gaacctttttctagaccagagttcaattcccagaaacgacatggtggctctgtaatgggatccaacgccctcttctgctaagtctgaagacaccgtgtactcacatacataaaataaactatgccaagttaattctatagagttcagccccttgtagagagcattcaagcaacactgccgagtcctctcatattcactcacataaacaacccctttttaatactactttttatattgtatatattcaatgtataaaatggtttgatgattccatttccactggtttataaagtactttgaccaaatgtaaaaagatataataaaaaatgtttatttcctagta

SEQ ID NO: 520451 - DNA, 107 bp, Homo sapiens
ctcggatagccaagatcgccattgcactccagcttgggcgacagagcgagagcctgtcccaaaaaataattaattaattaaaaaaataaaagattgggccttatcga

SEQ ID NO: 520452 - DNA, 540 bp, Homo sapiens
  misc_feature (432)..(432): n is a, c, g, or t
  misc_feature (515)..(515): n is a, c, g, or t
caatgatattcaatatattcagagttaagcaaccataaccacggtcaattttgaagcattttcatcactctatatataaagcaatcacactccattttctcccttctctcagcccataacaactactaatctactttctgtctttgaatttgtccattctggacctttcatataaatggaatcatacaatatgtcgtcctttgtgacaggcttcttttatgtagcataatcttttcaaggttatctgcgttgtagcttgaaccaggtacttcattccttttaattgccaagtaatattttattgtagggatataccttattttgtttatccattctatcagctgatggacattcaggttgtttgtactttggctattatgaatactgctatgaacattcatgttaaagttttttgtgtggacatagttttgnttttaccctttggcatatatagccaggactagacttgctggatcatatggtaactctatgttaaccttgtgaggaattgccanactgttatgcaaagcaacttcccct

SEQ ID NO: 520453 - DNA, 1595 bp, Homo sapiens
  misc_feature (389)..(389): n is a, c, g, or t
gcttccgagacaagcgctgcgcgctggatctccatcaatcgagttgggctcggttgcataacctactcgatcggtcatggctgcccgaggtcatccaacggacgtggtacgcgcactggagctggcagcccttgttttgatgtcaaacggccatgattcttcaaggccacactgggatgataaattgcacctatagagatggtggacaatcctgtggtttcatggtgactcggtcctatagctcgtgggtgtcatggattgagtgcatccggacatggcctctactaacgtagcgtacagacgacagtgaaaggaaaaagctgcaaatccgtgtgagactgtcccttggacccatcaatgcgtctcgcagcgctcaatctatcactcantggcccctattcaccgttggacgccctcgtcgaaggcgacccttgatacaatggcgtggctatagccagaatgtatgacaagactgatatgactcatgtgacctgggggacacgacctgtcagaacgacagggcatgtggacctaatcttcctgtggccacacaagggcttgtcgtgtttggatgggtaggaacctccacttgatccctcgctatggagatatctacctcgtggggtctttggtggccttcgtgcgttcgctcgaatcctgtaaggggctcaagttccgaatcgaaaggcacaaccaagagggggctcgaacctttggttcctatcaggcattgctccatcgtgcattaagacaatgggcactcctggcttatccagtgggtccccaagtgcggtggatcgcaccacctgtccccaaacgggcacttttttggacgttattgcggatccattcgaagcattgggggggaattcgcacgcggtttgggagggctatggggcacatatcattcattattcgggtggcccggcccgataggtgaaagctaatagacaacccaagtagagccgccacaagaggcctgcgtcactgtagccggagccccgtatgcaagtccccttttcccagttgccttttgcccgtattcttgggcctgggggtccaaacccgcgcacaggcgggggattcccgcattggttgatttttcgccttgttggggcgggggccctttggggttcccgggcccgctcgcgcggggtgagacacaacggatttgtcgcacgaccggaccgtttgcttcatccgggcgcgctctcggcggcgttggcacccaccacgagtgattgcggtcctgggcgcggccagttcgcgagaagtgggccctgcctgttaggaacaacccatgtgggttggccaaattgcgggggacttggaccagcggagaacgccgacaaatgtatgacgcgacgactgtttggaatatagttccacaaggagagtgtgtgcagctgtgtaaacaacagagcaccactaacgtttccccacacatatagatgcaagacgggagacgctcccactcagaatgaagcagccaacgcaccacggctgtagtgtggccaccaagaagaacgtctgtctcacacacgaccaccacacgaactcacggggcgagagcgccaaacaagatgcagactgta

SEQ ID NO: 520454 - DNA, 331 bp, Homo sapiens
agttgtaatggaaagcgcacctctctggaactcgggagtcttggatcctacacatgattctatgcataaatagaaatgaaattagcttcctggatactaagctagtattaatcaggtgattctaattaaaatcactctgctagctaaacactattcagcaagattttggttaccccaagaacattctgagacaattgtatctataattgataagacttgacaataatctttcttcctgaagtgtgttgttaactttttggttgactcttagcaaagtacatagcatatagtaggcattcaataaatgttcattcattttttgcatattttc

SEQ ID NO: 520455 - DNA, 182 bp, Homo sapiens
ggtagtttcacattccttataaaggatacataaatggtatacttaggatgcctaatatttagaatttaaacacggtgcatttcttttcctcaaatggaagcaaagttatagtttctaaacgagcatttacttctgcacatctcgaattcctgcatttcacgtgggctgcagcactgtgttac

SEQ ID NO: 520456 - DNA, 172 bp, Homo sapiens
  misc_feature (59)..(59): n is a, c, g, or t
gttttcagaatattttggtaactgtccaatgatatatatacctggttttacctttccgnttgtggatatcttttggaagatgtaattgaaaaaataaggtatgttccagaacaaaaagaacacagatcccagtttaagaggggtttcatgcaagggcatgtaaatagacaag

SEQ ID NO: 520457 - DNA, 414 bp, Homo sapiens
  misc_feature (58)..(58): n is a, c, g, or t
  misc_feature (72)..(72): n is a, c, g, or t
ttcaccgtaggtggcctgactggcattgtattagcaaactcatcactagacatcgtantacacgacacgtantacgttgtagcccacttcccctatgtcctatcaataggagctgtatttgccatcataggagggttcattcactgatttcccctattttcagggtacaccctagaccaaacctacgccaaaatccatttcactatcaaattcatcggggtaaatttaacttttttcccccaacactttttcggcctatccggaaagccccgacgttactcggactaccccgatgcaaaccccacatgaaacatcctatcatctgtagggtcattcatttttttaacagcagtaaaattaaaaattttcatgatttgaaaaaccttcgcttcgaaacgaaaagtcctaaaagta

SEQ ID NO: 520458 - DNA, 125 bp, Homo sapiens
aaagggcgagcatcagtgggtgcaactttacaaagtccaggaccaggatggcaagtctgggatgaatagtagcctggctgcgcaatgaatctgtgatacacgagccaggccggggctcaggcacc

SEQ ID NO: 520459 - DNA, 120 bp, Homo sapiens
atggtcggtggcgttgctgccggtgcctcgtcgtctgttttcctttctttgcaggctgcatcatttcccgaggtgacgctggggcacttgctgagcggttgttgggagacacgcgcacag

SEQ ID NO: 520460 - DNA, 107 bp, Homo sapiens
tctgtgttccagtgttgggaggattatcgggatgatgaccagtgtatgaggatgacttctcgtaatcagttacgagctgaactagagaaacatggttataagattgg

SEQ ID NO: 520461 - DNA, 867 bp, Homo sapiens
gaaacatcgagactccatctcaaaaaaaaaaaaaaaaaaaaacccaaaacttttattaatgaaaacttggccagtatccttaatggatgtggaaatattggctccttgtggaaatctgggcaaccaccaactgaagatttgggcaaaaataaatatcagtcagactctatattccaaaaggatttatttccacttggtacctgaaactcaaattgttaaattactgaaccaagtgcattagcaagattttacctttaacacatgtgacgatggaacacctgaaaaatattacacttaggaaatacccatttctataacctggtcaaaatgtagtggttcatcacggtcaaaagttacacgtgctttggtgtgtgtctaccccttggctttactcgtatgagaactatttggttgggtcgtttaattatacttacgtttacgggtaccttgtgcccattgtgcggtagtacctttttctacttgtgcctgcctgtgcgctgccccataacattccattatcgtgttacgtaggaaatgcttctgactttgacactctgcgtactaacataccggtctgactgtgtgactctcctgtaagacttgcacttatttcactgggcctcttctgctagggtttcaaaaatatgatgggccatggctccgccgggatttatgtactgcctggaaggaagctggtccctccatggccctgggtccgtaaggcttaggggggattaacatgcggcatttcaaacggtccaatgaacaagtggtagactcgcggtccatgttggcgtttaacatattaaaaaaccgaatgtatgacccacggcggtaaagaaaacacggggcccgagggggcagcca

SEQ ID NO: 520462 - DNA, 942 bp, Homo sapiens
gacattttctctaccttgactgttccgttccccatgtctgcctgctattattgtactctgtcacagtacctggtgcctatatggactatcctgtattatcgaatccactgattggattgttgtctaattgaaagagatcagttgtgaagtgtgctgactttcatctagactgagaatcgtggataccggccttgtgcttttacatgaatctggtcatagtcatgcccagcagccgcgtgctccagttgagcccgtacctgtggaggcagaatgtgctggaatcttgctttggccaggctactctctgaactctaattctccacctctaaactgatgacaatatttgttcagtaagtatttcttgaatgcctattatgtgcttgtgattcttagtattagttgaaattatcttaagaagaactctgctagcccagtctccaattttacagaagagggagagccccagagagagaaggtgacttcagtttagatcaccagctaggaaactgtgcagatgtgaataaaacctagtacgtctgactctccatccagggaccttcccactgtacgtcaacagccatttatctctttgactgactgattgtggagaagagagcagagagagcaagcaagggaagccagctacccagtctgagcaggcctgtgacagatcaatttgggctgagaatattgccgcaaattgggtcaggtgcagacctcaagtggattggctgtctcctcaattttgttattctcaaattctcctagcctgtgcaggaactcatcaaagacgggacgggttgggcgcccccaatgactggctccagttccaagccggaaaaaagagcgggccgccattgttcaacgaacaaccagaaccctccatctcttaggaacttgaaccacacatctgcccaactacactcacagggttcaaacctc

SEQ ID NO: 520463 - DNA, 403 bp, Homo sapiens
agtgcatgtgatcctgtcctgagatcttagacttgagtagcgctgctgtcactgatatactatgatgaaagagacattacagcatatcaagtcaagaaaataggaactccaactcagtgtgaccagttttctaccagtatttttgatgccatactttcaggaaaacagatttaatgtgtgtgtggactttacagtatctacgtcctaactgaaaatttaacaaagcagtcagatggaattacatgtagtattacaaatgtgttcattcaacactaatgagcacccactctgtgcatagcactgggctaccattttacaagttgagtttaacgtctttatcaagcatgaccttagtgtgaggtaaaatacattaaattagcgtcaacgcgtaagtctgctagcg

SEQ ID NO: 520464 - DNA, 170 bp, Homo sapiens
gatttgatgcttgcacatcaaaagagtctgatatttttttacacctcacacgaagcagtttattatctgcttggagaatgcatgatttaacaacagtgcaagaggtaaccctttagcagggtaagattaggcgggatcacagtagctcccaccggtaatcccagcacttg

SEQ ID NO: 520465 - DNA, 126 bp, Homo sapiens
tggttacaactttttttaaagatatagggctataactgtggtgtgcccgggcgtgcaggtgagcgtggtgattgcaccactgtgcacctccagccgtgggcaacagaggtgagacccgtgttctgt

SEQ ID NO: 520466 - DNA, 537 bp, Homo sapiens
  misc_feature (517)..(517): n is a, c, g, or t
  misc_feature (519)..(519): n is a, c, g, or t
aaaagcagcacatttaatttcattaactaaaatttataataaaactttccagtaacatgtttctacaaggaactttgtacctaggactcagaacgtgggcagatatttgttttcttctacttaaaagggttggcagtctatttgtgtagcctctcaggctcaagcagtcctcccactccagcctcccattgagtacctgggactataggtgtgcaccaccatgctcaggtaattaaaaaaattttttttgtagaggcaaggtctcaccatattgcccaagctgttctcaaactcctgggcttaagtgatcctcctgcctcagactcccaaagtgttgggattactgatgtgagcccttgcatccagccagaactttctattatttatggtgtgtggatcaaagctgatttagcatgaatacatatgattttggagttctgttttcttctggtgaaattttaaggcagcaaggttgacatttggtttttaattcattttcactggaggtaaaattaantnctaaacctgtgccgagat

SEQ ID NO: 520467 - DNA, 102 bp, Homo sapiens
gcggccgcctactactactactgctcgaattcaagcttctaacgatgaacggggacatgcagtccccctcagttcgtgctgcaataaaggccatcttctctt

SEQ ID NO: 520468 - DNA, 146 bp, Homo sapiens
agaaagtctgtcctttggtagaaatgaatctttcaaaggtttcccaaaccactccttatgagcgagtgaatattcaagagagctacatttgagagcctgtacaaaagcttatccctgtaacacatgtgctattgaaacttctaaag

SEQ ID NO: 520469 - DNA, 979 bp, Homo sapiens
acccacgctgtgcggaacgagaggatactcaactcctgcacagacctgatgaaggtgagtgggctgtgacccggggtgggtctgcacctggagtggccaccagtcattgctgtcttggtctcggcagtgctatcctggctcctggtgactgacatccactagcctgcagaaggcagatcgtggagatgcggcagtggtgatgggtgcctggctggcagcatgtggcacagtcgcacaagggagccttgaccccacaggcctagtgccaaccctgtggccattgagaacctctcacacccacgtaccacatgggagtgcctcatgggattgcgcccttatggccagaagtgacgtggggacgatgggccgcttagaggggcccctttcccacctcttggtgtcacttgaactggcaatgtacctgcccttgttctcgccgtcagaccactagtgtgggcagcccactgcagcagcgacatttacgccaagaactcagcgctggaccgcaaggcctcatcttcggacctcccaaggctgtgcggcctgcggagccacacagcttggtggagtgcagctgaccaagggtgcgtgccttcacacggtgcaagttctcgacggagctccatcggtccttgcttcacaaccgagatcgcagaccagcactggccccactggtggctggccttccaaagcgtgaatggccaagcaaagcacaagcccccacgctgagaccgcctgcaaggaactgtcctcgcaacaggtcaactgagagggctgccaatgttggtggcctcccaccaagtcaggccaggaccacaatatgaggcacacgagaacgcgcatggactttcctcctggacatggtcccctcattcaagcatgacagaagcccgtgcacatctgagctcccggatgcatgtcctgggtagctggcctacgcagctggaggctgaccccaccgggctggcggagaggggac

SEQ ID NO: 520470 - DNA, 210 bp, Homo sapiens
tgcatgtgactctatgaggatccccaacatgcgaacggactgatcaggaccatttgcagtagtgaactcccaggttgcctttgatggcagcagggtttccaccgtgaatgatgcatctctataacatgatcatccgacgctactctgataaaagtgggaacatggattttgacaacttcatcagctgctagatcagtccgttcgcatgtt

SEQ ID NO: 520471 - DNA, 974 bp, Homo sapiens
tcgtccgattttgcggattttcgccccaccctccgtgtctttgtttacccgcgccctttgctctttactgggcccgtttctcccctccttatgtacctccccgccttacactggtggtgttccttccaccttcctataccgtctcttcatattagtccttcttaccccacacgaccgataccacaaatacccccgtgggggcgcatgtttaacccggtctgagcacaaatttcccacatggccacacacagcaccacacctggtcccaaaagtccttttgaatacgggggatatatcctcttgtttttacccccagagaggttttttttttccccacgggagattttttgagccccttttaccaccctccacgcctttgtgccgcccttcctccccccactttttggaggggccgtgccgcccccaacaagggcgaatttcccccccgttatattccccttaggtggtcgcccacctctccttaacaccactcccggttttatctctgcactaccaggaggtgattcacattatcacccctgggcgtcacccacatacttttgttatatatggaaacccaccccgggtgaccccccataatttcttcagccccctgcggttatttaccaaaatttttctcgggtcttcctatttttacacctccttacaagaactctcgagagtgactttctgatgttttcctcccttctacacacttttctcgacagggatttttacgcgctctcaccaatgttttgtgtgagcaccacaagggcttctccccggaacttctacagtctaaattattgggtccaacattctctccccatatttgccttttatcccgccgccagtaaaattttccctttaaaacccaaaaaccctttgggtttgaaaccccccccctaaattggccttttttaaaattggtttgaatatttttttaatttcccaatttttgaagagggttttta

SEQ ID NO: 520472 - DNA, 260 bp, Homo sapiens
  misc_feature (174)..(174): n is a, c, g, or t
atgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcagacgtgctggatcngcgagggagcaatgtgggtgccacgccgaggggatcagggtcccaagaccagtgaccagatccataaggaggcgggatcctctaga

SEQ ID NO: 520473 - DNA, 135 bp, Homo sapiens
ccctaatcgcagcttgccttagctttatgaaataagttgcctgaacagagacttgtagaatggtggtatgagggctttccttgcttgtacatttagtggtgctaaactttagaatatgtatttccttaatgcata

SEQ ID NO: 520474 - DNA, 548 bp, Homo sapiens
agatgtactgtggacattgctgcggtgcgtgatgatatcgatgattctgtcttcgattagtcccgagtcccttcatggctttccgcagcgacttatggatctgcgatcagggtaagaagtctattgagtggccgcacagttcccttcagctctactcgggccactgcactaggttcccacatctgataggccacctgcgctgcctccgggaagaactggccagcagcatcatcttttcccccagacagcttcacgaagagtcttcttgtactcgccagaggtgtcatacttgatcatgctgtagagggacttctcatacttggtccggaagatctcccgaatgtcgagcatgtccaactcactacgggagaccatgatgcggatcaggggtgtagtcccgagtccccaggcccttcatagccttgaagagcctttcagcacaatattccgggggtgctccggattaacttcgtgggcagcctgcccacaaagtggcccccgagtgatctgtgaagaatgccagggtgggggtcggaggaggagtatag

SEQ ID NO: 520475 - DNA, 147 bp, Homo sapiens
tgctgcgtgtcgctctcgcggctccccctcggtggcccgcgccgtgcccacattcgtgctctttctggtcccccttccgcagtccggtcttttttttttggcagcagggcagtctccatctggtcccctcaggggtcccggcggctc

SEQ ID NO: 520476 - DNA, 988 bp, Homo sapiens
  misc_feature (840)..(840): n is a, c, g, or t
aattcgtagggtaggtgtgtttatagggaggaagagaggggccctaattggaaagactctcttaattctccacggctacaacatcttctacattcatgctgtagaagctatgaaagttttgggaaactatagagtcatcactgcaaactcaagcactggatacgtgccggagagcactttgacctagccgttagaagaaatggagaaacggtgacctctcagaggccgtatatgaattggctgagggagtctccaatagtgcgctaacaatgattggaaaaaagaataattatcatttgtttggacttggtatttgctctgactgagaaagacgttaactgttgagagctgcgggaggttaaaatctactgttagtagtggtttaatagtagacgatgaaaaagtcatgggagtgtaggccaggatcgccggctgctaggactttatgggaggctatagttcttggaaccctcactcactaaactaactagcgcgcgagttgttaggggtggtgtcgggtaggcgatgaactatattcaaaggggggtaagatccgtttacgtccatgggtcgggtgggaaaaccgggaaaatataacgtagaacgcctatagggtcttatataagggcgtatgaatccggttataaggtgcggcgttctgctacgtttatatagtagagctgcccgttcccgggaaagaatataatgtaagaagaggagccctgtgtgtagattcggaggggatattggtgacaatagatgttaaggtgcacatagcagagtgggccaggactacggccctcgcgttgcgtcggcgcttgttctccggtctagttgganaagaggtacgtgatgtcaactacgtcaactatgatgaaggagaaggagttttatccatgttgcgccgcgtatatatacacatccgcgtgcgaggttgaccggtgacaacgtctatgagtgatagcataacgccacggcaatgttagag

SEQ ID NO: 520477 - DNA, 422 bp, Homo sapiens
gcagggaaaggccttatcgctgtgtgtgtgtttcagtctacgtggattaaacattacttcgctccgtctacctgcattaatgaatcggcaggcaggcctcacttctccgtacgcagtgatctggagatcgctacggacctaaaatacccatagccccttcgccccctgaacaggcacttctccccaacgtgacgacgtgtgaaatcaatacagtagactgagaaagaaacccagaagaggaacgaagagagaaggaaacaggagatacagcgactggctactacagcggggcaatagagcagtggcgacgggagtgaaacacactacgagagacctcaacagcgagggagtcggcacacgccctgggaacccggcccggcggaaagccccagggcccaaaggaagtagaagggggagaaaca

SEQ ID NO: 520478 - DNA, 461 bp, Homo sapiens
tctgtaaccataatcactggtctagtctattcctagcttcagctaacacactagtagaaggagatagagactttatagtatgtctgaatatttggtagaggtagacctactctacatagcttatctttcgcaggtattcctagctacttcttacatttttatccttccgtatgaatgtgtgtatcagtttaggctctagaaaaaatgtaaggcataaactagaatcgcattaagtatattaatataacttgaggagaactgacatatttatgatattgagtcatcttttccaagaacaaaagatgacttggcttatttagggtctacttctatgtctttcaggagtgttaatgtattcctcatacagactttgttgctcttgtaaatgggtttactctacattacatcctctacttgattatcatttatgtatatgacagttactgatttccgtatgccaa

SEQ ID NO: 520479 - DNA, 347 bp, Homo sapiens
gtctgtgctgcggtgactctagaggacccagcggccgcctttttttggtgctccgagctcgcggtcgtccgggtttttttacgttttaatttccaggacttgaactggccatgtcctctgaagaaggaaagctcttcgtggggagggctcaactttaacaccgacgagcaggcacgggaagaccacttcagcagtttcggacctatctctgaggtggtcgtggtcaaggaccgggagactcagcggtccaggggtttgggtttcatcaccttcaccaacccagagcatgcttcagtggccatgagagccatgaacggagagtctcgggacggtcgtcagatcgggta

SEQ ID NO: 520480 - DNA, 328 bp, Homo sapiens
tgcggtatgagttcacccccacaagtttaggtattttcagaattttaagtgttataaaagcttgaaaggcaattttgcagattcatagctgcaaataaggccatgcacagttattaaagatagtcttcactcaccatccagtctgttcaaatatttttactaacctagtcacaaggagcgtaggtagagattgatatatttaatttaagtaagtttagtttagtcctgcaattgctggctttattaattctatgtacaaaaagtagatagttccttttaaaatccattctgttgctcaaagttggattaaagggttgactgatcagca

SEQ ID NO: 520481 - DNA, 460 bp, Homo sapiens
ctttgttgaggcatttcttcaggtcgctcaatgtctccagacaagatacccagtgtaagacattatcaatggggcagatgtccaagacatgggcagcacgggagcatggcagcggacgtgaagcgggacagcaagaagccaccacccccacaatagggtgggtaccgctcattctgagtcaccacctctggcacatagtacttgctccaaaaagcccggatggggcccacgtttcggatcagttgccccacgacagaggtggcggccagggtcatggtcctgcatgtagaagaccatgttgtctgtgtgtgcaaagacgtcatcatccccgttgagcacgaagctggagttggcgcaccttgtctcctgccactgtaagaacaggacctgcttgagcgtgaggttgacgaaggagtcgtggcagtcccactgccggatgtctccgtgagggggatctcta

SEQ ID NO: 520482 - DNA, 223 bp, Homo sapiens
  misc_feature (12)..(12): n is a, c, g, or t
agtgatggggtncttgtctgtcgacccaggctggtacaatcataactcgtcatttgccaaagtcttgaactcctgggctcaagtgatccttcctccttagtctcccgagtagctgaggcaggagaatggtgtgaacctgggaggcagagcttgcagtgagccgagatcgcaccactgcactccagcctgggcaacagagacaaatccgtctcaaaaaaaaaaa

SEQ ID NO: 520483 - DNA, 420 bp, Homo sapiens
  misc_feature (6)..(6): n is a, c, g, or t
  misc_feature (42)..(42): n is a, c, g, or t
  misc_feature (53)..(53): n is a, c, g, or t
  misc_feature (312)..(312): n is a, c, g, or t
  misc_feature (387)..(387): n is a, c, g, or t
  misc_feature (414)..(414): n is a, c, g, or t
cagccncataggaacgtagctaatcagccgtcgtcccgcatngctgctgacanggaccaacagctagctgcatttaggggatggaaaacccgtggtcactcgtagtgctaagcgtatagctagccgtatctggaaacggcaatgcaagcgtgtacgtacgggttgtgagcaacggtgcgcaaagccgatggttaggcctgtttggacgggcgtcgatgtcggcgtcaccaaccatcagatacagcgctattggacttgcttggtaaaacggttctaattacgcaccgtctcacgtgagtgccatggcttttngtacccgaattagtgaacttcgatacatcgcgactcgtcacacgggcccctgatgggttgacacgataggtgttncatagttcggaatttgaacgccaaccnttttac

SEQ ID NO: 520484 - DNA, 335 bp, Homo sapiens
cgcagtggctcacgtctgtaatcccaaaactttgggaggctgaggcaggtggatcgcttgaggtcaggagttcgagatcagctggccaacagggcaaaatcctctctctactaaaaatacaaaaaaaattagctgggtgtggtggcatgtgtctataatcccagctactcaggaggctgaggcaggagaattgctggaacccaggaggaggaggttgcagtaggttgagatcacgccactccactccagcctgggcgacagggcaagtgagactctcaaccgcagccataagggtctaacgcccatcctggtttggtttatttcgtttcctctgt

SEQ ID NO: 520485 - DNA, 712 bp, Homo sapiens
gcaggaacaggcgaaacctaagacgggtccatcacttcctttttctcaggagtccctgcatccctaatggcttctctctgatctcattcagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcatggcatcgtcagcttcgggtctcgcctcggttgcaactactaccacaagccctccgatcttcacgcgggtctccaattacatcgactggatcaattcggccacagtagtggggtctccacttaagctccctggatatcgtcctagcgatagctttggaagggtgacagaagacggaggccctaactaagtctagtgatccataggtcgaggtactcacctgcagtaacagctccaaataggccagatggtaccaaatctgcggagggtccctgatagccaacagcgtgggtcctgcacggactgtgccactggatacagatcctccaggatctaccgggtgaatgctggggcagcataacctctacgttgcagagtccggatcagctggccgtcagtgtctctaagattgcgggaagca

SEQ ID NO: 520486 - DNA, 340 bp, Homo sapiens
gacttgatttttcattttgcccctccattttcaaacccccccccctttcccatcctactcctgccatgcattgaaggggcaatgccttttggggtgagctttgggtttaggggccccctccatccctcagataccctggatttttgcccccctcttcctcaaagccccccctgaggggccgtagccccatctagggctgtggaaggagcagactggttcctaactctctccccccccccgcccccccccctcaaaaaaatcttccccccccccctctctgcccttattttttgatttgggccccctggaactaggggtttatggaataaaggagaatgga

SEQ ID NO: 520487 - DNA, 504 bp, Homo sapiens
aggactttatttttacacttgtatgcttcgtctaataaaaatgcctttcatcattactagtttaacggagaaatctgaacatttgtatcatcgttcccctttacatgttcgcagttgtttttcgatcaacagcaggatcctatagcactgagtagaggagcacacattcattcacgttcatgtttccatacacagtaagtagtgtcattcactctgttcctcgtcaatctaaagggacatatttggctttattttttttgttcagaaagaaaacctgaagacagtactagaacattcaaccaaatgtggtgtttagtgaatttttaataatgtacagtttttgtgactttaaatttgttcctttctatatttttaggaccaatatatcgtttttaagaggcgacattaaatgaccatgttgtttcaaggtaatgtaacacacgtgcatctgtagaatgtactgtaagcggaaataaaaccacatctagtagacgaaaaaaaaaa

SEQ ID NO: 520488 - DNA, 998 bp, Homo sapiens
tgggggctccagtcaaggaaggggacattttattggagggctccaggggccagggggccggggcaggaggctggcccttcaagggaaaagaacaaccttatttggaccttcttctggggaccgcaggtggtgggtgtggaccacacttcttctggcggcagtggaacagccagcgagagggtgcagagggcgaagtctatagaatctgggcggcagaatcattctggtgtcgcaggtgtgtattttcggggccaagtcgtgggcggaagaagaagaggtctcaataagtggccactctgggcgagggcgcaaacaccgagggggccgagggtgtggcacttctttcgcgtgggagtggtgtgatagttcgtggacgaagaaggtggcggccattccctcacaggcgtggtgtgggcgcggcacaaatatcagaacgccgtggggggggctcgacgggtgggtgaaatcacccttcctgtgggctcttggcaacttggggggcttttggcaaatttcttcaagagggcgtgatttacttacccagtgtgcacagtggaatttccccaaaagaacacacattaaattgtgggactctcaaacacagaacgcaacgccaaaagagggctttaaattaatatgagcgatttcagtccgcttcataacaatattttgtgaaaagcgcaaaggtgtcaagcagaagacaccataattacaggcgtgggtccccccaaaaggcgttgttccggtcgggaacgcccgtattaagaagccgccggttcagatagattagctaaggcttacgtcgggactgttcttaacccctttcaagaaactccatgggggccatggtccaatgcggccgaatttattccaaggtggaaccccgcttattctacgggaaatagaaagttcttaccgttctgctataatatgctaaactcttcccgctacgaagtcgttccgttaaattcataaccactttgcacacggccacggga

SEQ ID NO: 520489 - DNA, 536 bp, Homo sapiens
  misc_feature (7)..(7): n is a, c, g, or t
  misc_feature (25)..(25): n is a, c, g, or t
  misc_feature (43)..(43): n is a, c, g, or t
  misc_feature (71)..(71): n is a, c, g, or t
  misc_feature (82)..(82): n is a, c, g, or t
  misc_feature (101)..(101): n is a, c, g, or t
  misc_feature (209)..(209): n is a, c, g, or t
  misc_feature (302)..(302): n is a, c, g, or t
  misc_feature (361)..(361): n is a, c, g, or t
  misc_feature (369)..(369): n is a, c, g, or t
  misc_feature (391)..(391): n is a, c, g, or t
  misc_feature (428)..(428): n is a, c, g, or t
  misc_feature (449)..(449): n is a, c, g, or t
  misc_feature (516)..(516): n is a, c, g, or t
tgttggntccccaaccgcttgggcnccaaccttgggtggaatncctgcaagtgtgcctaacttggttgctnaacatcttgcnacctccaagtgctttgtcnccactcagtaccttggatcagagctgctgagttcaggatgcctgcgtgtggtttaggtgttagccttccttacatggatgtcaggagagctgctgccctcttggcgtnagttgccgtattcaggctgcttttgcctgcctttggcccagagagcctggttgaagatgtttgtaatcgttttcagtcctcctgacaggtttnctgtgccccctgtggtggaaagagggcacgaacagtgcccagcgcagcgttctgggctncctcagtncgcaggggtgggatgtgaagtncatgcggattatccactcgaccacagttatcagctgnccattgctccctgtctgtttnccccactctcttatttgtgcattgggtttggtttcctgtagttttaatttttaataaagttgcaatnaaatcatcaaaaaaaaaaaa

SEQ ID NO: 520490 - DNA, 270 bp, Homo sapiens
tcacgtactctacgtagactacaggagtgtctaggcctgtgtagcctaagcgtacagtgtggataaagtctcaggtagagtacagtgagtgttctaggcctggtgtagcataagtgtgtagtgttgataaagtctacagtacagtacagtgagtgttctaggcctgtgcagcctaagtgtgtagtgttgataaagtctacagtagagtacagtgagtgttctaggcctgtgtagcctaagtgtacagtgttgataaagtctacagtagag

SEQ ID NO: 520491 - DNA, 925 bp, Homo sapiens
acggcatcgctgggcgcgcgcggtactttattgagtaagctcgcagattcctgtgttgtggaacatcagcgcgggctcacctgggctctcatcgggactggttttaccaagcgcacaaagtcggactgttcccaatggcaatcaccggtggcccccacaagtgtgtcgcgccccccgaacttttcgggcgggacccccttttcccggtgtgggttccctcattttccggggcacttaatctcgggacatccgcggatctcaatgggcccagagggcccccggtaacccctgtgcgtacgaagggagaatctccccccgtccgatagcagggttgatacccaccacacagtggaccaactacagcgcgaacctaaacagcacccaggacgggctgcaatccaccaaaggggacccctgcccaccttaccccgtcccttgaggccgagccgacgcaacactccccccgcgtgtacgtctgtccacgcagaaacgaagggcgaccccgccactatgcgacccccaagcaccccccttgagcaatgccaccggggggaccacaccggaatccccggccccccttctggtggaagcaacgggtgtaacaccccctcccccagcgtcacaaagttccaagccgctttttatcatgacagcatacttcctgtcatctggggtggagcccacaggtgtctgcgccacaccaaacggagagatctcggatcatcaggacagccccccgtgatggagttcggaaacccaagtagagagtgagcgagaggcaggctcggccgcaagaggaatattatccgggagattagtcttctgttctgtgcaattccggccccctataaccacccaccgtttaccgcgcgattatcttcgccccaccagggaaaaaaaacgtatattttcttccaacaaaaca

SEQ ID NO: 520492 - DNA, 101 bp, Homo sapiens
gtttatgttactgtactgtactctctgactccttactaacaatgaattgttacataatcttctacatgtatgattgtgccactgatcttaaacctatgatt

SEQ ID NO: 520493 - DNA, 995 bp, Homo sapiens
gagagtacttcgagtctccctttcatcatttccgggggggagtctggagacgacgtggagaaatgggaactcgaaaggggaaggaaaagaaggagagaacagaggtctattagagctcgggaagctcagaggtgggtgtaagggagaagaaatggattttgggtgggtttggcactatttttggcattcttcaatggaaacattttggtccatggtctactgtgaatctttctgggcaaaggaaaacacttctgtgccggggtgtaatggggtggggatgtaaggggtaaagaggcagagatacggagaatagtgaattcttcacacactatgtgctggctattgtgttggggctggaccagaggatgtgtgtggcccagagagaggtgtgcacagggagaggctgggggatatctaagccgcggcctatcaacaaatctacaaagatctcggggcgcacaaaaggagaggagaaatataggagacacatagaaccgcctgggagacctggggggggccaaggtctggggcctctacgatagcgccttgtgccgggtcccggggtacatgagagaatctggggcgggggagattgggacggaagtgtgtcaagccaccaaatatcgcgctctttgagcaactgcggcactctgcgaagggaagacggggggggggtctgcgccggggtggtctgcggcgggctctgtggtggaaacccaggacatttccctccaaaacgtatttttagctggctgctacagtacgaacgatggcgcgtcttcactggtgtttcaaacacagcaatatcaagacaaaacaaaggggggggggggccagcgatacatcaaacaagagaatttcacccttcacggagggggggcgccacccacgcacgtttaattacgcacggtttacaccccacgggatgtatcgttcggggacaccccacaaggaggtgggcccccctcaataaagatgaaagggcgggccattaa

SEQ ID NO: 520494 - DNA, 109 bp, Homo sapiens
agataggaatataaacatcgattgtattcaagttaaacattttatttacgaaaataggcgggaggaaaagggttgcgcccccacattctctcccgaggtgatcttctga

SEQ ID NO: 520495 - DNA, 1175 bp, Homo sapiens
atcctgaaacaagggctgagaaaacctcatagctccagctgagaggtagtagtggatttgccatttttaaagcagttgcctacgaaaaaacgttgaagaatatgcagcagacactatatgtggccatgtcaagcctagcaatatctactaaaatatttacacgaaaacagtttgctggtccttgtgagaacaatgcagttcaaaaaaggatacagaccgaagcatcctcttacaatcacggaatgtagtttccactctcgtgggcaccgaacaagatggacaacgagaagtaaccaaacttcaactcttacaagtatctgtcgcaccagaactttcacttcggacttagttccgtcctaagattatttatcaacgatgacgtccggaacagcaaagccacgaaacctgcccactcacccaaaacttgtttaaaaagagaccactcaagggagcttcattatgccgtatggcacgatgtctgcagctcgcagcaaatcacattccagcagaaggtctcgcgctcggtgcaagacagccaggcgcttactctaacgagatacagggcgccctgagcagacaagccagggcaggctcttcatccacgagcaagacttcatacccacagcaagctgaccccacgaaacgcgcagactacacctcctggcgctacctagatacgcccacacagccaactcggacatagggcaactggccaaaacagacaacatccagcggcaacccgcatcgggccaccacaccagggcagcacaccatgccggcaactaaggcaggcctaaagtaacccaaataggccacacactatgggccctccagcccactaccacacaacccgccccaccacggagcgtaggcaccctaggaacagtatccagaaacgccccttgcggaaacttacccgtcacaccagataaacacaaaggagaaagagtacacacagggccactataagcccaggatcaactcccaaacacaccggcgccatccaccccccctcttcccacggcgaacccgtgcaaccgtcctccatcgacgaacgcacacctagagcgcacaccaaccaacgcaagacggtcaataatcaccaatcaatccgaccatacccggtactaacaaaacgagctcacgatagtatcgaatcacccatgacaccatac

SEQ ID NO: 520496 - DNA, 100 bp, Homo sapiens
cgtaaagaacgagggtcaagatgcccccgggacaaatacggtcaacggtattacttatctctctcaaatccatcttttccagttagcacctagttctaat

SEQ ID NO: 520497 - DNA, 282 bp, Homo sapiens
  misc_feature (280)..(280): n is a, c, g, or t
caggcggatcacctgaggtcaggagttcgagaccagccaacagaagaaatgtttaacagttcagttcatattactttaatgccttaagtactgggtgagagaatggaagaaaaatattatatgaagcagtaaaattataatgaaaatatccgaaagtggcaggggaataagatcaggttatggcaaattatgagatacatgcatctagtcactgggctgcaggggcaggtagtaaaggtttttacaaacatctactagcaactcacaggcacgacatgtncg

SEQ ID NO: 520498 - DNA, 529 bp, Homo sapiens
gtgttctttggggatggggaatttggccgggtgtcgtttggcgtggtatgctggtgcctagggcctgggccagctggctctgtgctgcggtgctctggttggccgaactgcgatggtgtagtgccgagctagcgtgcacgcgagccgtcggcacggcaaacgccgtgttgggccgagacgcactagccatgctgtgacgcgtggacctgcaagcgaacgaactagcctgtggggacgcacggcatccgtgcaagctggtgggagagcgtccggacagccagggctgcactcctggagcagtctggtccatgtacgacaatttacgtggtctgtaggagatggaggacacggctgcaggaccctggagaaggagcaagccatgccctgagggtcatctcctgaggctcttcctgctgctgctctacctggacgaccggcctacgaggcaaccctggggcccaccagcgcctgccatgctctcaccatgcatatcctaggtttgaagagatatacacagatggcatactcg

SEQ ID NO: 520499 - DNA, 234 bp, Homo sapiens
tcttaccacaaatttaatatcaccaccaaccacgccccttagagataccaaaatgatgtgatttcaaaaagcaaataaagcaaattcaaaagattttcttatttgagtgcaaaatgggtcataaagcagcagagacaacctgcaacatcaacaatgcatttggcccaggaactgctaacgaacatacagtgcggaggtgtttcaagaagtttgcaaaggacatgagagccttca

SEQ ID NO: 520500 - DNA, 107 bp, Homo sapiens
atcatttgcaggataactgccactaacaaaaaggaatgatctgatttagaaaaaggatattcgtgttggcaaattaacatttgccttcttccttcctttataaattt

SEQ ID NO: 520501 - DNA, 525 bp, Homo sapiens
tcaacatcctcatgtttcccttgtctttcccttgtaggacttataactcaactcattttgctttaacttaaatggaatttttccttaagtttctagatttgtggaattttatttttttgtctgttactgatttctaatatttttacattctggtcagagaattaaattactatgatgttaactcttctgagagggaaatattagttcttaaactacaattatcaatctatctgtttttgtcaattgttgctttatgtgttttgaggttcgctgttaggtgcatacatgtttaggttttttgccttcttgatcttttcctccctttaccagtatgtaacatccctcataacccctcatgttgtatttcaccaaaaaacctattttgtctgacatgaaaattgctataggccgggcggtggctcactcctgtaattgcagcatttggggaggctaaagtgggaggatcgcttgaactcagaggttccacaccagcctggacaatgtagtgagacatcatctcaaaaa

SEQ ID NO: 520502 - DNA, 722 bp, Homo sapiens
gaacaatctgttcctctggctctccacagtgatccagtactaagggacactatctgctcctattcagtgatggagctctgcaccaaaggtcttgggaaccaagaggaagtgctaaagaccacagggatcaacctctcctgcgttcggacctgagaggtggtgtcgaatgagaggcaccacgttgcactccagcagtccttctctaagctcttcaaagacatcgggctgtacccgcgggctgtcagcaccacttttggatcaagagtcaatgtggcaatatgtttacagagaacctcaacgcctgatgcgactactgtgtatgtggttctgtaatcactctcacagtctggaaagattttacctggagtgaaagtgggtattgctaattctgtgaccgagccaggtggagactctcaccctggagagatattggtgatcaagagccatacagccagcggctactacaccatatatgatatcgagactcttttagctgatcatatcaacactactctcagatttggagatgcagctcagacactctgggctctgacaggataccttggttttgtgcgccggaccgtgctcacagcggacactggagagagtatgatgcactggatgtggtgggagcactggatgcactggagctgataggatacgatccacccactagatttgagactccgggtccggatcacagatgattgtgatgtgccggt

SEQ ID NO: 520503 - DNA, 284 bp, Homo sapiens
gggggccccccccccgggggtccccccccggaggggggggggccctttttttttgccctggcccccggggggttttgaaggattcggggggcccccccccccttttttgtttggggggaaaaaggaaaagggggtgggtttcccctttggggaagggggggggaattttttgggggcccccccggggccctttttttggggtttttttcccccctcccctttgggttttttttgggggttttttgggggggggggggaaaaaattttcccgtttggggccccca

SEQ ID NO: 520504 - DNA, 628 bp, Homo sapiens
  misc_feature (103)..(103): n is a, c, g, or t
gaatttgacctgctgcgggaactcccaggagtctcataaacacactgtccatcaagattgggctactgtaggaaagactgatcggctcagcccttttagtttnattgtcagaagtgccccaacagggactgttcctcatatccgaataagccgggaaacaacacgtgtatcccagatatcagtggtgttactatcggccagtggatggtccaacgccgcaatatagaaggcactgtgtccgtggacttctctccagcattaaatacaattgttttgattaacagactgaaacttctatacgtgctccatgtagaatagcagcagaattatcgtctacaagaacatgactgaattatatcaatcactagccagcctattacctttccagctatccttctagatggcatgccatccatacatagtgccgtctccgagactttactttgtgtaacttacgtcacccatcacggagatcttcattatgtgcattacgttccatacacgtttacccgtatcaggcatcgctttacggcatgtcataattcaatcattaagcaacacatgctttatgaatagtaaacaagtctgaatcaatggtggggcaaaagtcaataggagtggggtcaac

SEQ ID NO: 520505 - DNA, 366 bp, Homo sapiens
gtgatatagaaaataaactttatatatatgtgtctcagagatgacactgtgcaacactcacagatttgcatacaatacaggtatggattggctattcacaatttacaggagtggtttttcctcttggaaaatataagtaccaaagctaagtaaacaatgagggactggcatttgggaatttttacatggcttagcttaaagaactcggctttagcaaatattcaacagatcaacctggataaaatagtcaattaaatgctctaatttatcagaaaaaatctcactaagtttcacctcaaaatgtattgcgcaagtgtttttaaaaaatcacccttaaaataaataggaaaggtaagccggtcttta

SEQ ID NO: 520506 - DNA, 376 bp, Homo sapiens
  misc_feature (1)..(1): n is a, c, g, or t
natctctgcaggagagagaactggggagtctgagctgagcagcgaatcaacatgttcgtccaccaccccgagctggctagagcccctcttcccatccaaagctaaatattaaaaattcccttacgttcggaaagaatgcacgaatcatgctcactgcggaactggcttcagatccctcgcagatgcgggttgggcactgtgagagaaccggagcaggttcccaaaacgaaggctatgatgggggttcgtgctggggcggacgaagtgggactgaggtgggtaaggagagaccaaggagaacagtgcactctggagacaggcaggcttggagaaactggggcaggggaaaatttcacactcacagctataaatagtc

SEQ ID NO: 520507 - DNA, 101 bp, Homo sapiens
aacctctagaggaccccggttagttgtgcataaaaatgattacggatactagtataagagatcaggtcgtcctttagtgttgtgtatggttatcatttgtt

SEQ ID NO: 520508 - DNA, 198 bp, Homo sapiens
  misc_feature (37)..(37): n is a, c, g, or t
  misc_feature (73)..(73): n is a, c, g, or t
  misc_feature (122)..(122): n is a, c, g, or t
cagggggcccatattttaaaatttccaaagttgcttncatttagattatccagcccaatcataaagtgaatgncaaaccctttgaatgaaattgtggcccaaaatctgttcaggttggtgtnccgtgtaaaatggggatggggtaaaaatggttaacgtactgttggatccacaaataaaggttccagttttgtaaga

SEQ ID NO: 520509 - DNA, 195 bp, Homo sapiens
ttggggatggccctccccacccgacaaaaatgcaggggccagggaagcccagcgctcggtgccctttgtccagggttaaaatcggcctgtggggtgtggttaaaaggcaggttgtgcgggtgttgaccgatgtattttttccttaaagttattataaaaatgggtaatttgtcaataaagcattcctttggggga

SEQ ID NO: 520510 - DNA, 114 bp, Homo sapiens
atattttctacctaaggtttcttttcccttggtatgagatgtaaaatgatacccagattccggtatccaattaacattatgctggcgggttcgatcagcccggtgggaaaagta

SEQ ID NO: 520511 - DNA, 495 bp, Homo sapiens
  misc_feature (1)..(1): n is a, c, g, or t
  misc_feature (30)..(30): n is a, c, g, or t
  misc_feature (37)..(37): n is a, c, g, or t
  misc_feature (110)..(110): n is a, c, g, or t
  misc_feature (156)..(156): n is a, c, g, or t
ngtggagacactgccacttgctgtgccaantggaacnccggggataaagtcagccatgggagcactggggcggtgccagtctagagctcctggaaggtaaagtccttccnggggtggatgctctcagcaatgtttagtattttctttcctgccttnggttcctgtgctcctaagtcaacctagtgttttccacatctccatttggtgttagcgcaagattcagctagtggctgagatgtggcaccaggaacccttaaacagttcacagcatctcagctcgtctttactgcatcaggatttgtctgtgttcttcaagatcccatttaaattccttagtgactaaaaccattgtgcattgtagagggcgtctatttatattctgcctgagaaaggaagtgagctgtaaaggctgagctctctctctgacgtatgtagcctctggttagcttcgtcactcactgttcttgactcagcatggcaatctgatgaaatccc

SEQ ID NO: 520512 - DNA, 468 bp, Homo sapiens
  misc_feature (12)..(12): n is a, c, g, or t
  misc_feature (153)..(153): n is a, c, g, or t
  misc_feature (222)..(222): n is a, c, g, or t
  misc_feature (386)..(386): n is a, c, g, or t
  misc_feature (447)..(447): n is a, c, g, or t
  misc_feature (452)..(452): n is a, c, g, or t
cggggcaaaaanggtgaggactcagaacgcagggagaagccggcacaggcccagaggatgaggggctgtgggtcagagaatggcgggaacctccccaaatcccaagttccctgaggccagcccagggccagccttgtgtgcgggtgtttctgngaatggcgcgtctctgcatgagccttgtgtgtcatgtgcaagagtgtgtgttgtgtcctatgtgtgggngggagctgccggcggtgcatttgtgggggccgagggcagttcaggatgtgccattagaaccacgtggctcctgaaagcaagcccgtgattaccagagatacctggttagtagcatctatatctggattagctgtacatctcttggacagttcttttttaaaagncatggagtggaagaaagacataaacttccggattttgcgtaagtggagcttggccaactanggganacactggagttttatt

SEQ ID NO: 520513 - DNA, 166 bp, Homo sapiens
cctgcacttgagccaacaagtgtgtgtgtgtgtgtgcgtgtgtggtgacgtgtgtgtgtgtgtgtgctcatgaggctgattccatgtttggatttttgttccttcggctgtgtcatcaattaagctcggccatttcggcgtatcttctccatcttcatcaccatcc

SEQ ID NO: 520514 - DNA, 700 bp, Homo sapiens
  misc_feature (378)..(378): n is a, c, g, or t
tggttagaacacctcagcaaaataaaattccggtttatggtgggacaacttggtttcacacatacttcaaacgggccaaaaaaattaaacagcaatttcttagacaaaaagggaaaaaaaaggaaccctttatcttgggcctttttaaaccattcttcatacaaaccaacttactttatagtatacagcttaagttacattacacaaaaaagtttcactgggaagtgctcggaataagatttggtttccgtgtggctcatttgggccttttttaacagggtttttttccctccttggaggattataatgcaactgtggttcacaccacaagttaaaagctcagaagtttggcacagagaaacgcgtccgaaaggcggngttgggctcactccggaggactcctcttaacaaaagggggtgttgaccccttcaaacaaaaaaaaaacgaacacaacaacaaaaaaacaagaagaagaaaaaacaaccaaacaaacaaaacaaacgagggggggcggcggcgcgctacaaaaagaaaatcaccccgggggggggcgcaccaaaattattagaacgctaccccccggtttttttgtagaaacaaggggggcgccccaaaaagagggaggggaaaaaaaacgagcaacggccgggcccggaaacaacacgtgcgcgcgggggaaaaacacgtcagggcgccttc

SEQ ID NO: 520515 - DNA, 175 bp, Homo sapiens
aagacctttccctctccctcgcccctagaccaaccagtactaccaggtcccacccttggtgctgccttctcttcccacagcctctaactcagtgttttgtacttccctgaattgtgatggctagacacttcctggatagtttgtggacatcatccaattaaacatactgcttaac

SEQ ID NO: 520516 - DNA, 206 bp, Homo sapiens
  misc_feature (13)..(13): n is a, c, g, or t
gcaagtagccggnaattacaggcatgtgccaccatgctgggctaatttttgtatttttagtggagacggtgtttcaccatgttggccaggctgttcttgaactcctggcctcaagtgacccgcccacattggcctcccaaagtgctgggattacaggcgtgagccccgtgcccagcaaggattgctgttttaattcttgtatcttc

SEQ ID NO: 520517 - DNA, 1742 bp, Homo sapiens
gcacaggtgtcgtgctacacgtacccctaacagccaacacgagataccggcaaacgcctcatatcaacaatagtgcggtcatacgcacacgtacgattcgtggcaagtccaccacatagctggccactctgactctataacactgcggtggcatcgatcaaaacgaaccagttcgaaacaagtttgagaacggaggctgctgagatggggaaagcggctcctatcaagatatggcctgggtctagggataaaacgtgtagaaatctgaggcgtgacacgtggtgatcaccaatctgatactcgtcgctatgtaggacacctttgagaaccagtcccgatactactgtgagatatcaatcgagtgccgccaggaagacaagagaccttgtatcacaaaaaagcgatgagttagcaagaggaccaatctacacgggcgtgaccatgatgcctgatctctagacttcgctaggacgtgctggagtagattccgactcgaacatatcgacaagcctgggctacttcatccgaacgacactggagccagaccgccagacagacgcgaaatgaccgcatatcctagggcctatagcaacacacatagagacatagacagaaaacgcagaccttcacattacgcctccgggagagctataaaacagagaacacaagggggcagttcacacgaaacctatggcatgcgacgacacaccgaaacacaacggcacaacagagagaccacaagcaaataactgcaccggagcacaccacactactgcactgtccacgggcgacaacgagatttccaacgcccaccgtgccacacagcccaacacgaaacagccaagatggggccctacccgagaaagccccatgtaacaacacaggaaaaacccacatttcactgaatggcccatcaaatttgatcaatagcgcttaatgggcaaagtttgagatagacccgacatcaaatatgcttaaggacaaagcacatcaaaggataggattgcataccgacatataggcccctactggtgcaccaccaacacaggcgacgcactcagtgcgtacagatgatgctaccgcccctcctggctaacccgcgactcatgagcacaatttgcgcgcaaataaccaggaaggaaccacaagagcaatgagctcttaaggagcaacaaatcgtcccaagaacactttcgtagttcaccaaacagtccaaccgaaacaactgggtcccagacaaggacgatcagagccacattatgcgccacagggcaccctctccctagggcaagctcactacccaacacacctgggcgtgggcaacaacgcgaccacacaaagacaccgccggaaccatggaccacagacgatacaaaagccctgaagcgggtcaccacaacacccacccggaaaacggaggaacaacccataggcccctgacatcaaagatcacaacacagccacataacaacctgaatcaacacaaccagagcagacaagcaagaacatcaacccagcgcgacacagaacgtaccatcaaatcacaatagtatacaacgataacagcacacctacaacgctagtcagacaacaaataacaccatacacagagccgcactcacacatcacctagtaaacaaaacgcacaaatctagacacaactaaccacagaacacaaagacagaacaactcgttactagctagcatgctagtagactatcgtctcgctcactccagcaacc

SEQ ID NO: 520518 - DNA, 164 bp, Homo sapiens
ccatagagttacccccaaataagtgaaaagcgctcgacgtaggggtctggaaagaagaaagcaaaaagcagcctattcacgctcacagactaaaaatgtaggctaaattgtaaacctgctcaaagaaaattctagaaaggccacctccccttctgtcgtcttct

SEQ ID NO: 520519 - DNA, 409 bp, Homo sapiens
tctagaggatccgaggagagagactgattgagtggtctcatctgtctactctggatctggatcatggcttcgtggagtgatcctcataaagaaggctggagatggatcaaagaagatcaaaggctggtgggattccatccacgttgtagaagtggcggagaaatcccgggggtcgcaccgcccattacaagttgacctccacggtgatgctgtggctgcagaccgacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcca

SEQ ID NO: 520520 - DNA, 239 bp, Homo sapiens
gtacttaggacaaatgatagaagcatggatcagggtgtggcacagggacttgtcaggtacctagctttgacgtctgggcgcaattgaagcaacttccatcgtgaatctttataatgaatgactgtggtgtatagtgcagcgaacaaatagtgctcctagttaagtatttgtcagcatccttttgtctctaacgtgtgtctatttgtacagccacgcaattcttggcacgtgtcttaaga

SEQ ID NO: 520521 - DNA, 196 bp, Homo sapiens
aattgtctcctgttgcccgaggatggcctcttgatctgtccataggccatgaacttaatagctgactcggggacaatcttgagtacattaataccattgccgtgcaaccagtgagcgaatacctccctcaagaaccatgtttcgaagccccctgaggatgttcagcgggttgatcctaagaggctattggagctag

SEQ ID NO: 520522 - DNA, 461 bp, Homo sapiens
  misc_feature (41)..(41): n is a, c, g, or t
  misc_feature (89)..(89): n is a, c, g, or t
  misc_feature (118)..(118): n is a, c, g, or t
  misc_feature (443)..(443): n is a, c, g, or t
  misc_feature (445)..(446): n is a, c, g, or t
cccctgccttattttaaaaaaatcaggcctggaacacgggnttgtacgccctgtaatccctagcaagttgggaggcccgagaacggggnactgcttgaagtcctggcaagttccaagncccagtctggacaacaaggcaaaacccccatctcccacaaaaacaaatagaaaaattagctgggcatggtggtgcatacttgtaattcccagctacttgggaggctgaggtgggagggtcacttgaaccccaggaggcggagactgcagtaagccataattgcaccaatgcactccagcctggacaatggagccagactgtctctcaaaaagaaaaaaaaaaaaaagcagaaagaaaaaaaaattttttttgtagaaatggggtcttgaactcccggcctcaagagatcctcccacctcagccccccaaagtgctgggattacananntgagccactgtccca

SEQ ID NO: 520523 - DNA, 81 bp, Homo sapiens
ataaagtgctttattggttaaaaacaaatacacaagaatgccctaaagaaatttcagtattaccccttctgtcgtcttctc

SEQ ID NO: 520524 - DNA, 298 bp, Homo sapiens
tcacgtccagtccatgtaggatggtgtcgtagacagaatgactatgagatccgagtgatattacatagaaactccttatgttagtgcaaagttgagtaatttattaatgtcataggatcatattagcgataaccagattcagaatccaaagactatattctgactctatctagccactccataagtttaatccaagacctcatggaactgattggatctcttccttgcatcatccaaagatcttcctctctctaccaaccgtagaaccactttttcccatcgactatgtacactgata

SEQ ID NO: 520525 - DNA, 281 bp, Homo sapiens
gatctcctgagcagctgggatacaggcatgcacaccacacccaaatactcttctatctttagcaggcacaggatttctccacattggtcaggctggtctcgaactcccgacctcaggtgatcctcccacctcggcctcacaaagtgctgggattacaggcatgtgccgccacgcccggcctaattttctaattttttttttttaacctgaagaaggaccccgcgtcgtcatcggtgcctacttaccccattacggacctgcgcgtctagacatcgtgggac

SEQ ID NO: 520526 - DNA, 564 bp, Homo sapiens
  misc_feature (544)..(544): n is a, c, g, or t
gagcgcgggtcaaatcgcttcgcttcgccttgggtattttgagttctgtgcatccccatctgttacagtgcacatgcaaacaaaagaacactgtgcttggcgaccacttttttcccccttttaataatggtattgagagctttaagtctaggggcagatttggaagctgtgtgtgggagacagtcacagatgggacagtacagtttcctcacttaatgcttctgtgccagcataaaattatcagagggacttcagttgaggttaaagtcaggatgaatttcctggctggatactatcctagaattttccgtatagttaaaacattaaacagttccatgccatttggaagaaatttgcctctggcgttggcatttccttcattgtgggtggtgggaagcctgttcagaggcggggtcctggaggtactggttgtcttgtctagttgtgcagcttgtgtgtggactggtgcccttattgctgaagagggggtggtacctggcaatggaggacaacctcacttcagctgcagggcagagacttggantgtctcatccctttggttgt

SEQ ID NO: 520527 - DNA, 289 bp, Homo sapiens
  misc_feature (208)..(208): n is a, c, g, or t
  misc_feature (238)..(238): n is a, c, g, or t
  misc_feature (281)..(281): n is a, c, g, or t
aaaaacacaaaaattagccaggcttggtggtgcatacctgtaattccagcactcgggaggctgaggcaggaggatcacttgaacccaggaggtggaggctgcagtgagcctagatggtaccactacactgcagcctggggtgacagagtgagactctgtctcaagaaagaaaaaaaaaaaaaaagaaagaaaaagagaaagaaagaantaaggttcaaaggccgggcatgatggcttnacacctacaatcctgggcatcattagggaggcccagggcggcnagttccac

SEQ ID NO: 520528 - DNA, 806 bp, Homo sapiens
agcgggctgaggatccggaaactgcgccgcagagtggtgcggcccagaggaggccgccgggcctgggaagggccgggctgggacgggaaacgttagtggcagctggccccctgtgggtgatggtggtgcctgagctggactggtgcatgtggcccctgagtgctgaactcctgccctgtgatgagtgaatcaaatgcatgtggtgtgcatgtgctgctgtgctgtctcccagctgcatgcttggcatggttgtgtgcatgccctccttccctgaatgcttctaggactggaatggccccatgtgtgttcccctgatgattgccccaaaccacagtggctgggtggttgcactggccacctggccctcgtggatgaatgtttggtgctgtgcccctggtgctgaccaccgtgggacagaagtaggcctagcggtcagtgttgcagcgctgtgtcttgcttgatgcacacgattgtgggtacgcacctgtgaacccccttgtgaacctgcaaaactcctgattcgccttgttccccagtcaccctgaggcgcttccttttctcctgatatttttgggccccgcagacgccctgaatgccaattcatcacgcgattgcaacttgacaaattgaaaccgctggaggttccaagttaggcgggacttgggaaggcaacgccttggacttcccataccttcgtggtgacagccaatggccctatggccaaagttcctcacgggcacgtcagccctggcgattttggggttgccctacacaccaacttcacaaagtgccatccctggcccccg

SEQ ID NO: 520529 - DNA, 1210 bp, Homo sapiens
  misc_feature (322)..(325): n is a, c, g, or t
  misc_feature (327)..(327): n is a, c, g, or t
  misc_feature (330)..(330): n is a, c, g, or t
  misc_feature (352)..(352): n is a, c, g, or t
  misc_feature (356)..(356): n is a, c, g, or t
  misc_feature (362)..(362): n is a, c, g, or t
  misc_feature (369)..(369): n is a, c, g, or t
  misc_feature (373)..(373): n is a, c, g, or t
  misc_feature (396)..(396): n is a, c, g, or t
  misc_feature (431)..(431): n is a, c, g, or t
  misc_feature (476)..(476): n is a, c, g, or t
  misc_feature (515)..(516): n is a, c, g, or t
  misc_feature (518)..(518): n is a, c, g, or t
  misc_feature (567)..(567): n is a, c, g, or t
gcttggaaagatggcgtcccgcaaggaaggtaccggctctactagcacacctcttccagtctccaccgcacggcgcagcagggaaaggactaaaggcaaaggcggactcgggagaattcaggccggtgaagcaagtgcagatagatggccgttgtggtattaaagataatcaaacattatcaagaagaaggacaaggaactgaagttgtacaaggagtgcttgtggtgtctggttgtagaatgatcggcttgacacattaccaacatgctttccatttgccctacaggcacacagacggatgagtgctgacatttgatggannnntncantatccgatggaaatgctgcggngcgnttcgcnatgtaancatngatcatcttcacgtgggctggtntcagtccacatactatgtgctcattcgttacccgngcactcctggactctcagtttagttaccagcatgccattgaagantctgtcgttctcatttatgatcccataaaaactgcccanngntctctctcactaaaggcatacagactgactcctaaactgatggaagttngtaaagcaaaaggatctccccctgaagcattgaacaccgcaaatatcaccttttgagtacatgttctgaagaagtggcgatccgcacttacacaattcacatctgatcactgtccttatggtgggaacttggaaacagcaagttcacggctgtgtgcagatcaaccctgcacctgctccagcctaggccaggcaccccatcaatttggcgcggcaacacatctcacagttgcctgatgcgaccccgaccgtgccgacatgagccccgataaatcgctccacaaaaccacatcatcacaggacacatccacgcacacaaacacagcgccggcaaacactaagcactagaaaggctgccacgagccggcgaaactgcaggcccgaagcgcagcgaaccccggcacccgaagagggacacgtgcccaccccgtaaccacaacggcccccgtacagcgggacgacccgcccactagagggaacaaaaacaatggccgacacagcagatagtcgccccaaggacaagccaccgcccccgcaacataacaacgcaaagatagccagacaagcaacccgtaccgcaccgagaaaccgacaacgagcagatcgcgcgaacacaacaacaaaccgccgcgcgccctacagat

SEQ ID NO: 520530 - DNA, 596 bp, Homo sapiens
agtgattctagaggatccctgagagacgtgtagcatgcctgtaattataagtgtggtatgtgttacatcatgcataactgtctcatttgtgattagttagtaacttatttcaagtacttgtaagctcagtctgcctcagatgtaatcataatagatgaattaaattaatcaaataaaggaacagcaattcagaaagaaacacactttaagaaatcaaaattctcaattcaggcagtctgtatctatcatgaggtattctactcctttagaaattgcagtatcgcccaacaaaaagtgggttatttgcactggtatatggagatgactgaacagatgaaggcatcagatgccttcatcagctggtattttgcctaagatctatttaagataaccttttcttatatttctcacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatccattgcaacacggtctctcagggtaccgag

SEQ ID NO: 520531 - DNA, 705 bp, Homo sapiens
  misc_feature (487)..(487): n is a, c, g, or t
  misc_feature (594)..(594): n is a, c, g, or t
  misc_feature (668)..(668): n is a, c, g, or t
tgtgatgactcatgcctgaaatcacagcactttgggaggccaaggtgagtggatcacttgaggccaggagttcgacaccagcctggccaacacggcgaaaccccatctctactaaaaaatacaaaaaattgccagaagtggtggtgcacgcctgtagtcccagccactctgagactgaggcaggagaatcgcttgaacctgggaggcagaggttgcagtgagccaagatggcgccactgcactccagcctgggtgacagagagaggctccatctcaaaaaacaaacaaacaaacaaaagtgtgcctcttgggctcggcgcagtggctcacacctgtaatcccagcactttgagaggctaaggcaggcagatcacctgaggccaggagttcgagaccagcctggccaacatggtgaaaccgtgtctctacttaaaatacaaaaattagctgggtgtgcttgtgtgtgcctctagtcccagctacttgntaggctgaggcacgagaatcagttgaactcaggaggcggaggttgcagtgagccaagatcacaccaccggacttcagcctgagtgacagagtgagatcctgccccanaaaaacctctcataacatgcattgcggcccgcaattcggggctcactttggtcaatttcgccctaatagtgagncgtataaccattcacttgctcggcggtttccggcgcg

SEQ ID NO: 520532 - DNA, 382 bp, Homo sapiens
tccggtcgcatgttcccaggaggctctatctcttgactctgacactgcctggctcccaaagagctggaatcacaggcgtgacgcaggcgcccggtgaaaaaatatattttctattcattaagtggaagtgaagagatcgtcataaagatcttcgtgttgagaaaggagaggaggaggaagaggagggattgatcttggtgtctcacagcttgatagaggcagaagaaaatccaggagtataagtggacgcgtacagttcaaaccgtgttgttcatgggtcaactgtactttgaaaagtgctccctctggtggctgtggggggtgcagggagaccagaacagtctagatgctggtgctgggtagtggggaaacatggcgaaag

SEQ ID NO: 520533 - DNA, 767 bp, Homo sapiens
  misc_feature (5)..(5): n is a, c, g, or t
  misc_feature (93)..(93): n is a, c, g, or t
  misc_feature (95)..(96): n is a, c, g, or t
  misc_feature (123)..(123): n is a, c, g, or t
  misc_feature (147)..(147): n is a, c, g, or t
  misc_feature (166)..(166): n is a, c, g, or t
  misc_feature (216)..(217): n is a, c, g, or t
  misc_feature (221)..(221): n is a, c, g, or t
  misc_feature (223)..(223): n is a, c, g, or t
  misc_feature (227)..(227): n is a, c, g, or t
  misc_feature (236)..(236): n is a, c, g, or t
  misc_feature (302)..(302): n is a, c, g, or t
  misc_feature (308)..(308): n is a, c, g, or t
  misc_feature (316)..(316): n is a, c, g, or t
  misc_feature (318)..(319): n is a, c, g, or t
  misc_feature (323)..(323): n is a, c, g, or t
  misc_feature (331)..(331): n is a, c, g, or t
  misc_feature (335)..(335): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (382)..(382): n is a, c, g, or t
  misc_feature (409)..(409): n is a, c, g, or t
  misc_feature (412)..(412): n is a, c, g, or t
  misc_feature (437)..(437): n is a, c, g, or t
  misc_feature (502)..(502): n is a, c, g, or t
  misc_feature (511)..(511): n is a, c, g, or t
  misc_feature (516)..(516): n is a, c, g, or t
  misc_feature (539)..(539): n is a, c, g, or t
  misc_feature (607)..(607): n is a, c, g, or t
  misc_feature (615)..(615): n is a, c, g, or t
  misc_feature (680)..(680): n is a, c, g, or t
  misc_feature (687)..(687): n is a, c, g, or t
  misc_feature (744)..(744): n is a, c, g, or t
gctcncgttccctcttggtcaggtggtttgttttagagctactcgatatttataactttttataagccccggtcatttttagaaaacaaaatngnnttgtccaacaaagtaaacaattttttnctgtgtggcagtttctttttttanaaaacactgagctaaaacncagaatgtgtatttgtttggatctgaacccaatcttttgaaatccccccnncccngnaganccctgaagncatttacggggctttttaatggtttcttaaatactagttgtatacctcataatgtctaaggcggcnattttntttctccngnnggtngcatttcnttcngaggctgccccgagtttaaattacaccatagtatntncnttctttcngcccatccttctttctgttttgccgtnttntccaacccgagccatattggtggcncccacgtctgccgttcatgccccccccgctctgatattttatggatacatttgtataaagcaagncttcttgcnctganccctgggtgaccacaaataaatngagaggccatgattattggacgctgagagaaagtagcatacttaaacccacagtacagataatccggnggcaagcnaaaacaaagctataacttggcagtggtattcacccaccacttattccaaaaacatattttgcttnttaaatnaagggaaatatggtccagttttgcaatgttaatagctgccagtctctcatatttttnataaatatcatttcctgactagc

SEQ ID NO: 520534 - DNA, 400 bp, Homo sapiens
  misc_feature (107)..(107): n is a, c, g, or t
agaaatctagaagaatttggagcattatctccactggtactatttagctggactgttaagtattttcttccagaacttaagaaacgccactctgggtcagagagctntggtctgttgtatctctagtcagttcagtaggagcattttccctacaataatggcaccttccccagatgaacatttttgaagatcagaaataaccttagaatctcaggaacatcttctgacattcccaacttccctcatctcctattatatattatttttcgtgaaattccctcttaagctcattgtgttttcacccagttcactagaccaacagcaataccagtaccagagttatgttttagaaagtctactagctgtccacaaagtcgtagttcattaactttgacccaaa

SEQ ID NO: 520535 - DNA, 529 bp, Homo sapiens
cagtccaacatctgtggatatgggtttaagaccctccctaaagagggttccgtcctattccctgagggaaggaatgcccaagaggactggggttcaaggagcttccagaaagctgaacacggtagaggtcaccgggggttgcacccggggaagcatggaagatccatgccccttccccgtacataccttgccttacggtctcttgaccggcatccttggcactatgctttatagtaaactgataaatttaagtgtttctctaagttctgtgagccgctccagcaaattaatcaaacccaaaggggggggggtgggtgtcacacctcatgtagcccataaatacgtatacctactatgtacccacaaaaacaaaacaatttaaaaacaaggagggggccaggcacagtggcccacgcttataatcccagcacttggcgaggccaaggcaggtggatcacttgaggccaggagttcgagagcagtctggccaacgcggtgaaacccctctctaataaaaatacaaacatta

SEQ ID NO: 520536 - DNA, 928 bp, Homo sapiens
gcgtaccttggccttcaatgtgcctgggcggaggttgtggctgtgggcctggctggacagtatggtggagctgtgggcctggcgagaatggggcacggctgactgccttctcttgcccaccatgtgtctttgttgcctcgcgtgcgcctgtttccgtgctgtgtcggggttgccatgtggacgtgacggctggacgcaggactggcatgagtggctgatcgcggtggctgtcggtactatcagacgcgcgatggcgatcagggactctacataaatctcgttcagcgtttcccagtggggcttcagaggtcagggctacttggaatagtcgcgcaggatgatcctgcccatgcggctggctaagtccccaatggatatttggtcgaagtgtgtgcacgaaagactgaggtccatctgcgagaggcatgcgagcagcatcaacggaagtggctaccacttcacggtcccatcctggcatccatgctccaaggagttcgcagaatgcgcttgatgactatgcgcacgtgtggccctatcttcgccaggagagtctccttggtgttctggcctcagtagggaatttcacagatgcatgcctttggccacagggcaagctgctgacagcaggtcaccacaagggcagacagactttccactgtggccaactgagctgccgagggacattgagggcccttgtgagctgctgtagttttcagcactgatgtgaggcagcctggccaccgggggccgggatcagagtctcctcttgctgggcacgtgagggaacatgcaaaaccccgtgttttgatccaacgtccgttccttgcctgtcaccgtgacttgggtcacttggctgttgccttggaccaaaagataacctatcttgatatcctggtccagtgatggtcctgtgggagctctgggaaca

SEQ ID NO: 520537 - DNA, 384 bp, Homo sapiens
gtgccgatatcacatgacatctcctcttctctgatttctccttctgtgtgtcttcttttttagtgtgtatcttttttttggtgggggggacatagtcagtgctctgtcacccagactggagtgcagtggcatgctcacagctcaccgaagcccgacctcccgggctccagcaatcctcccacctcagccccccgagcagctgggaccacaggcatgcaccaacacgcaaggccaatttttttatgttctgtagagacagggtctcaccatgtttcccaggccggtctcaaactcctggactcaagggatccacccgccttggcctcccaaagtgccgagattacaggcatgagttcgagaccagcctgggcacacattatggag

SEQ ID NO: 520538 - DNA, 513 bp, Homo sapiens
  misc_feature (2)..(2): n is a, c, g, or t
  misc_feature (358)..(358): n is a, c, g, or t
  misc_feature (367)..(367): n is a, c, g, or t
  misc_feature (396)..(396): n is a, c, g, or t
  misc_feature (453)..(453): n is a, c, g, or t
  misc_feature (500)..(500): n is a, c, g, or t
cntcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactgggtaaggggaaaaatgcctcaagtgagcatgcgcgcaacttcagtaatcacactgtgcatgcgaccccttccaagtgctgggcaggtcaccacatacgccggacaagcctgctgcaagggaagaatcaggggangatgagacngtaaatcccaggactatgccaaaattacnataaaacccccaagtttaaggggtcaggcagggcactttagatcttctcaaggttgncttgcctgaccccaggtgtagtgtacttccttttggttcctggctcnaaaactttttaat

SEQ ID NO: 520539 - DNA, 196 bp, Homo sapiens
attagatgtctactctggtcctccaaatattttttaccctaaacttaaaatgggctcacatagttacttggtctattgcaccaccatcttctagctttcttcctgagcaggttaagtgtacatcctccgtttttagtagacacctaattcttccgggacctaattacttactcaacctatatgttcttctgtagtg

SEQ ID NO: 520540 - DNA, 225 bp, Homo sapiens
  misc_feature (63)..(63): n is a, c, g, or t
  misc_feature (118)..(118): n is a, c, g, or t
gctcggtacccctgtcgtgcagcagctgatcagccatggtgcgagcgaagggaggaagagcanagggagcgagggtggctgcaccaacgcgggggctgcgacggcgggggtacctccnatgctgctgctgctgctgctgctgctaaggcgcgctgtgcgctatgccgccgccgccgcctgcgccgccgcctgactacgagtaacggcacgggggtccacgacact

SEQ ID NO: 520541 - DNA, 1499 bp, Homo sapiens
tattggagttcgtgaattgctggggttatgttacatgtctcgtttgctgtgtttttcgttgtggcctcttctagtggtgtgattcttgttgtctctgtgttgctgtagtgtgttttcagtgctggtcgtcgtgttcaatgtgttttgtgcttgttttccactgtctccttttctcgttttgtggatctggggatgtcttgttattacgcgcctgggtgtctcacccgttttttttttcttgtttgagttttttgcacactttgggccatcttggtgttaattcgggtttggtactgtctctggcttgctctatgcttcacgctgaatggtgcgctcttcgagtggcctcttctttgagtcattaggcatcgggaatttgaataaatgccgtgttctctccgttttctcgccgtgcacgactagttgtcaaactttccccctactctggtgatggtttgtgggtttttgcctcaacagtctagtgttgtgtccaatatttctatgcgacctcctcctaatttatttgtgtctctcgcttgggcgtcatatactatgtttctgatttgggatgtataactcaggccgttttgcttgtgtatacaatttgctggttgagaatgtttcttgtgatgtgaccccaacttcggggtcataccggcctttgcggcccgtgttttaaacgtgatgtgtgtaatcacgctatgggattgtgttctgctctacgtgtttaagcggtggttgtgtgagagtaatgcttgtgtaaggtgtggtgtaaaggggattatttgtaggctgatgttgtaataagtgtgtgcgccattttgccttaatattcggtgagagtccatgttctagttttttgtttttttgggttgtgatctcgggagaggaacaagtgatgtttgagtcctgtcgactgttttgtcggtagatctcgctcctggtagaaaggtgctagggaacacgttagttgctagtgtagacaccactggcatctggcatgtcagtagtccatcgagcttatgttcacttgctgaccaaggccttactgtagtctgtctgtaagcaggatataactcatccacactatgtctgatccggctacagtgtggagtgaccatctccttgggagcaggtacttctttagatcacgtgcaacgaaggtgcagtcacctacgtgggatggggtgcggctggtagtctggtcggtccgaggtaccctggtgacacttgatcctatacttcggataggacatgtatccctggatggggggaccataggggtcagaaggaggcagacagaaaaccataacattttcagctgacgaaagccgccctccctgctctaagaaggggctccgtgaagttcttgcccagataccgacgctgctctgcagtgagttcgtgaccttctcttcagtgtgctgtaaatctgtaatataccattctctgtggcctgtttttcctggaagaagcgaataacagcttggcaggccatg

SEQ ID NO: 520542 - DNA, 818 bp, Homo sapiens
gggccaaggctcctatgtacccctgacttcggtgacacggacatgcagtgtgagcctctgaagtccgcagtggctacaggattcaaggccagccagcaggacgactccatgcagggtcctgtactacatggagaaggatgctggccaacttcgacccattctcgacctggccccacccagatggccgtgtgtgagctgggaccatgcagctgcacacgtcagcctcaccgtaccacgacaggcacgacttggctgatctcgagcccttcccaggggaccctgaccactcaaccaccgatccggcgactgacgcgagtgtggcgtggaccaacatcccaccccctgggagatcccaaagggggacttggcgaaccaaggcaagcccccgcccaggggcagacaagggccacaggcgagggagctgggcagggtgacgccagaggcaggacgcaccagagagacccacggcacaaccgggtggtgaaccgaccaccatgaggaaaccggaacgcatacaaacaccacagacgcgaaagacaacaacgacaccgaaggttccaaggggcaaggacaagagggtactcaccgcgaacggacgccgtacgacactggagcgtggcgcgacagcggcacggacaatgccctgacgagccacatatgcgacggtggcaccccacacggcacgggcagagccccgacagtcgaccctgtgtgaaccggaacggcttccgtaagctacacgcctaaaaggtcaactagcaatattcgcgaatcggtgaacacttataccaccaagactgccatacaccacgggatga

SEQ ID NO: 520543 - DNA, 859 bp, Homo sapiens
  misc_feature (41)..(41): n is a, c, g, or t
  misc_feature (80)..(80): n is a, c, g, or t
  misc_feature (193)..(193): n is a, c, g, or t
  misc_feature (244)..(244): n is a, c, g, or t
  misc_feature (272)..(272): n is a, c, g, or t
  misc_feature (282)..(284): n is a, c, g, or t
  misc_feature (297)..(297): n is a, c, g, or t
  misc_feature (318)..(318): n is a, c, g, or t
  misc_feature (320)..(320): n is a, c, g, or t
  misc_feature (348)..(348): n is a, c, g, or t
  misc_feature (359)..(359): n is a, c, g, or t
  misc_feature (375)..(375): n is a, c, g, or t
  misc_feature (382)..(383): n is a, c, g, or t
  misc_feature (392)..(392): n is a, c, g, or t
  misc_feature (400)..(400): n is a, c, g, or t
  misc_feature (405)..(405): n is a, c, g, or t
  misc_feature (439)..(439): n is a, c, g, or t
  misc_feature (447)..(447): n is a, c, g, or t
  misc_feature (495)..(495): n is a, c, g, or t
  misc_feature (502)..(502): n is a, c, g, or t
  misc_feature (509)..(509): n is a, c, g, or t
  misc_feature (554)..(554): n is a, c, g, or t
  misc_feature (562)..(562): n is a, c, g, or t
  misc_feature (679)..(679): n is a, c, g, or t
  misc_feature (776)..(776): n is a, c, g, or t
  misc_feature (831)..(831): n is a, c, g, or t
gctcctctccgcagtaagttattccaatgtctctgcaggtntctgatggtcgtagtagagtgtagctcctctctgctggnaggtggtctctgtagctttcagcggagaaggtactcctctctgtagctggtcaccccaccgtctccagctatcagcagagagggtactgctctctgcagctggtcatcctgtnccctcgtctctaccatcttcatcctctggctattctctgggctgctctggntgagcctagggtttttatggacctcagnggggaagaannntgtgctgattggnccattggcaggcccagaaaangntccaagagtatccactctggtcagaagnaatggaagcanagaacccagaattaangaactgnntggattganggtggggntttantggggaggccaccccctttctcctgttgctattnatggttgnaggttttggtttcgttttccctttaagatcagagcagttgctggagtngagagangccaggnagtggaagcagacacccctgagcctgcagggatggagggtgaagnttgctgtncttcctgggatggccgatggtgcaggctacagagatgccctcgtcctgtgcctgggggggcagccacagctgcacctgggagctcccaccccgccaacttggaagaggcagggcttncacttgtccctggctcctgcctgcgcggctgcagctgcatctggaagggcaaattctgcctgttcccggctcccccaggagcagagaggctcggatncacagctgcagtttggggtggctgtagccctgcccaagagggtggggctcctgcntgctccatagagcagaatggctgggtct

SEQ ID NO: 520544 - DNA, 2093 bp, Homo sapiens
  misc_feature (5)..(5): n is a, c, g, or t
  misc_feature (73)..(73): n is a, c, g, or t
  misc_feature (273)..(273): n is a, c, g, or t
  misc_feature (303)..(303): n is a, c, g, or t
  misc_feature (547)..(548): n is a, c, g, or t
  misc_feature (610)..(610): n is a, c, g, or t
  misc_feature (1579)..(1579): n is a, c, g, or t
atagncttatccgcagaggacaccgcgaccacgcaactccccttaaccgctcctcgatcacaacagctagcantgtgatccagacaaagtaggcttgtcacacgctctgtaacagtgctgtcttgaagtatgagccggcatcttacacctaagctcttgccccagtagagtagcctcacacccacgctgctagctcaaggccaacctcatctgttcagaccatctatgtgattgctttcccttaagtgaaatcaagatgggtgcggctctccntcttcatccaggagccttcctggcccctcnctccttaccccaggggtcctgctggccagacacagctggcatctcctagggcttggtggatgccggtggatcctgttccctccaccccctctgctgaggcctcagtcctcccagacctgctagagtggaccccagactcccaggagaccccagggtgcaggagaggggagaaggctggaaaggttgcggggagggagagggctgggccaggagtcaccggggcaggctgggggtcctggcccanncggacccgctgatcatctagttagtgggggaggggcccaccaggggtcggggcccggggcangcctccagggccagacaatgtgtcttcctcaggagtcccagcaacagaggggcctaccagtgaggtcacagagctccgtggtgccgttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactatagggcggtggccgcagggcatggcagactttgtggttccagagcgaaagccccttcacgcagaaagctgacttcgaccaagagcaaaagtggccctcgccagcccactaccagctgctcagccggccggccttccccgccttcagcttcagaggctgccactccgcttccaagacacctgaaggccaacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggcttctcgatgagccgtcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttccnaggcctcccctgggacttgggccccagcctggccttctgaccctctgggcaccccgatgcacccttctggctggccaacccttctatgggctgtggacaaggctggcccagcctggatcccccatctgcccatctccccgctacactgagatgctgttggttttcccgagctctgtggtgtgcagttgtctgtccgtcacccgggggcgggtcctagagatatggctgccagctgggtcatttccggctttccctgttgaggggtctccattcagctgcccctgaagggtgctctcttctctagggtggcagcctgtgactgaccctgagctctagcctggagcgagatgggaggtgggctctgtggacacccccacccagccgtgtcactcaggggcctggtctagctgctgtccacctgagtgtcagctgcttgcacgagccagggaactgggaaggaggcgtcaaatgccctgagccgcacacctccaggtgggtcaggcctggccagacc

SEQ ID NO: 520545 - DNA, 789 bp, Homo sapiens
actagttctagatcggcgcggatgtgctatgctggggtcccagggtggcagcagcagtcagggtcactgtgggagccctggggtggagtgacaaagcgcattgtcctgtgcccgccatggcagaagcgcagcctttgtatggaggcccaatcgcgctcccgtctggagaagcggcttccggggatgtggctgccgggtcggttctggtccacagcacggtgccggggctgcaggttgttgagggctgtgactccgtgggtgctcagccaggctccagcaggtgtcagacgtgctgttgaagagcaaagccacagacgatgacttgtccatactcagtggatgctccatgctgtggctacacagtagtgctgttgacatgtccacgggtttcgcagtggcccggtggccttgggagctgctttctcctccgcacttggcgtgggcgtgcattctggccctgtgctggaggcctttgctttgagggtgctgtgactcggctcttcccccaggccctccccagccgacgacagccaccgggagacggagctcggagcacgattgtctcagatgcggggcgctgtgcggtgacgaacgctcgcagggattctcgtatcggtgcccttggtgactcgtggaggtgccgtgaggcggcggtgctctggacctcggtgtacactgacctttgtttcacttgcctctgtcgactccgacagcaggaaacccggccgtggcctggcagtccgctccatgccgacgctgggtctggcttgtctggagcgtggggccccc

SEQ ID NO: 520546 - DNA, 2062 bp, Homo sapiens
  misc_feature (5)..(5): n is a, c, g, or t
  misc_feature (73)..(73): n is a, c, g, or t
  misc_feature (273)..(273): n is a, c, g, or t
  misc_feature (303)..(303): n is a, c, g, or t
  misc_feature (547)..(548): n is a, c, g, or t
  misc_feature (610)..(610): n is a, c, g, or t
  misc_feature (1006)..(1006): n is a, c, g, or t
  misc_feature (1076)..(1076): n is a, c, g, or t
  misc_feature (1078)..(1078): n is a, c, g, or t
  misc_feature (1081)..(1081): n is a, c, g, or t
  misc_feature (1083)..(1084): n is a, c, g, or t
  misc_feature (1089)..(1089): n is a, c, g, or t
  misc_feature (1098)..(1098): n is a, c, g, or t
  misc_feature (1548)..(1548): n is a, c, g, or t
atagncttatccgcagaggacaccgcgaccacgcaactccccttaaccgctcctcgatcacaacagctagcantgtgatccagacaaagtaggcttgtcacacgctctgtaacagtgctgtcttgaagtatgagccggcatcttacacctaagctcttgccccagtagagtagcctcacacccacgctgctagctcaaggccaacctcatctgttcagaccatctatgtgattgctttcccttaagtgaaatcaagatgggtgcggctctccntcttcatccaggagccttcctggcccctcnctccttaccccaggggtcctgctggccagacacagctggcatctcctagggcttggtggatgccggtggatcctgttccctccaccccctctgctgaggcctcagtcctcccagacctgctagagtggaccccagactcccaggagaccccagggtgcaggagaggggagaaggctggaaaggttgcggggagggagagggctgggccaggagtcaccggggcaggctgggggtcctggcccanncggacccgctgatcatctagttagtgggggaggggcccaccaggggtcggggcccggggcangcctccagggccagacaatgtgtcttcctcaggagtcccagcaacagaggggcctaccagtgaggtcacagagctccgtggtgccgttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactattgctggagcaacgccncctgatcacagctgacctggaagtccccagccccaccaggtaccagtgccgagcccgtccgtacgagagncntcncnnacccncactacagnatcggctgcaagcaccagggccgagagggcggtggccgcagggcatggcagactttgtggttccagagcgaaagccccttcacgcagaaagctgacttcgaccaagagcaaaaggcctctttgcaggcacctggcaagagatgccctggccccaacacctacaatatccttcctgggagccgcctgcagagcccccgctcgccggcttctcgatgagccgtcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttccnaggcctcccctgggacttgggccccagcctggccttctgaccctctgggcaccccgatgcacccttctggctggccaacccttctatgggctgtggacaaggctggcccagcctggatcccccatctgcccatctccccgctacactgagatgctgttggttttcccgagctctgtggtgtgcagttgtctgtccgtcacccgggggcgggtcctagagatatggctgccagctgggtcatttccggctttccctgttgaggggtctccattcagctgcccctgaagggtgctctcttctctagggtggcagcctgtgactgaccctgagctctagcctggagcgagatgggaggtgggctctgtggacacccccacccagccgtgtcactcaggggcctggtctagctgctgtccacctgagtgtcagctgcttgcacgagccagggaactgggaaggaggcgtcaaatgccctgagccgcacacctccaggtgggtcaggcctggccagacc

SEQ ID NO: 520547 - DNA, 2331 bp, Homo sapiens
  misc_feature (5)..(5): n is a, c, g, or t
  misc_feature (73)..(73): n is a, c, g, or t
  misc_feature (273)..(273): n is a, c, g, or t
  misc_feature (303)..(303): n is a, c, g, or t
  misc_feature (547)..(548): n is a, c, g, or t
  misc_feature (610)..(610): n is a, c, g, or t
  misc_feature (1111)..(1111): n is a, c, g, or t
  misc_feature (1181)..(1181): n is a, c, g, or t
  misc_feature (1183)..(1183): n is a, c, g, or t
  misc_feature (1186)..(1186): n is a, c, g, or t
  misc_feature (1188)..(1189): n is a, c, g, or t
  misc_feature (1194)..(1194): n is a, c, g, or t
  misc_feature (1203)..(1203): n is a, c, g, or t
  misc_feature (1817)..(1817): n is a, c, g, or t
atagncttatccgcagaggacaccgcgaccacgcaactccccttaaccgctcctcgatcacaacagctagcantgtgatccagacaaagtaggcttgtcacacgctctgtaacagtgctgtcttgaagtatgagccggcatcttacacctaagctcttgccccagtagagtagcctcacacccacgctgctagctcaaggccaacctcatctgttcagaccatctatgtgattgctttcccttaagtgaaatcaagatgggtgcggctctccntcttcatccaggagccttcctggcccctcnctccttaccccaggggtcctgctggccagacacagctggcatctcctagggcttggtggatgccggtggatcctgttccctccaccccctctgctgaggcctcagtcctcccagacctgctagagtggaccccagactcccaggagaccccagggtgcaggagaggggagaaggctggaaaggttgcggggagggagagggctgggccaggagtcaccggggcaggctgggggtcctggcccanncggacccgctgatcatctagttagtgggggaggggcccaccaggggtcggggcccggggcangcctccagggccagacaatgtgtcttcctcaggagtcccagcaacagaggggcctaccagtgaggtcacagagctccgtggtgccgttggggaagagagccaggagactctgatgatgaattctgaccagaaggcagtgaaattcctggcaaatttttacatcaatggaggcaaacactggacccatggtcacctgaggcagacacaaccagagcccacccagcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactatgtgagtgagggtcctggccaccccacccccaagctggtctttggggggctgtgggaggggcccgctgaaaggagcccaggcccagagcttgcttcctgtggccagtgctggagcaacgccncctgatcacagctgacctggaagtccccagccccaccaggtaccagtgccgagcccgtccgtacgagagncntcncnnacccncactacagnatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggccggccttccccgccttcagcttcagaggctgccactccgcttccaagacacctgaaggccaacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggcttctcgatgagccgtcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttccnaggcctcccctgggacttgggccccagcctggccttctgaccctctgggcaccccgatgcacccttctggctggccaacccttctatgggctgtggacaaggctggcccagcctggatcccccatctgcccatctccccgctacactgagatgctgttggttttcccgagctctgtggtgtgcagttgtctgtccgtcacccgggggcgggtcctagagatatggctgccagctgggtcatttccggctttccctgttgaggggtctccattcagctgcccctgaagggtgctctcttctctagggtggcagcctgtgactgaccctgagctctagcctggagcgagatgggaggtgggctctgtggacacccccacccagccgtgtcactcaggggcctggtctagctgctgtccacctgagtgtcagctgcttgcacgagccagggaactgggaaggaggcgtcaaatgccctgagccgcacacctccaggtgggtcaggcctggccagacc

SEQ ID NO: 520548 - DNA, 1588 bp, Homo sapiens
  misc_feature (13)..(13): n is a, c, g, or t
  misc_feature (368)..(368): n is a, c, g, or t
  misc_feature (438)..(438): n is a, c, g, or t
  misc_feature (440)..(440): n is a, c, g, or t
  misc_feature (443)..(443): n is a, c, g, or t
  misc_feature (445)..(446): n is a, c, g, or t
  misc_feature (451)..(451): n is a, c, g, or t
  misc_feature (460)..(460): n is a, c, g, or t
  misc_feature (1074)..(1074): n is a, c, g, or t
gggctagggacangtagaggggacaggctgtggggcatgtggctgggagcggcgggggctgagacagtggctgctggtctcccttgcaggcccaaggcatctgtgctgttgttgggcccggagccggggatggcctgggatgagacacagcccccaaagatgaaggagatcccagttggcctcaggttacagacgggcaccccccaggagtccctgcccacctacacccagaccctgagggaactatgtgagtgagggtcctggccaccccacccccaagctggtctttggggggctgtgggaggggcccgctgaaaggagcccaggcccagagcttgcttcctgtggccagtgctggagcaacgccncctgatcacagctgacctggaagtccccagccccaccaggtaccagtgccgagcccgtccgtacgagagncntcncnnacccncactacagnatcggctgcaagcaccagggccgagagggcggtggccgcagggcatggcagactttgtggttccagagcgaaagccccttcacgcagaaagctgacttcgaccaagagcaaaagtggccctcgccagcccactaccagctgctcagccggccggccttccccgccttcagcttcagaggctgccactccgcttccaagacacctgaaggccaacccacctagggctgcctggggctagggggctgggcctcagggtgcagccccagtccctgcttcaggcctctttgcaggcacctggcaagagatgccctggccccaacacctacaatatccttcctgggagccgcctgcagagcccccgctcgccggcttctcgatgagccgtcccctgcgttcacctcctggctcagcacctcccgaacccctggcccagccgcctaccacgtggaggactgcaactcacgcttcccttcggcgcctggcgtggtcatccagggtgtacgcagacccaagcgccacgacacaggccccttctgcacgctctagagccagctgggcacaacctgcttggcccggccaccgagtggaaccatggcctcccccggggctttccnaggcctcccctgggacttgggccccagcctggccttctgaccctctgggcaccccgatgcacccttctggctggccaacccttctatgggctgtggacaaggctggcccagcctggatcccccatctgcccatctccccgctacactgagatgctgttggttttcccgagctctgtggtgtgcagttgtctgtccgtcacccgggggcgggtcctagagatatggctgccagctgggtcatttccggctttccctgttgaggggtctccattcagctgcccctgaagggtgctctcttctctagggtggcagcctgtgactgaccctgagctctagcctggagcgagatgggaggtgggctctgtggacacccccacccagccgtgtcactcaggggcctggtctagctgctgtccacctgagtgtcagctgcttgcacgagccagggaactgggaaggaggcgtcaaatgccctgagccgcacacctccaggtgggtcaggcctggccagacc

SEQ ID NO: 520549 - DNA, 661 bp, Homo sapiens
tgcggcgcccattgatggcgagcctggcgctgtgcgagtgtcggagatggcggggcattcagcacctcggccgtcctgggccgcacgtgacacccccgctggggccgatgcccaacagtgacatcgacttgagcaacctggagcggctggagaagtacctggagcttcagacctgataccggcgccgcagcagagcatgtgctggcgcagtgccccagcactggtggctggacctacctgagagtatttcggggagaagacaagatcccaaagagaagattgatattgggctgctccacccaaatgtctcccgtgacccaacagctactggaacggaaacaggccatccaggagcttcgggccaatgtggacagaggagcgggactgaccgactccgcacagccagtgtcccgactggatgccgatgcgggcacgagtgggagaggacctgtgagacacctacacacaagacagcggtctggcattgagtattaccagtgacttcattaccgaggaagcatgtatccactggttcgccacgttattagtgcccccgaggataccaccatagcaacggtgggcttaacgctcgatggagttgaggactgacctggatgccttggtgtacatgtggcaatgaggggtgatccaaaccgacggc

SEQ ID NO: 520550 - DNA, 211 bp, Homo sapiens
  misc_feature (37)..(37): n is a, c, g, or t
  misc_feature (100)..(100): n is a, c, g, or t
  misc_feature (108)..(108): n is a, c, g, or t
  misc_feature (136)..(136): n is a, c, g, or t
  misc_feature (170)..(170): n is a, c, g, or t
  misc_feature (180)..(180): n is a, c, g, or t
cttgatgtatgtccccttacacttggtattgaaactntgggaggtgtcatgaccaaactaattccaaggaacacagtgggtgcctaccaagaagtctcanatcttttntacagcttctaataatcaaccaactgtnacaatcaaggtctatgaaggtgaaagacccctgncaaaaggcantcatcttctgggtacatttgatctgactgga

SEQ ID NO: 520551 - DNA, 295 bp, Homo sapiens
  misc_feature (10)..(10): n is a, c, g, or t
  misc_feature (124)..(124): n is a, c, g, or t
acgggtctantactgtggtgtaccgtgggagagagtataacaccacagctcttcggacagggtcgaggcagcgggacagttggtccactccgagtcagttcggacccaatactcagttggccgngggagctggtcgattttatgtcagctcggacccggtaccgagtcggtcgggatagctcgtggaccccacagctcctcggacctgggtccgacataggccgtaagtgtgggtcgacccggcggcagttgcgacgcgaacaacgttgtcggcctgacgggtaaacacctacag

SEQ ID NO: 520552 - DNA, 160 bp, Homo sapiens
  misc_feature (134)..(135): n is a, c, g, or t
aggtaagtataagttgatgaagtaaacaagggggagtgtgtcctgggcagagagtgggaacagcatatgtaaagcctgagatcaaagaaggccaagtgcagacaaaatgccatgggcacacacacaatgagacnngtggctgaggaagtcagcagtgggc

SEQ ID NO: 520553 - DNA, 120 bp, Homo sapiens
  misc_feature (1)..(1): n is a, c, g, or t
  misc_feature (23)..(23): n is a, c, g, or t
nctctttccctttctcgtccgtnctcgccttctcgttcctttccagctctctctctctctctctctctctctctctctactactctctactacaactctctctctctctacaaaaaaaaa

SEQ ID NO: 520554 - DNA, 310 bp, Homo sapiens
atcccagcaagcaacaccatgcaacaattgttgcaagcagtcatgcccaacagttgcatttggtgcagccaacacattcccgtgctttccgtggaggtttttcacagcaatcgtcctattagctagtatctctcagcagctctcacttttccaacatcttgcacgcactttcaaacaatggtcacatttttatacatagtcagtcatcatcactgtaaggctcaccttcataattgtaatattgcagtaaaggcaatcgtgtgctcaccatccttgcccagcatttcttcttctttgattcttcatcttg

SEQ ID NO: 520555 - DNA, 832 bp, Homo sapiens
gggcccggaaggggctctgcgttcttgtagtggcgctgttgggcccgtgaggattgtaagcctggctggtttgcggctgggaagagcggagagagggttcggcatgtgttcggtcgggatccccgcgaaggatggagtgctgcctgagagtctcacccggcatggggtgaagctgttcatgccttccccgagatgaggatctggtgatctagcaatggggaggcaggagacttgggtaatgaagagagaaaacgaaagagttcttgagacttatgggtgcgggaaatgaacagaacatactggtcgtcttgttactaggagatcacaaatcaacatctcacttccgaaccggggaagaagacccaagaaaacttactgaagaactggagtctcaatatcagcaaagtatggccagtacaacttatcaggaagatatcggcgacattgtggactgtggcttcagtgaggtagaagaccatgatggagaaggtgatgtggctggagatgatgatgatgacgatgattgattcacctgaatcctgaaagtccagatgattcttgaaagcgattcagagtcagagaacagagattctgtgaagaatccaagtgtgagaaccctgatgaatgtggggatcccaaaacaaaaaaggtgcaaaagcaattataaactgtgttctgtaaatccagtgggtcattactcccaaagttaggctttgttttaaagtaagctcttggtcaatgccgtggggctggttgagcagacttgttttattttaaaagctttaaattcaagaggtggttcaatgcggtactttggcgcgtccttggaggg

SEQ ID NO: 520556 - DNA, 212 bp, Homo sapiens
atatctatacacaaaaactaggacattacaagccagctcttactaaaaggattactaaaggatgtacttcagcagaagaaagtggactcagagaagatccaggaacaataagtaggaagcagaagaaaacagacacgctaggaaacaaaaagctaagggccaaatgtacaaacttagaagaaaattggaagatagaaagcagataggtgttc

SEQ ID NO: 520557 - DNA, 324 bp, Homo sapiens
ccccttttttttaaaaaaagggggattttttttgggggggtttttcttttgggggaaaagggggggggcccccccttttcccccccccccccgggggggggggggttttgggttccctaacccaggggaaaaaccccccccccggggggggggaaaaagggttttcaaaaaggggtttttttttggccccggggtttccctttttttttttgggccccccaaatttttgggcggggttttttttttttggggggtttttttaccccccgcccccccccccctttttcccccccctgggcccaaaaaccccaacccccttgggga

SEQ ID NO: 520558 - DNA, 743 bp, Homo sapiens
  misc_feature (25)..(25): n is a, c, g, or t
  misc_feature (31)..(31): n is a, c, g, or t
  misc_feature (60)..(60): n is a, c, g, or t
  misc_feature (62)..(62): n is a, c, g, or t
  misc_feature (91)..(91): n is a, c, g, or t
  misc_feature (97)..(97): n is a, c, g, or t
  misc_feature (175)..(175): n is a, c, g, or t
  misc_feature (195)..(195): n is a, c, g, or t
  misc_feature (197)..(197): n is a, c, g, or t
  misc_feature (202)..(202): n is a, c, g, or t
  misc_feature (246)..(246): n is a, c, g, or t
  misc_feature (264)..(264): n is a, c, g, or t
  misc_feature (299)..(299): n is a, c, g, or t
  misc_feature (317)..(317): n is a, c, g, or t
  misc_feature (323)..(323): n is a, c, g, or t
  misc_feature (353)..(354): n is a, c, g, or t
  misc_feature (358)..(358): n is a, c, g, or t
  misc_feature (364)..(364): n is a, c, g, or t
  misc_feature (367)..(367): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (434)..(434): n is a, c, g, or t
  misc_feature (450)..(450): n is a, c, g, or t
  misc_feature (461)..(461): n is a, c, g, or t
  misc_feature (465)..(465): n is a, c, g, or t
  misc_feature (473)..(473): n is a, c, g, or t
  misc_feature (530)..(530): n is a, c, g, or t
  misc_feature (544)..(544): n is a, c, g, or t
  misc_feature (571)..(571): n is a, c, g, or t
  misc_feature (626)..(626): n is a, c, g, or t
  misc_feature (628)..(628): n is a, c, g, or t
  misc_feature (635)..(635): n is a, c, g, or t
  misc_feature (637)..(637): n is a, c, g, or t
  misc_feature (643)..(643): n is a, c, g, or t
  misc_feature (666)..(666): n is a, c, g, or t
  misc_feature (721)..(721): n is a, c, g, or t
tatgtagaaaaacaatttattccantttaancacttacacagttagtcatggagagtaanangcctgctggtgaaaaaggtcacccaaaanggaganggcatcaaactagtggtcaaggactaactcctaaaaaaaaaagcaactcttatcaaggattaatttaatttttaaaanaaatacaagttattgattcncncttcncaacttgacagtctacctgtggtataactgtcaggtaaaaacanacatctttacaacttggnggtccccagttaaaaaaaaaaaaaaaaaaaaaccnacaacaaaaaaaaaaacncccttncccagacaggaaaaaaacaacatgaaaacnncccnagaaanacnccaacgggcaaaaatttttgaatatttgggggaagggggccgggttgttttgccntanctgaanaancccaggggaaactggnccccgtttganaatntgcctccnggaaagtcgggggtcaagattttcgggtgggaatctttacgccttggatcccccccnttttcctgaataanggtgccccctttcagtatttatacttnatggctcagacacctacctcatttggctctattccttactcactctagcctttantnaagaganantgaaanacttgggggatatagcgtaagangaaaaataatcacacataatattcccctttctgtagctactttagacctgggtgnctagaaaattcctgaagagaat

SEQ ID NO: 520559 - DNA, 324 bp, Homo sapiens
tgactctgaggatccccgcggtcaagtaactggatgcggtaaagtactaactcagcatcctcaatggggtatagatgtgagactcttttctagctctctagtgtactgctaaatcaccatacctgaactgctttataaaactgatatgctgaaatttaactatactgtttacgcttacgctctgataccaaacaaaacttagcataagcttcttctatctctgggtccatctcatcatcaatatcatccaagtatggatcaccagccccggataaatctgtgccattttcttcataatctggaaaaagagtcctctctttcaag

SEQ ID NO: 520560 - DNA, 924 bp, Homo sapiens
cgcgcgctcttctgctgcgtgttgtctacttcctcctgcttccccgaccgccggcgccgccatcatgagggaaatcgtgcacttgcaggccgggcagctgcgagcaaccaaagtcgggcgccaagtatatgggaaggtgagtcagcggatgagcgacggcatcgaccccacgaggcacctaccacggggacagcgacctgcagctggaacgcatcaacgtgtactacaaggaggccacacggcgggcgaaagtagcagatggccccgcgccgtgactcgtgggatctggcagcccggggaccatggaactccgtgcgctcggggacccttgcgggacagaatcttccggaccggtacaacttacgtgtcttgcggtgcaggagtggtagctgggatagcaactgtggtccaatggtggcgaactacatcgaggataggctgcgggaggctgggtggcaactcgtgtgccattggcatagttttgatgaagtacacaggtaggcattgaagaagacttggctggaacattggccttgtctatgtgggcttttcacaatgctttggactcctacatacacacgttgtgagtttgtgtcggtgtgaaccttgcgcgctacctagagcgaactgtgcgattagcgccgtgcccttccatgtgcgaaggcacaagggatcgtgcgcggggtaaagggcaacgctaccacgccatgaacacacgcggaactcctacgttggaaaaagccatgcgggattatgataacgaactggtgttgcggagttggccaccattaattccggcacgcgcaatagtaagggctgggttccagaggaacgcacatcaatgctatgggagcattggcgcaaacgtcccacccattaccgtagacgctgtccacccacaccccaccgattcatttccaaggg

SEQ ID NO: 520561 - DNA, 646 bp, Homo sapiens
ggcgctggagaccgcgatggcgaccgggagcggctgggttccctggctgcgctgcccttcgtgccagtgccgggagcctgcgccagtcggagcccccggcccagcgtggtcctgcctccctctcggatgtccacctgccctgtgatgtacttgccatgctggtggcattgacctgtacccatccatgtggtgctgcctgcctgccctgtgctgctctgcatgtgcctgctggtgattgaatgaatgaaaagccctggctgccgcttctgaccctggatgctgatggatgtttgaccctggagcggaggagttgaccctgagtgaggaagcgacctggagtgaagaggcgacccagagtgaggaggcgaccagggcgaagagatgaatctggagccaggaggtgacccgggaccgaggagtcgacccggagcgaggaggtgaccatgggaggaaatggcgtgcagctggtgctcacctgttgacttgtcacccaacagcaatgagaagcacgaccttcatgttacctcccagcaggggcagcatgtgaaccagttgtccaatgacctgtgcccagggttgtttgacagaggtcataggggggttccacagtctttttcatgaaactcatatttacagggcacaatct

SEQ ID NO: 520562 - DNA, 125 bp, Homo sapiens
tgagtagataagataattgccttatgccagttacttcatctatttgagcttcagattccgtcatttgtaaactagcccaatatgtttcctcacatataaacatctagtcctactcgtcccccttg

SEQ ID NO: 520563 - DNA, 109 bp, Homo sapiens
  misc_feature (51)..(51): n is a, c, g, or t
aacatacgtgcagatccactgggtatgttagaatacatcaaaagcaagcancaagcaaacgctgaatatatctgcaaatgagttctatcacctttaatgttaagtgaaa

SEQ ID NO: 520564 - DNA, 389 bp, Homo sapiens
  misc_feature (150)..(150): n is a, c, g, or t
gagcccctgagctccgtgtgggggccggcccccagttttgctgttgccgcatcagggaaccctttcccgtgggaggtggacccccccgtgttttaagtgcccaacgggtacagggtgttgggcatggagggcaacgagcccctccgggangaggggaatgacctcctgcagtttgccatccagcaggaggaggaggacttacagcggttcctgcagctgtcactccttgagcattgagccatagccccgggaggggtggccaggcccctccctgcccgcttttgtaatttttttatttataaactttttgctgttgaggttggggcctggagccccaggaatgagcaggcaggggagatttaaatggaaataaaaagactgtcgcagca

SEQ ID NO: 520565 - DNA, 226 bp, Homo sapiens
  misc_feature (121)..(121): n is a, c, g, or t
gctatagtccttccctcccaggctcgcttcccagcttctgagaaggagtttaggggatgagcgctgcgtggagagcagacacctcccagcagaggggcaggatgtgggcaggagagtagcnaaggtgacatcttctcgggcggagctgagactgcgcaaggctggggggctatgggcccgttccaggcagaaagagcgagagggcagggagggagcacaggggtgg

SEQ ID NO: 520566 - DNA, 407 bp, Homo sapiens
caggggacctcagaagctgctagaagccctgagtgccttctcttgcccctgggagagttgggtcagggcagcaaggtgcgtgagcaggggcttctggcggcagctggcccttgactgtcctgccccctggggctcatccccctgggaggtcagagatgcaagcccaggacatacacacagccgcacccctggggctcactgctcccagggtatctcgtcgtgggcagcccctccctgggcctggtgcccttctgggcagtccccccatccccagcctgcatcctcattgaaatccctgggccatggtgatgatgtgggaagacaggcggggcttggtgacgggctgaagctgggggctgggccaggtgacttcctgcttcctaacttcctcctttgtgcccccagaa

SEQ ID NO: 520567 - DNA, 216 bp, Homo sapiens
tgtcgatctagaggatctgtccctggtatacccatccgctaggatcaggactgggtcaagctgcatgaaaccaggcctggagcaacctgggaatggctggaggtgtgagagaacctgacttctactttaccctctaccctacctccaacattactttgaactctactcctgttgcggatcttcttgagcttgtttcacctgcttgggttggggcta

SEQ ID NO: 520568 - DNA, 895 bp, Homo sapiens
cgtgtcaaggtgttcatgcccccttttccagctccatattcgaattgtgtcccactctcagccgttttttgcaggacggctaccttattaacgggtcttaattctgcttaaaccatttcctgatgcatgggtattcagccgttacggccatacctctagcctaattcgcttagtttctagggataaacaggccatcttgggcagacctgtgagcatgctctatcacaggggcaagcccaacgggccaagtaacctgcggagttcatgtaggttgcacacattggtaccagcagaacccttgttggttctctcataagaccaagccttgagtactcgcacactgcacaataactcctcccagggtcttatgaacatttgtgtctagtcttctcaaagaccaggtcgcaatgagcttttctggacagtctggtcgtagtctatcagagacaccagtcttccttcagagagcagatgcttttggcggggaggaggaaatcccttcaaacttgaacgcttttctaattgcattatttattgcttattctggggatatggcgtaagtacagagaagccatcacctcagatggcagcttttaaaagatgtcattttttctctcaacaccaggatttccgtttaacaacatgtgtccagcattcccaggtaggccaaggtgtcctacagaaaaacccttgggattagacctacagggggtctggctggtgttaacagaagggagggcagagctggtgcggctggaccatggagaaagctgacattggctggtgtggtacagagaagccagcttgtttacatgcttattccatgactgcattgccctaagcagaaagtgcctttcaggatctagttttggagaatatcacgccatgtctgatc

SEQ ID NO: 520569 - DNA, 121 bp, Homo sapiens
tccctttataaattcttctttatagaagggtgctgggcaggattccccaaagaaaaaaagggttccaaaattcctttaattgccctgattaaagggcactgttccagcagctagttcccaa

SEQ ID NO: 520570 - DNA, 207 bp, Homo sapiens
  misc_feature (5)..(5): n is a, c, g, or t
  misc_feature (53)..(53): n is a, c, g, or t
  misc_feature (57)..(57): n is a, c, g, or t
  misc_feature (61)..(61): n is a, c, g, or t
  misc_feature (70)..(70): n is a, c, g, or t
  misc_feature (73)..(73): n is a, c, g, or t
  misc_feature (110)..(110): n is a, c, g, or t
  misc_feature (139)..(139): n is a, c, g, or t
  misc_feature (165)..(165): n is a, c, g, or t
gaagnttcgctcttgttgcccaggatggaggtgcaatggcatgatctcaaaanaganaganagaaagacnganatagaatagacactgttctaaagaagattcacaaatnaccagtaagcacatgacaatatactcacntgtcactaatcattaggagaatccanatcagaactacagtgagttacaagatactgccttacacccgt

SEQ ID NO: 520571 - DNA, 139 bp, Homo sapiens
  misc_feature (2)..(2): n is a, c, g, or t
gntttaaggatataggtctgggtctaggaattaaaacatccagaaaatggtcctaagttactgtgatcttggctgaagaaaatacattttcttcatgtgttatataaaaaacttacttggtaataattatgttggtggg

SEQ ID NO: 520572 - DNA, 295 bp, Homo sapiens
aatcgcttgaacctgggaggcagaggttacagtgagctggagatctcgccactgtactccagcctgggtgacagagtgtgactccctctcaataaataaataaataagagtttatcaaagttcagtgtgcacacaaatgacctgagatctcattaaaaatccaggctgcaggccgggcacagtggttcaggcctgtaatcccagcactttgagaggtcgaggtgggtggaatcttgagctgaggagttctagaccagcctgggcaacatagcaagactctgtctgtactaaaaat

SEQ ID NO: 520573 - DNA, 250 bp, Homo sapiens
aggggttccagggggatctatagtttcatgtcacatcttcaggtgcctataggtcctgcctgcaggaatgacacctctcggcttagtaagggctgcgtatagtgggaatatgactcccatctggaagaccaggtggagacttctcaccgtcaaagtaaaaaacctatggtccatgtcaagggcaaagctgatgtgctgttcctcaaatgagtaaaacacacttctgtagtgctggaagaggtcagcgtag

SEQ ID NO: 520574 - DNA, 389 bp, Homo sapiens
  misc_feature (22)..(22): n is a, c, g, or t
  misc_feature (103)..(103): n is a, c, g, or t
ggaaccagaccctttcgggaancagtggtaagctctgtttaagacaactgtcaaacccaagagaattcttaaattgtggcagttaaaaatgtattaatccccncgagggccgggcgcagtcgctcaagcccgtaatcccagcactttgggaggccgaggaggcggatcatgaggtcaggagttcaagaccagcctgaccagcactgtgaagccctgtctctactaaaaacacaaaaaaaattagccaggcgtggtggtgggcacctgtagtcccagctactcggggggctggggcaggagaatcacttgaacccgggaggcagaggttgcagtgagccgggatgacgccactgccctccagcctgggtgacagttgttggactgccgtc

SEQ ID NO: 520575 - DNA, 356 bp, Homo sapiens
tgtggcttggtgacatctgagggagggcaggtgtgtgatggctgggccgggtctggacccagacccaacccctagtcccaactcacgctggtggtgaggacgctggcggccgccttgtaaaagtggaacgctcggacactgcgcatgccgtcggtgaagagggaattgcccagggtacaacccacgaacacgtacctcggtgctcaataggtgaccatctgaggaagggcagatgtgtgatggctgggccgggtctggacccagacccaacccctagtcccaactcacgctggtggtgaggacgctggcggccgccttgtcaaagtggaacgctcggacactgcgcatgccgtcgg

SEQ ID NO: 520576 - DNA, 83 bp, Homo sapiens
agggagccaaggtgggctgcctgacacacttgccgctctcgtgtgaatccaagaaactgcgttcctcaaagggaaaaaaaaaa

SEQ ID NO: 520577 - DNA, 668 bp, Homo sapiens
gcaggattcggcacgaggaataaagaaaataatgctcttaaagtactcagagccaccacgccaggccaagacattttatttaatatagtaacacattgattccacaaaagaacactgagggatagatgttaatttttccatttacatgtgaggaatttaaactgaaaggtgaaataattggttcagcattatgctcaaaaccaaagcgttgtctgcatttttatttagcagttctacttccgcagtctcttagtggaacattttaataatattctgcattataaagtacaaaattagttcctattctcatttcctttttaatgtcgggtttctttttgtaaagtctttagtatctcaactcttcagttcttacacctcctccctcagatcttttgtttcaaaaactgactacttcaggttattctactgtaaagaaggctaagccttcttttccatttgaaaaggaaatagatttaatgggaaagaatatatagtagtgactcagatttaagatgcttaatcttatttaacatgaacatgactatacatgataacttaaaagtatttctaaagagggtattctacaaatgcacttaatattaattttctaattatttgcatatatctttcttttaggatccttcctgagcgtttcctggcagttttaa

SEQ ID NO: 520578 - DNA, 949 bp, Homo sapiens
  misc_feature (229)..(229): n is a, c, g, or t
  misc_feature (297)..(297): n is a, c, g, or t
  misc_feature (311)..(311): n is a, c, g, or t
ggagaaaagagatgagacctgctagtgtccgtcactgttcaagacattttttgggggggtgctgtgggggacggagtctcgctctgtcgcccaggctggagcgcagtggcatgatctgggctcactgcaacctccacctcccaggttcaagcaattcttctgccttagcctcctgaatagctgggactataggcacccgccaccatgcctggctgattttttgtatttnaagtagagacagggtttcaccgtgttggccaggatgatctcggtctcctgacctcgtgatccacccgnctctgcctcccaangtgctgggattacaggcgtgagccaccacgccaggccaagacattttatttaatatagtaacacattgattccacaaaagaacactgagggatagatgttaatttttccatttacatgtgaggaatttaaactgaaaggtgaaataattggttcagcattatgctcaaaaccaaagcgttgtctgcatttttatttagcagttctacttccgcagtctcttagtggaacattttaataatattctgcattataaagtacaaaattagttcctattctcatttcctttttaatgtcgggtttctttttgtaaagtctttagtatctcaactcttcagttcttacacctcctccctcagatcttttgtttcaaaaactgactacttcaggttattctactgtaaagaaggctaagccttcttttccatttgaaaaggaaatagatttaatgggaaagaatatatagtagtgactcagatttaagatgcttaatcttatttaacatgaacatgactatacatgataacttaaaagtatttctaaagagggtattctacaaatgcacttaatattaattttctaattatttgcatatatctttcttttaggatccttcctgagcgtttcctggcagttttaa

SEQ ID NO: 520579 - DNA, 614 bp, Homo sapiens
gcaggattcggcacgaggaataaagaaaataatgctcttaaagtactcagagccaccacgccaggccaagacattttatttaatatagtaacacattgattccacaaaagaacactgagggatagatgttaatttttccatttacatgtgaggaatttaaactgaaaggtgaaataattggttcagcattatgctcaaaaccaaagcgttgtctgcatttttatttagcagttctacttccgcagtctcttagtggaacattttaataatattctgcattataaagtactctttagtatctcaactcttcagttcttacacctcctccctcagatcttttgtttcaaaaactgactacttcaggttattctactgtaaagaaggctaagccttcttttccatttgaaaaggaaatagatttaatgggaaagaatatatagtagtgactcagatttaagatgcttaatcttatttaacatgaacatgactatacatgataacttaaaagtatttctaaagagggtattctacaaatgcacttaatattaattttctaattatttgcatatatctttcttttaggatccttcctgagcgtttcctggcagttttaa

SEQ ID NO: 520580 - DNA, 119 bp, Homo sapiens
  misc_feature (3)..(3): n is a, c, g, or t
  misc_feature (58)..(58): n is a, c, g, or t
atngcccagcatttcgtggttttcagttcacattgtcattccattccaggggcatccntctcagcagtcgcacgtgccaggccatgccaagctttggccactggcccgtctgttttcac

SEQ ID NO: 520581 - DNA, 1963 bp, Homo sapiens
ggtcagttgttggtgggtgctcagtggctatttcgttagtcgtgtcgatggtttcggtatggtgcagttcatggtgtggttatagcgtgtcggcactgggctgtctgatagatactatctcgcttcataagtatgaccacgccgttgtgtgtcgacaacaaccacggtgtgtgggggtgcacccatatttttattgcggtgtgtgggtccatccacgttgtggtgtccgcatactacaatatcagcgccgggttgtttttttttcctcgctgccctctcatgtttttttgtccgcgggctccgtctttgtgtttgttgtgtcccgcctttctggtgggtgtgtctatttttttggtctactctcactggttgtggtgtggggctgtctcgttttcttcttgttggtggctgtcttccgcgtgagtgttggtggtcctgccccggtggggtgtttggttctgttgtctgtccgtgcctctcgttctgtggtgtcgttagggttgtgggggactcaccagtctgtcgttcgtacgagacttgctggtggcgccgcccctctcctctgtttttagtgtggtgttgtggtgcggctctccgctcacttcctgtcggagagttgggtgcggcccacgtctgtagtgttggtttgtgtggtacttcagctccctctaggttgtgtcggtggggcgcagctctccgcagttgtggtcggcactacgtggggttggtctgttttttgttttcgtggttgtttgttggcggcctcgccttctgcctcctctgcgtcactgcagcggttgtgtttgttgtttgtctggtgccaccccacagcataggtggtgcgtcactccccgccctgctctccgatctctgttgtgctgggttggcggattgttggttggtgttgtttttcctcttcttttggtgggtgacgacccacaccacaccatcggtgggggtgcgtcactcccgctcatcgtctcttgctgggggggagtcctctctctttgtgatagagtagagtgatatatttgttttcttggtcgcacgctctctcagttggcgctctctctctctcttctctctctctctctctctgctcgctgctctctctctctctgctgaggggacactcacacccgccctctctctccctctcactctgctcgctcacactctctctctctcccgtctctctcatgagtagagagtgtacacgcacacacactactgctgtgtgctgcgggagagtggtgccgcgcgcaccacacacacaccgcggtgagctactctctcagctctcttctgctcttgtgttgtggagagagtgtgtgtcctcgactcagagagagagtggtggttgtgacgacgactcactgcgcccgctcgctctgcctgccctccggtgtgtgtgtgcgccctctcttatagataagagagagtagttcacgccaccgcacgcgcgagagagagaggaggaggtatatatcacatcactctctctctctctcgaatatcgcagatgagctgtgacgagatgatgatagatagagatagataaaatagagagagagagtagtatagatagagagagaggggaagagataataaatagaactcaccacccccctcgtgtgttctcctctcgctctctcggttgctctgtctcctcgcgtcgtctctcgcttgttgttcgcggtctgtgtgttataagtgtatttggaggggtgggtctccctctctctctctctgttgatatttgtgtgggctgggtggccacatagattgttgtgtgtggccccccctctctctattcgcctgttgtttggtggtgttggttgttgttgttgtgtgtgcgtgcgcggagaaatgaatggaaaataatacaccatgttgtgttctcccaccacaatattatatatattatatataaataataaaatataatataatataaattata

SEQ ID NO: 520582 - DNA, 446 bp, Homo sapiens
taccaggttctccaggtcgtggtttatgtactaaatacaatatccatcctataatagctatttctaccatggcaagcttatacaagtctaggaagcacaaggtggaaatggaagttgtagttctcatgatcatccctagtgatccactaacacaatataaacaacatccccaaaatctaaggcactactgctctagaagtcttagttccacaggaagaagtgcttccaccagggacacaatgataccatagaacactcagattagaagactgccacttgaccacttagagctcctaatgccactaaatgaatggcatatcaagaaaggggttactatactggctgtgtagactgaatcttgactatcacagggaaccttcaattgttaccatgaaatgaatggctatatctaaaatgcaggagaccctctagggaaacttaaaata

SEQ ID NO: 520583 - DNA, 168 bp, Homo sapiens
aaccggagatgtagtgcatcaaatggacctcacgcccttcctgttacggcggttggacctccaggctctctgctgtacatccgtggatccatcatgtccatttcgagaccagaagatagtcttcaggagagacacccaaaggtaaactatccagagggtaatgacaac

SEQ ID NO: 520584 - DNA, 244 bp, Homo sapiens
tcgatgtctagaggatcacaccgcaatagctcggatcaccccaaaactacttatggcgattaacaatattcagcagagtagcaggatataatgattaacattcagaaatcaggggagttcccgtcgtggcgcgtgggaaaacaaatccgactaggaaccatgaggttgcgggttcggtccctgcccttgctcagtgggttaatgatccggcgttgccgagtattgcggtcccgagtattcggtc

SEQ ID NO: 520585 - DNA, 381 bp, Homo sapiens
  misc_feature (377)..(377): n is a, c, g, or t
gtatgcctctatgatacttgttactggggcacagttggctctggatgtctaccgtgctgaaggtcagccaaataggcaggtaagactacctaggcctcttcatatgcctaactaagatcacagttggacaaaacaacgtatagaaaaagaaacgaacgtggttttttttttctaaaattacctttttggtttccttggaagagggaggtaaaccatctccattcaaaagaatttggagagtctgttaatgccatacactgaagtacaccattaaccaaaatagccctatggttggttctcaaagagctaccatcctagtggtgagagacaattaataggcgagtaactatgtagtagggggaaccgaagctcgaatncgaa

SEQ ID NO: 520586 - DNA, 765 bp, Homo sapiens
cctcacgcgtacggcagcccaacctgttatccctgatccttccgcgtgacacagtggcctctagcacttctgcctctactggaaccgacatgctgggagattacatcttctctatggacaagcgtgacttacttgactgagtgacaaagacctctagacctacctactgcttccagcacacaggaggagagcctggctcaggggccccctgttgtatagcacacttctagtacacctcctggtggagccctcagaacatcaggcgtgcccagtagcacagcacagctatcacacttctaccattccacagtacctccacacacggcctgcatacacaatgcctacggtggaccatgtgcgagctcaagcagggacctcacagctgacatcagacagttcctgatcgcatccgccagacagagctccaaggacggcccatacggcttgcacaccagccagcacagcagtctgcagagcctgagaagatcacgaaactgacactcatggtgagacattcatggagctggacactggtgtaccctccgaggcagcgactggatcaaacgcaacgagctgtggaagctactagcccacaagactggcctcccaggaccctgcaccattccccctccaccgacacggaagtcagcgcaataccgacacgacacaacggacgttactcaggcagcagcaagcgctcacaccccatcctccaccgcaagtacacacactggccgatatcatagtggaatgtaagaacaagag

SEQ ID NO: 520587 - DNA, 162 bp, Homo sapiens
ggagcgcagtgccattgctcgtgtgcatatggggcagctgctgcaccagctgctgcggtgctgggcatctgtctactgctcagtactaccaagggtggtttgaaacctggtgagtggttgttgacatcagaagtgccgtgccgcacaccaaggtgtgcctat

SEQ ID NO: 520588 - DNA, 259 bp, Homo sapiens
gggaggaaaaagaaagaaaaaagagaaagaaagaaagaaggaaggaaggaaggaaggaaggaaggaaagaaagagaaagaaagaaagaaagaaagaaagaaagaaagaaaaaggaaggaaggaaggaaggaaggaaggaagaaagaaagaaagaaagaaagaaagaaagaaagaaagaaagaaagaaagaaagaaaaaggaaggaaggaaggaagaaagaaagaaagaaagaaagaaagaaagaaagaaagaaagaaag

SEQ ID NO: 520589 - DNA, 453 bp, Homo sapiens
atgtatgtcttcttttgagaagtgtctgttcatatccttttcccactttttaatggggttgtttgtttttctcttgtacatttaagttccttatggatgatggaactcataggctcaagccatcctcctgcttcagcttcccaaattgctgggtttgcaacggtgagccaccatgcctggctaacacctataatctcaacactttgggaggccgacatgggaagatcttgtgaggccaggagttcaaggccagcctgggcaacctaataagaacctgtccctaccaaaaaaaaaaaaaaaagttagctgggtatggtggcacctgcctgtagtcccagctatttgggaggctgaggcaggaggattggttgagcccaggagttcaaagttgcagcaagctgtgactaggccactgcactccagcatgggcaacatagcaagatgctgtcactt

SEQ ID NO: 520590 - DNA, 111 bp, Homo sapiens
  misc_feature (76)..(76): n is a, c, g, or t
ctaggtgaagcgacgtctaggtggagttgcgcttgatcagggcagtcatcacagcctccggcctgtctccagcccncagcgacaggggagccacgtccagcagcagcaggt

SEQ ID NO: 520591 - DNA, 149 bp, Homo sapiens
ccttacgtcctggactccaccagaaaccttctccctcctccacgcaactcccaaaggtcgcatagatttctcacttcacataattcaagtcgctactccgatgtactcttcagagaagctttctcccaccaccctaagatcacatcctt

SEQ ID NO: 520592 - DNA, 438 bp, Homo sapiens
tagtgcatagcgttctgaggatcccggtgtatcctttgtcttcattcattaatcacattatcagacattccctgtgtatcctgtactgttatacatgctgaagctacaaatcaaatgtccgctttgcctccaacaagattccctgtacctaagtgaaccaaggaatgaggtgttccacgcctgggctcacatctttttttttttttctgtaccccaggttggattgcaatggcgcgacctcggctcgctgtgccctccgcctcgaggatacaagcgattctcccgcctcagcttcccgatgcatgttgggaccacaggcgcccgcaaccaagcccagctaatattttggtatattaagtagagacggggtttccccatgttgcccaggatgttctcgaactctgggcctcagtgtgatctgccagcctcggcctccca

SEQ ID NO: 520593 - DNA, 263 bp, Homo sapiens
tatgactggagatggcgatggactaactcaggacctgagcttgtggagacatgacagcaggagatagaaccttccagaagtgggcagctgtggtggtgccttctggagaaagaagctgaaatactcatgccatgtacagcatgaggggctgccgaaagccctcaacctgagatgggagccgtcttcgcagtccaacgtccccatcgtgggcattgttgctggcctggctgtcctagcagttgtggtcatcggagcttgttggg

SEQ ID NO: 520594 - DNA, 309 bp, Homo sapiens
cagcgtgttcgagaactgtgcagttggggtaggcttccgtcaaaaatgcttcttgatcttttctgactctgcatatttggagattccattgatgaagagggttcgcttcaccagatcattcttcccttgtagcgcattcttgtaggtgtgtcttaccgcatgctgtagaacggtgagcaagcagatacagcaaggcgaacggaggtgtgcaggcatagcaggttgttccctgattttcacgttggcaatggtggttctcctcaaagctggtaacattgttcttccagcaggtcccctgagaagttgaca

SEQ ID NO: 520595 - DNA, 244 bp, Homo sapiens
  misc_feature (171)..(171): n is a, c, g, or t
  misc_feature (179)..(179): n is a, c, g, or t
  misc_feature (207)..(207): n is a, c, g, or t
agactacatgcagaacatggagcagaagcgaaggcagctggaagagtcccaagactcgctcagtgaagagctggccaaactccgagcccaaggtaagcaattgaccactattgcgggtgtccagcttctgtggcctaaaccagacactctctatgttggctggactcatgngtgtttanacttttgctcagttaaacgcatttctanggtctactgcaaaatgggggcagggtgacggggaaca

SEQ ID NO: 520596 - DNA, 769 bp, Homo sapiens
  misc_feature (57)..(57): n is a, c, g, or t
  misc_feature (285)..(285): n is a, c, g, or t
  misc_feature (766)..(766): n is a, c, g, or t
atgaggtttcctaatactgtcactagaggatcctgacttagctgcccagcgcggtancttgtgggcagcaccgattcggccattatggccgggggcatatctctttgccagtgtgacgccgcgtggatagtgaaaaatggtgagacactatataaaatttcaaaaagaaagcatctggatttacagatttattgtgagacacaaattcactgctgcctttacactaagagatgtatatgttaaccatatatgctgtatttttcttgtcaggaggggggctttaanttcactcagaattttcaattagatataaagatgtatcaattaccatatataaaaatattactttaaaatgacttgtttcctttgaaaatacctgtgtactgagggttatgattcgtgtcaaaaattgacataagtgcttttacaggcaccaaaggtgaatgaatcttcaacaaaatgtatttaaagtctatgttttcagttatgactcaggttaagaattgtgttttaggatctacttgctggtttatctttttgatccaaatgtgggatctgccctgaacaattacaaggtttagggccatcttcccccccattttcaaagagaagaaaaaaggagatccccggggcactatgtaataaaatgaccctactttggtgttaggaaatagatgaagggtgcctgggaaaatgcccctttggcataaaaaaaaaacacttttaattggtgaacggggggacccatttaaagaatttacctggncgg

SEQ ID NO: 520597 - DNA, 603 bp, Homo sapiens
gtcattcctaattctgatacttaacatcctcatttctatcatattcatccccacccccatgggttccatacttgccacactaggctggtggccttctttctattacgtgtatgtcttttttatagagttttaattttttatttttgagacagggtctcaatccctcatccaggctggactgcagtgatgtgatcataaatcactgcaacctcaaactcctaggctcaagcaatcctcccacctcagcctcctgagtagctgagactacaggtgcgtgcaccacacccagctaatttttttattttttttaaatggcgagtgatgtctggctatttgtggcccaggtggtgatcctctataactccggggctcaaggggccctccgtgccttgggtttcccaaagtgcggggaatagaggtcatgagccattaggacggcgcaaacactatttcagacagtcggatgtctaccacgttcacagtctacttatatcctctcggtaggcttttataccaataaagtcttggacatccactcgtggcaagcatgctctggccacaatacctttattcccttgaacattagcccttgtgtatactccg

SEQ ID NO: 520598 - DNA, 643 bp, Homo sapiens
cagacagggtcttgctctgtcatctaggctccagtgcagtggcacaaccatagcccactgtagccttgaattcctggggtcgactgattctcccacttcagcctccccagtggctgggactatagatggcatgccaccatgccaggctcattatttttatttttatttttggagacagggtctcgctatgttgcccaggctggtcttgaactcctggcctcaagctatccttcctcttgtttgttgatgaaaaagagtcaaactctggctgagcccaggctcacacctgtaatcccagcactttgggaggctaaggcaggaggatcacttgagcccaggagtttaagacccgcctggcaatatggcgaaaccctgtctctacaaaaaatacaaaaattagctgggcatggtggtatgcacctgtagtcccagctactcgggaggctgaggtggaaggatcacctgagcctaggaggcagaagttgcagtgagccaagatcatgccatggtactccactctgggtaacagaatgagactcctctcaaaaacgaaaaccaaaacaaaacaggccgggcgcggtggctcacacctgtaatcccagcactttgggaggccgagatgggcagatcacctgaggtggga

SEQ ID NO: 520599 - DNA, 455 bp, Homo sapiens
taaaactgggtattagagtgctttgattctccttcacccctcacccctggtctcatgttcttgatcaaatcttccttgctctgtccccttgtctcatctttagtcccctccaacctggggggcaggggtgtggagaagccaaagaggcctgagatttcagtctgtctctccgtgccgggagtcccagaggagggcaggaggaagggggtggtgtgctccgaagacgcccccagacatctgaggaagaacgggaacattacttggcgtgcaatttcacccactccctttctccctttgtcccccaggactggggccacttgctggcatggtcgccagtggttcccaagatgggctcactagcgtgctcaatgtaccgaacctaacaacacaaaacatcagccctaatcacacttaccacttcagggtgtcgtcagagaagacaaccaaaacaacgg

SEQ ID NO: 520600 - DNA, 126 bp, Homo sapiens
gtgggcagcagcaggtgccctgggcacagggccggtgccttctcacgccaggttcccacgcaatgcaccatggtcgcgcaggagccgtggctggcctccagtctccagtggtggaatggtccacat

SEQ ID NO: 520601 - DNA, 184 bp, Homo sapiens
cgttcgacggcgcggagccggtggcgccgtagggaacttgctcttgtgatcgtggaagctgcttgacatgccgagctcggtgagcacttgctggccgcagtatctcgtccaccttcatgatctgatgtggcgtgtggctcgtgtcgctgtgtgcctgggcaccctatgtctcgggttatcactg

SEQ ID NO: 520602 - DNA, 418 bp, Homo sapiens
ggttttagcaccgtggtataatagccatgaaacaccactccattttttttgagacagtcactgtcgcccaggctggagtgcagtggcacgatctctgctcactacaacctccgcctcctggcgattcccatgcctgagactccagagtagctgggattacagacatgagccaccacgccgggctaatttttgtatttttagtagagatgggatttcaccatgttggtcaggctggtctcaaactcctgacctcagttgacctgcctgtctcagcttcccaaagtgctgggattagaggcgtgagccaccgcgcccaggctttctggtttttggccgtgtagagctaccacggtgctataacgccggtgaagcttcagggggtttggatgagaatggctgttaccacggtgctataacg

SEQ ID NO: 520603 - DNA, 210 bp, Homo sapiens
taacatttccagtagtcacatgtgattgttttgttttcgtaaaagaatactgcttttattttgaaaaaagagttttttttctttttatggggttgcagggatggtgtacaacaggtccagcatgtatagctgcatagattttttcccctgatctttgtgtggaagatcagaatgaatgcagttgtgggtttatattttcccctctcctta

SEQ ID NO: 520604 - DNA, 180 bp, Homo sapiens
agcatagcgttaccttgtgtgtacattataagaccttttactgcagatttcacgggggaggctttccatatggaagtgaagacataatggcatatatcttccactctttttctaacagttgggagtactgttatgttgctgactgggtatggctggatgtgcctgccccatcctatgttg

SEQ ID NO: 520605 - DNA, 357 bp, Homo sapiens
gtatcgccggaattgtaatgggtatagagacatatcatattacgtatgctagggtgagtggtaggaagttttttcataggaggtgtatacgtggtcgtaacggaatcgggcgtatgctgttcgaattcataagaacaggcaggttagaagtagggtcttggtgacaaaatatgttgtgtagagttcaggggagagtgcgtcatatgttgttcctaggaagattgtagtgctgagggtgttcattataataatgtttgtgtattcggctattaagaatatggcgaatgggcctgcggcgtattcgatgttgaagcctgagactagttcggactccccttccgcaaggtcgaacggggt

SEQ ID NO: 520606 - DNA, 149 bp, Homo sapiens
  misc_feature (58)..(58): n is a, c, g, or t
  misc_feature (112)..(112): n is a, c, g, or t
ctggtgctctacaggatctgagtactggtctcgtgtagtggtagctatcaggaagcanaggcagaaggatggcttgagcctggagttggagatcagcctaggcaacacagcngaagacccatttctccaaagtaagactaaacaccacg

SEQ ID NO: 520607 - DNA, 81 bp, Homo sapiens
  misc_feature (30)..(30): n is a, c, g, or t
  misc_feature (50)..(50): n is a, c, g, or t
cgggcaatattgtgttcagttcaagctgtnaagaaaaatatatatcaatnttttccaataaaatacagtgactacctgaaa

SEQ ID NO: 520608 - DNA, 425 bp, Homo sapiens
aatgtggactcagcgggcggtggggcaggctgcggtcacgtttggaagaactgttggtccatgtggtgtgctaacgtggttccgctagatggtcagtgtccggctcacaaactcctgggtcacatgccgggtgagggagccgcctgcctccaggtgctgagccccccgggtcagcccatccactaggaagggctcggtggcgctagtgtgagtagtggtcatgctgctgtactcgctttgcaggcgcgtgctggaagagcccggaacgggtgcccagctacgggaagggtcctccatcctgggactctatagtgatgatgccctcacgctctggaccaaagccctcagtgttcctggcctgaaccttgaacttatagaggcacgttctcactagaatccacattttaggggtaccgagctccaaa

SEQ ID NO: 520609 - DNA, 706 bp, Homo sapiens
tccagtcctatggtttttgtggaaaaggggtctgtattgtttggcaaaaaaaaaccaggaaaaaggccctgggggaaaccccggccttttgtcccccgctcactcccaatggggccccgtgtttattgagcaccggggggggcacacacccccattccccaaccttgttccaggggtcctcccgtgcggccagtggggtggggttgtgggagtgtgggacccatgtggccgggtgggggaccttcgctctcattcccgtgatgtggtggacattcgacttccgagcggcgtctccaagttatgttggctgatctcgcgagttcatcttgcgggttccccgcgacctcgcggggacccccgagcgcgtgccaacagaaaacccagagggagaactccggcgccgcgcgggtcatcccaaagtgtggggcctgaagttcacccaagtggggaaccatcttcttacgaaccacagagtgtgctcgggggcaagacgatgtgccaagaaacgcaaggggcttgcataccgtggaaagttgcttctgggcgcggggggggggggcattctctcccaaccaagagtctcggggaccaaagaaaaatttccctgggtgctcggggcatttccccagtggccatatgggctcctttgccccagaaagcccccattttcaccttgaggaaaactttcaaaggccaaagttcccag

SEQ ID NO: 520610 - DNA, 1505 bp, Homo sapiens
gctaccgctgtccgccgtctcttaggtcgcccgggtccaccggccgccacctatgcctcgtgggaagccgcagcgcggcctcccggccagccagccgccccgccgcgcccccttctgggaccaagcacgagcaaataacacataacagaatcatataagaactataagcaaaaaagacaacacacactatataagatcacatacacatgggaataacatggataacacattaggacacccaatataatgcatacgataacgacggacatcagatagtaaaaaacgatacaaggaaccagcgacacaaaaccagacagccatacagccgaagaaagaagaaagacaacacactagcaagacatagaaagaaacaaacaagaacaaaaaaaaaacagaacataacacaaaaaagactacaaacacaaaaagacctcacacacaaaaaaaaacaaactacaccaatcaagcacacaaaaacacatcgaacaatcataacaacaataaaacaccaaagaaaaaaaacaaacacacacaaactcatcaaataaaaatacaaaaaaaaaaatatcaaacacaaaaataataccacacacaaccaaacaccattataaaacaatatacactcaaaaataaaaactatctaataaataactaaaaaaaaataaactaaactacaatacaacataactaaaaaaaaaataaataaaaaaataataaaacactacaacataactacatatatatacaatattaaacaaaacaaaaaaaaatatttaacataacaaaaaacaaataaacaaaaataaaaataaaacacaaatacataaattataaaacaatcaacaataataataaataaataaacatcacaaaatatccaaacaaaccaaatctaaaaactaatacaaaaaaatcaataacacaaaatcacaataaaaatataaaaaataaaaaaatcaacccaaaacacaataatcacataactaacaaacccaaggacccaaacaaaaatgaaaaagaaaaaacacacgagaagcaacgaaaaaaacaaagaagaaaacggaaaaaaacaagccaggaaaacaagaagacagaagtaagacaggaacaagaaagcacaaaaaagaagaaaacaaagaaaagcaaccagaaaaacaagaaggagaaacacggaagtaaacacgaaaacacaaacataactcaaagaataaaaaccaataaaacaacataattaaacaaaacaacaaacctaaactcaaaaaaaaataaacaacaaatacaacacacattatactaaacaaatataattcaaaacataaacaaataaaatatcaatacaaaaatcaacacacctacttaataaacaataagatacaacaatcacatccaaacacaaataaaaacaacacataaacaacaacacataacctctacaccaaaaacaactaaactaacaacacaaaaaaacaaaatataaaaaacaacacaaataaacaaccagaaac

SEQ ID NO: 520611 - DNA, 727 bp, Homo sapiens
  misc_feature (286)..(286): n is a, c, g, or t
  misc_feature (288)..(288): n is a, c, g, or t
  misc_feature (290)..(290): n is a, c, g, or t
  misc_feature (295)..(295): n is a, c, g, or t
  misc_feature (305)..(305): n is a, c, g, or t
  misc_feature (314)..(314): n is a, c, g, or t
  misc_feature (317)..(318): n is a, c, g, or t
  misc_feature (367)..(367): n is a, c, g, or t
  misc_feature (392)..(392): n is a, c, g, or t
  misc_feature (404)..(404): n is a, c, g, or t
ttcttccccaatgttttttaagaaaagttttacaaaatttgttgttgaaactgcattccaaaactgtccttgggccaacaagcagcccgtcattcatgggtaagccaagttaagtataaagtaattatcttatcttttctttttgttttgagacaaagtcttgctctgtcacccaggctagattgcagtggcatgatctcagctcactgcaacctccgcctcccgggttcaagcgattctcccgcctcagctactgagtaactgggattacaggcgcctgccaccncncncggcnaatttttgtntttttagtnganncggtttcaccatcctggccaggctggtctccaactcctgacctcatganccacccgcctcggcctcccaaagtnctgggaatacangtgtgagccactgcacctggccagtagttatcttttctttaagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagttcttaaaaagtaaacaaggtgggctgggcgtggtggctcacgcctgctatctcagactttgggagcactggggcggcagggggt

SEQ ID NO: 520612 - DNA, 118 bp, Homo sapiens
acctggatttcctctaccttccaggggctgaccgatatcaactggttggcatataagggcagtattcctatcgttaccctctggttcctctttaccttcggggtcaatatcgctaaaa

SEQ ID NO: 520613 - DNA, 1130 bp, Homo sapiens
agcggaaggggttggatgtggcagaggccaggccccagcctggtgccgctcgagacttccgcgccgcgtgtctgccgccgttggtcccagtccatggccagtcctatccagtctggctctggccaagcccaaggctcagaagtatcctttaaggaagcgggccagcactgcagggctacagctgcagctccaggagctgttcaaccgctcactggcttaagaagcgaagcctccagtagggtgccccggtaatgaggttacccccgacggagaagccgccaattgagatcagccttggaaggagagcagagcgcgcaaggaggctggaaggcggggcacgagtcagagaccaagtgagcttgttcagaggccttgagaagcgcaagaactaagttcgtgtccgttcgcgcgcccaatgtcaaggaagtttccctgacatgaacgggacacggtgaacgtcgtgatccctaacaaggagtcctatcagaggggaaacacggggtggacgggcgcgcatggggggatgaacccagagaaggccctggcgagagaaagcctgtttgagttgttgcgattgcgataaccggagcgaaggtttgccatcgcgaggggtcgcactcgaatcgtcctagagagcgaagggacggaaacttcgtagcgggagtggcccaggttacaccaagaccccttgtgtggggacttgccttagacccaatagaaagtcgttgcgattgcaagtgggcgcgtccttcctgtcccaatttccctgggcgcacgtaggacgcttatcccattggaggtcccgcctttggttcaccccctttgacaaggaactgccttttcctgtggcccaccactaaagcaaagaccccggtgggcggtttttataccgtcttgggttctaagggccccagattcgttgggggccttggggaaatagaataggccccttccttgtggggaatgagaaccccccaggcgggaatcctccttaattgagtaagaacacccaaggggggttgcgcctcgccggtaaaccaatcgccgcgccgtttgtgttggagctcccctaagtgacttaggccagttgggccccccccgagtggagtggttcgacaccactcacttct

SEQ ID NO: 520614 - DNA, 131 bp, Homo sapiens
ctactggctctgagaccccgtcacagcctcaccccgctctgagacccccatcacagcctcaccccactctgagaccccatcatagcctcaccctgctctgagaacccatcacagcctcaccccactctgag

SEQ ID NO: 520615 - DNA, 765 bp, Homo sapiens
ggccttgtccagtgaaacaccctcggctgggaagtcagttcgttctctcctctcctctcttcttgttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaatgggagaattctttaggtttgtcccctaaagattctggaaaaagagaatcagattcctgaagaggcaggaagcagtggcttaggagaaagcaagagagaaaagcatgtccttgtgcaacctgatcacacaaatgatgaaaaagaatagaactttctcattcatctttgaataacgtctccttgtttaccctggtattctagaatgtaaatttacataaatgtgtttgttccaattagcttgtgtgaacaggcatttaattaaaaaatttaggttaaatttagatgttcaaaagtagttgtgaaattggagaattgtgtaagactaattatggtaacttagcttagtattcaatataatgcatggttggtttcttttaccaaattagtgtctagtctgctaaaatcaggtcattgcagtgtgttctaattacaagtatgtgtattgagattggtagattgtggactgtgccatttaattggggttgattatgggcatggtgc

SEQ ID NO: 520616 - DNA, 607 bp, Homo sapiens
ggccttgtccagtgaaacaccctcggctgggaagtcagttcgttctctcctctcctctcttcttgttgaacatggtgcggactaaagcagacagtgttccaggcacttacagaaaagtggtggctgctcgagcccccagaaaggtgcttggttcttccacctctgccactaattcgacatcagtttcatcgaggcaacagaggcatggttcctttgggcaaccctgtgatcacacaaatgatgaaaaagaatagaactttctcattcatctttgaataacgtctccttgtttaccctggtattctagaatgtaaatttacataaatgtgtttgttccaattagcttgtgtgaacaggcatttaattaaaaaatttaggttaaatttagatgttcaaaagtagttgtgaaattggagaattgtgtaagactaattatggtaacttagcttagtattcaatataatgcatggttggtttcttttaccaaattagtgtctagtctgctaaaatcaggtcattgcagtgtgttctaattacaagtatgtgtattgagattggtagattgtggactgtgccatttaattggggttgattatgggcatggtgc

SEQ ID NO: 520617 - DNA, 144 bp, Homo sapiens
tggtacccgcgcgagggttttttggcttagcgcataaatattcgagaagaaatgtggtcctgctggatgatggtacggcaacgctcagaattaaacgctacaataatctcactgctcggggcgtcgtgaagtcggttttcctca

SEQ ID NO: 520618 - DNA, 621 bp, Homo sapiens
  misc_feature (575)..(575): n is a, c, g, or t
ctggttcacagtcctggtttgtgaccccctgctctgaggttcaaggaggtccaccaagttcagcaaggccaggttccagcagcagcagcaattagttactatcttcaccttacacaggatgatcattacccatgggggctccacagaagtggccttattctcataactttgctcagagtcaaggacctctaaaggatcctctcttcctggtccctggacagttaactgtctcctgggtcggggtctggtcagggactaattggagtctggatgcttgcatgctaaaagctttattttattacccatgctcacaatttattttcctatcttaaaattctcttaacataatattttagtcttatgcatgaatccatacttcgtatactctaataaaaaaaactccaaagattttttcccccaaagctgcaatgtattgttttctaaagcctgagatcttctgctgcacctagttctatccttgataagtttcaaatcctcttaacatttctatcaggcgtcttggaggcaacggcactcaaaattgttggtttggtgttttcttatggggaatccangactctgagaaaaagagatcttgtcagatgaactttgaaaagaatt

SEQ ID NO: 520619 - DNA, 376 bp, Homo sapiens
ttatcgcctagtacatctgtaagtaactggcagagtccagacactgatgtaacacgcctcagctatcttctagcaagtcattcatgtgcatcatcataatgccattatcatgcctcagacaattaggttcactgtcaggttcaagttatcataaaacaaggtctcctatactacataccatgttcctaatgtatgtccaaaacgcacatgctctaatacagttaccaatggattaccattgcttaggttcagctcctctccaacttaggtgcacaaagagcttgtgcaacttgagtgctcagcgctcctccggggatcagatatcaaggaccgaatccatgcaattttttaaaaaatgcaaatgatcaactgtaat

SEQ ID NO: 520620 - DNA, 171 bp, Homo sapiens
cccccctttatggcctttggggccttggggataccccgcccactttcccccctcaatggaactccatgggccttgctggttttgggggggttatttaatttttgggataggggaaccaatttttttggattaaaattaataaccaacccattaaagttttttgggccccca

SEQ ID NO: 520621 - DNA, 316 bp, Homo sapiens
gaaatggtgcagggagactcgaacgtactctgaggcttgtaggagggtaaatagcgcccccgtatacttgtactccgccgtgcttgacttctttggtttcggttgttttctattagactatggtgcgctccggtgcttgatactcctgatgcgagtaatacggatgtgtttaggagtgggacttctaggggatttagcggggtgatgcctgttgggggccagtgacctcctaattggggggtaggggctaggctaggagtggtacaaggctcagaaaaatcctgcgaagaagaaaacttctgaggtaataaatagg

SEQ ID NO: 520622 - DNA, 100 bp, Homo sapiens
  misc_feature (71)..(71): n is a, c, g, or t
  misc_feature (84)..(84): n is a, c, g, or t
catgaacgacaccgtaactatccgcactagaaagttatgaccaaccgactacttcagaggaaacaaatggncattgatgtcttnacccgggaagcgacag

SEQ ID NO: 520623 - DNA, 534 bp, Homo sapiens
gccgccgcctaccactactcaattagcgcccggtcgaccagaactgaaattccaacggccaggataggcaagcacagctgccaactcctatgtacctgcagaacccaaattggcgctcgtcactcagactcagaggtatcaatggcgtgagcccaaaggttcgacaggtgttgcagcttcttcgccttcgtcaaatcctcaatggaacctttgtgaagctcaacaagggttcgattaacacgctgccgattgtcgagcgatatattgcatcggggtcaccaatctgcacgtcagtaaatgaactaatctacaagcgtggctatgcgaaaatcaataagcacggaattcgtttgacagataacgctttgcctgctcgatctcttggtaaacacgggctcatctgcatggaggatttgattcatgagatacatactgttcggaaacgcttcaaccagccacataacttccctgtgggccttccaattgtcttctacacgaggcggaattgaagaaaaagcccaaccattttcgtag

SEQ ID NO: 520624 - DNA, 423 bp, Homo sapiens
  misc_feature (2)..(2): n is a, c, g, or t
  misc_feature (229)..(229): n is a, c, g, or t
  misc_feature (421)..(421): n is a, c, g, or t
gnttccacaggtgtcctagcttgtctttattctgttttttctttttctttttcaaagcagattacaatgttgccctaatttgcattttaattagttgttacaagacactgcacattctcctgagggcacacaatgatttccaagatgccaggtccctcttccaatcagtgaatggcgagctccctggcaggtgcagggctacttcctgttttccaatggtgtgcctganatagcgctttgcgaggtgggcgtggattatgtggacacaattttgaggcaatctcccttacccatttggtagaagactgcctaacttattcttactattagtgtattagtgttgtttttttttgaagacatattatattccattattctgcttagctcaaggggggataaagaatttgggccaaaattttancc

SEQ ID NO: 520625 - DNA, 1087 bp, Homo sapiens
aaattaaaaaaaaaaaaaaaaaaaaaaaaaaaaaaaaaaaaaaaaaaaaggggggaaaatataaaaaatttcccccaggggccccatttttaccctgcccccgtttttgttgtgtcccacggcgggcccccgctattggggagagtctgcttttttatatcgcgcccagcgcccgtggccgctctctgcttttataagcacgcgcgcgacgagcgtgggaaaacacgtgtccagccttgtggtgaatcatcttggtgtgcaacgcgaaccctatatatctctctgtgtgggggggagggaacacactatagatgtgtggacacaaccctataccctatagcagagcaatattatataaagtgcctctctcaggaggtcgacaacttatataaccacatcttttctacagcagagtgtcatatatagggtgtgtgtctcaacaccaccatacgcgctgagcgctatattatctgcggcgacgagcagccgagacgcgatctgaggagaactactatgtctatgcgcgcgctataacccgctgagagaatatataatagtatgttaatatgtagagagaacactatgttcttttattatatacccacaccgcaagagaggagcaaacgctgtagttagtaaaaaataaaaccgcgaaggtgagagactgcaacactgaagtgaatataaacagccgaacccaatatccactcacaacaacacatacacgacgaaactaccccaccatcaaccaatatcacgtacagtaacactcagcactaacataaaactactctctcatctaaaaacacaccaactacatataataataattaaaatacatcactacacctaaatctaatactacatcatagatacatatcttaactcacagagcaatatcaatactacaacactagtactctcaagccaatacagcaaaaatcatatagaacaacctcagtaattcagatactaccatacacaacaccatacatataacactacccacatagacaaacaacacacacaccatcacacaacatacaacacacatcaaactacacatacaaacacaccatacaatcaa

SEQ ID NO: 520626 - DNA, 118 bp, Homo sapiens
ctttgcggtttccagatgagaaggggtgaagcggggctcctcctggataatgtcaaagttggaagagctcaatggggtgttaaatgataatatcagggctcaacagggagagccatcg

SEQ ID NO: 520627 - DNA, 345 bp, Homo sapiens
gtgggaaatccttagtggcttttatggtgttttgtgggagggcacaggggactgacgtgtgaatgccaggtgtcattatcactgtcaagtgtctaattcagtgctgggtcatagacaggtttagaagtgccttagaattcagagttaatccagagtgggccacaggttgatggcattttgctttattcttcaatgctttccttttctctttagaatattgtcatcccttttaccccttcccccttcctcggccattttccccagagggcagaatggcttgagctatttcctgcctgagttttgatgtcgagacccctgcctgcccaattcctgcaacaatgaccc

SEQ ID NO: 520628 - DNA, 121 bp, Homo sapiens
ctcatgtcatacatctaccccattctcctcctatccctcatcccagacatcattaccgggttatcctcttaaaagaatgaaaaaagtctaattataataacatttgagtgaaccgtgaggg

SEQ ID NO: 520629 - DNA, 157 bp, Homo sapiens
caaaggccggagagatcttctcggcggccggcgcgctctcacgaagctcggggagctgacgatgcagctgatccgcggccgatcttctctgcgggtgcgaagtggacggagacggaaatagagatgctgagggctgctgtcaaggatttcgggacga

SEQ ID NO: 520630 - DNA, 446 bp, Homo sapiens
ggccggtatcggaatctgttgaacatgaaatatcatcaatgtgattttctggactacactttttatggaactactaaagcaattcagcttgaaataaacacgttttgtaaagtagcatgcaaatataacagtctagccgtggttgcagtggctcatacctgtattccctagcactttgggaggccgaggcaggaggatcacttgaggtcaggagttcaagaccagcctggccaacatggtgaaacctcatctctaccagaaacataaaaagtagctgggcatggtggtgcacgcctgtaatcccagctactcgggaggctgagggagggaattgcttgaaccaaggaggcggaggttgcagtgagccgagattgcaccactagactcaagtctgaatgacagagcgagactctgtctcaaaaaaaaaaattctgaagcttaaaatg

SEQ ID NO: 520631 - DNA, 169 bp, Homo sapiens
ccaaggaagcacgcagggcgcgtgaagagcgcctccaggccatgagggaggagatcatcaagaattttatccagggaggaggagaccaggaaataaaacctcccatttgtgtctgtacttcctggcctctgtgattccttagatcagccattaaaataaaacaggccta

SEQ ID NO: 520632 - DNA, 122 bp, Homo sapiens
gtaaaacccagcccatgacccctaacagggcccctctcagccctcctaatgacctccggcctagctgtgatttcactttccacttccattaacggtgtctcattacttagggcctacttacc

SEQ ID NO: 520633 - DNA, 177 bp, Homo sapiens
gatgcttcctatgcagcctgcagaaccgtgggtcgattaaacctcttttcttcctaaatcaccctgtctcaaaaaaaaaagtttttgatgatatggaccaaaaaaaaagtttttaatgatatgtacaaatacttacattaggtcaaaatttttcaaattataatctctagtaccaaa

SEQ ID NO: 520634 - DNA, 645 bp, Homo sapiens
taagcgccgagccgcgcaccggccccggtcggaccggcggcccgggcgcagggcgggatataggccgcagccgggggaacggagtgcagagggaaagggcagctctgccctctgcccaagagcggccaccctaaagacgagggaacaggggaggaggaactggggacagtgtggtacctatctgccccacctctgaagtggttgacaagggaaatgggcaccgtgtttttcacatgaaatgcaaggacaagattgtcacatcactgttaaaacctgaatatgcttctacattcgtcagatgtcactcaacctggaggacacggagttgcagatgaagctagacatgagatccggataagggaaggggactgtaaagcttataacaatctgatcaccaaatgaaaaaaaagataatagaaagtcaacaaaaaaactaataaatatgcaaaaatattatgatcaatcagcatacaattagtgaaaatacaaaaaaaagataaaataagaaacgcatagtgatagaaagaagaaaaaaacagagagaacataatgatgaagaagctactcctagaaagaacccctaaaattagacgagactctcaatcaatgacaaccaaattacatcaatgagcatagaaacacaca

SEQ ID NO: 520635 - DNA, 376 bp, Homo sapiens
cggttactgaagtttcacatccacatgtgcttgctacgcataaggtcattattatcagagagctttacaaccatacgagcagcttcatccaagtcatcacaagcaagtatttaaagtccactgtccgttatcagtgccttagcatcatcgactcgtgtaccttgtcaccgtaccacacacaggtattttaatttccaagtcttttactgccatgactataccctgtgcaataacatcacagcgcatgattcctccaaaaatgttgaccataatagccagtacctttttatctgaagtgataagcttaaatgcttctgttacttgatggactgtaccaccaccaccaacatcaaggaagttggctggtccgtgacag

SEQ ID NO: 520636 - DNA, 200 bp, Homo sapiens
gacagaggcgacacacagtgccccacacaggataggcacccaggcctatattgttactataataaagtatgtagtatatctaggtcatttgcagatcacacgatcgcaaaataacaaaatgaacacaaaggcagatagagctggttggggagcacagacatatggatggccttgaaagcagctttatccccttaagatct

SEQ ID NO: 520637 - DNA, 251 bp, Homo sapiens
ctgacaatcctctagctgatcacttagagtatccccgccgaacgtgggattcagctgggccaccctacagtcagaagagatatgaggaaattgtttaccgaagtcagcactgtactttaagaaaattggctacaacccctacacagtatcatatgtgccattttctggtttgaatggtgaccacatgctggagccaagtgctaacattccttggttcaagggatggaaagtcacccgtaaggattgcgatg

SEQ ID NO: 520638 - DNA, 223 bp, Homo sapiens
ttcgaatcgagctcggcccgatacctaattacgcatgtccaatgtacttgagaaataattactctgagcacagcaggacaatatttaacaataacggaatgctgcttgttaatcccaattgctctcttctggttttactcttttaacagcaactccccagtcctttactcagggtctcagctcatacctggccttaaaatgaatgctttaaggagttcccttc

SEQ ID NO: 520639 - DNA, 127 bp, Homo sapiens
  misc_feature (55)..(55): n is a, c, g, or t
  misc_feature (88)..(88): n is a, c, g, or t
tgatgaggtgatctagaggatccgtgtcatcccccttcgtgggagggtcgaagtnaacatcaggggaggtcagctgtgattgacatgnagaacatgattatacctcagggtctagcttcgaggatat

SEQ ID NO: 520640 - DNA, 170 bp, Homo sapiens
agcagttatcgtaaggatgatagagttgggcgaacgattacctattcaatttaatggtagagccggtcgtgcgtgagcggcgtgatgcgagtgctagtggcatttgtagcagactgggctggggatgaacgaacgcgggtttacgccgatgcgggggtccgagtcgaatc

SEQ ID NO: 520641 - DNA, 365 bp, Homo sapiens
cacgtccaccttactaccacacaactcttagccaatccatttatccgcataacttaagtctagagcgatagaaattgaaacctggcgcaatagatataggtaccgcaagggaaagatgaaaaattataaccaagactattaatatagcacggactaacccctataccttctgcataatgaattaactataaataactttgcaaggagagccaaagctaagacccccgtaaatcagacgagtctacctaagaacagctaatagagcacacccgtctatttagcacaatattgggaagatttataggtagaggcgacaaaactaccgatcctggttattgctcgttgctcgtaaccgatcttaaatt

SEQ ID NO: 520642 - DNA, 275 bp, Homo sapiens
tgcgtcttcataagcatacttaataaaatacacttttttcaacagaagtataatgtcaacccagttctttgaatcatcaaccttctgtccaatttctaaatcttgagaattctctgaactccattcttgggaaatctaaccatgttattggcactccctttagaatgaaaaggggtttgttccttacagtggacttatcagtttttcttcctagccccagaatctggctcaaactctccaacataaatcaagaaacaataatattttaagagctg

SEQ ID NO: 520643 - DNA, 358 bp, Homo sapiens
cacaggcatagtaagagattaccaataatacctaataatacaatagagcaattacaccaacatactataatagaaattataggagcctgggcgtggtggacgcctgtaatcccagcacactgggaggccgaagcgggtggtcaggagtttgagagctgcctggccaacatggtgaaactccatctctactaaaaatacaagaattagctgggcgtggtggtgagcatctgtaaccccagctactgggctggctgagccagtagaatcgcttgaacttaaacccaggtggcagaggctgcagtgagccgagatcgcaccgctgtactccagcctgggcaacagagtgagactctaactc

SEQ ID NO: 520644 - DNA, 891 bp, Homo sapiens
  misc_feature (706)..(706): n is a, c, g, or t
  misc_feature (709)..(709): n is a, c, g, or t
  misc_feature (733)..(733): n is a, c, g, or t
  misc_feature (744)..(744): n is a, c, g, or t
  misc_feature (776)..(776): n is a, c, g, or t
ggctacattgaggaccagaaactggtgctgagcgagagggcgctcactcgcagcttgtcccgcccgagctccctcattgagcaggagaaaaaaaagaagaacaaaaccagccgctctcagcccggtgatggtcccgcgtcagaagtatcagcagagggtgaagagatcttctgctgaccctcttcctctctgctgaggcagctgcctcctgatcctggccagcccacctctcctgctgtccccgcgtgcacaagtctcttacactggacgcccactgctcctcagcgtccagtcctcctgggcggccccaggtcctggacaataagcagcgcagcctggagaagcagcgccaggacctggccaacctgcagaagcagcaggcccagtacctcgaggagaagcgcaggcgcgagcgtgagtgggaagctcgtgagagggagctgcgggagcgggaggccctcctggcccagcgcgaggaggaggtgcagcaggggcagcaggacctggaaaaggagcgggaggagctccagcagaagaagggcacataccagtatgacctggagcgactgcgtgctgcccagaaacagcttgagagggaacaggagcagctgcgccgggaggcagagcggctcagccagcggcagacagaacgggacctgtgtcaggtttcccatccacataccaagctgatgaggatcccatcgtnctncccagtctgaggagccccctcgcnatctgaccttncatagcaatcaggctcattggcactcagactntcagtgtcccaaaaggacagctctctcgggacaccacaaagaataggggccttttcacatactgagttcaccagcagacaacaaaggaccagaaggcagagcaagccctggtcac

SEQ ID NO: 520645 - DNA, 745 bp, Homo sapiens
gcataggccggttctaatttacaatgaacaccgcggcctgaggccggagagtcccttcaacccgggaggcggcggctgcatgggagccgagacggcgccattgccctccagcctgggcaaaaagagcgaaactccgtctcacaaaaaaaaaaaacagggccgaaaccaggaagctgcgcgagtggcgccaggggccccttcttctcccggcctgtgctccggaaggttccccttccgaggcgccccgggctcccgcaagcggaggagagggcgggacgtgccggggccggagctcagaggccctgggggccgctcaggctctcccgccatcgcaaggggcgggcgcttgacctgagggccatccccgcaaagggtccccagaggcggcggcaggcggcggcgctgtgagaacccgcagaagaacgctgggcgcgcagagacccggtccacccccgcgagggagagacttccacagaggcacgcgttcccacagcccaaagccacgtccctcagggtgatgcagccccagtaagtcccgggcggggaagctcagggcttgtcaaacgaactcttcgctccagccgtgcgcacgagggggacggcgtggcgtgaggctgccgcccgcacgtggttcatctggatcagtttgccgctgcctagttcggcttggggcatctccgcttgggtctcaccgccatcacgccgtctctccctccgtggctttccttttacctttagaacccaa

SEQ ID NO: 520646 - DNA, 214 bp, Homo sapiens
agtcactctgtgctgtgcgctagcaaatcagggtgctcttgataaaaatcttctcaaattaggcagctcatcacgattcacttcttttagctaatatctcccagggttccaaaacttctttccagataagggccctgccctacttcctccaaatcgaggtgcaccaaacccctcggtcccgggccgcgagtctcgggtcaactcgaaataaccc

SEQ ID NO: 520647 - DNA, 390 bp, Homo sapiens
tggtagtctgtgaatgacatgaaagtatcagcgagtattgattttggggtacaaataaatttcagtgactaggtaagttgacaaatataaaagctaggaatgagaactaatggtatgctggcatttaataaagtttctaaatcaattgtaatggtaaacatattttaaaaaattcataacttggtgggcatggtggctcatctgaggtcaggagttcgagaacagcctggctaacatggcgaaaccctgtgtctactaaaaatacaaaaataagccatgcgtggtggcccgtgcctgtaaatcccagctactcgggaagctgaggcaggagaatagcttgaactcaggaggtggtggttgccgtgagtagaggttggggtgagccgagat

SEQ ID NO: 520648 - DNA, 559 bp, Homo sapiens
  misc_feature (3)..(3): n is a, c, g, or t
  misc_feature (48)..(48): n is a, c, g, or t
  misc_feature (140)..(140): n is a, c, g, or t
  misc_feature (163)..(163): n is a, c, g, or t
  misc_feature (254)..(254): n is a, c, g, or t
cantttcagaactttttaaaagcacacgtgggagcaacatgtacgccnatccatcacacctatttacagcaacttcttggagccttacacccaccattaccagcaactgtagctggtcgaaccaccagtgaccttttccncctcttccaagtcaccattatantttcacctaacatatgccagtttccaagaactattaagtccccttatcgcactttttatgccatgcccacgaaaaagcactttcttccgcntacagtatcagatccatgggacaaccacagacaactaagagcagcattctcccgttaattttcttgcacaaaagtataagtctcattgcccactgccataaattttgtctcgtcctcacagaagcaacatgcactggctcattttatgtgcaaagaaaagacttccccattacaaaaattaacttggctaggtatggtgtctcacacctgtaatcccagcactttgggtggctaaggcagatagactgcttgaacccaggagttcaagaccagcctggacaacatggtgaaaccccatctcttta

SEQ ID NO: 520649 - DNA, 1329 bp, Homo sapiens
ggtgactaggctgggtgtgcagctgcagcgtatccacaggccccagggatgcattgccctggtgctactcctctgcattgtagccctcctcgggcacagcagctgccagaacccctgtctctagtcctccgccgtgatgtgaggtgcgtcgccagatccccgacagcacaggagcgctggtggagagaggacggatccttttcttcaaaagtcccctggtgaaacatagacttgggcagcagggcatgatcgtaccaatttacagtgactagtgatgctgataccggggatagcgactccgagccactgaagcccgcaggatccgaaacgctgcatccttggtcagtcctcgtgcacctgttgggacatctggcacctgtcgtcggttccatcctcagcgtgggaagccgtgtagtcagcggaaacagcaagtctcaatcagttcaccgtgggactcttcttactcattgacgttgcatacaggcgaggccacagactatcacattggtaaccgtatcagagggagcctcctatgatcgacggactcaacattgcccctgccagagaagagaacactcaaagaagttgcactcctcgggatacgtctgatgcacagaaagcaagggcttgcgggcagtaacacaaactcgcaaggactttcatgatggggcaaccttcttagcgaacaacacgatcagtagtgcgtgacaccaagtgacccaagaagatcacttgaccgggcgcaaaaccctctcggcttgggaaccttgcccaaggacgatcgaaggaagaatggggtggcaggacgccaaggattgacaccaggggggaaaaggcttcggacgcgaggtgttacccaagcagagacgggggacaaattttccacctggactagacagcaatccaggacatttccgtaccattatccttccgagaatggtgaggcatggcacgtttccacacggggggagacacggttggggtaaaacgacagaggctacatcgacgtttccaactgacagatagaacttctcccccattcaggaaacggaggaagtatcatcattaagacgttcttgaggactttcggaacgcatagagacgtaggacagccccgtaagcaacaggcggagttaccccccagttggcaattaggatacggagaaccccgatttaccaggcggcaaatagatattctaacgcgcctcatcattgcgagcttattggggagcattacgaagagatcccgtccaggtgcctttgcagaagagatttggcgccacacgtcctggcctctcttgcaccgtgcagggccattgatagttaata

SEQ ID NO: 520650 - DNA, 715 bp, Homo sapiens
ccatcgccacccgctggtctgcccagcactgccggtgactgctgctgtggccatccagctccccgtgggtgctgttgtgtgtgttgctcctgctgtgtgcctggtgcctcgtgtgattctgccctgccgcttcccctggggatgcctgctgctgcaaatgccagtgttgggtgcgcctggtgccctggccagctgccctctagtgcagcaggaatgtgcatgcttgctttacatcctgtcctcccctgcctcgcagagttgggagaatgtgcatgggtggggggtgtggaaaaataaaatggaaaatgtccttgcaccatgtagatcagcgtcccccactttggcatccctggcctgtgcctggtggacctcccagtctgcgtgccatgaacgcgagcatgctgaggtgcgagagcttcgctgggctcgtgtgcaaattccagggtggcacaacgtgtgctggtggatgcttgactcccgacatccatatcttgcgtgcatcttgcaagcagcagtttaacaacctggatgcctttgtagctcacaagcaaagtggctagccagctgacaggcacatcctgcagcaggccccagcacggtccagtttgtatcggaggaaacatgtgcctgccacccagactcagaccacaccagaaccatcacctcggagagccagacaatcacagtttcagctccagaatttgtctcttggacc

SEQ ID NO: 520651 - DNA, 254 bp, Homo sapiens
acgagttgaggtacagctagtgtgggatcgtggaggcttgatgggagcacactgtcgtgactggtctggcctgtgtagagcgtttggtgaagcagggcactgagtcacaggcaggtcgtcaggatccacgcccagctcctgcagcatgctgtgtggtctcctgggcactcgggccactggcttttctgggactcacccacgcccagctcctgcagcatggctgtggtactccggcttggtctccagcagtttca

SEQ ID NO: 520652 - DNA, 125 bp, Homo sapiens
aagcagattaatacagactcagtgttgtgattagatgcaggagagctcgcggtcttacccagccgtgtcaccaaccccaaaactaacatatcagaaggaagctacgtggacgatgtcaaacatca

SEQ ID NO: 520653 - DNA, 507 bp, Homo sapiens
  misc_feature (437)..(437): n is a, c, g, or t
  misc_feature (474)..(474): n is a, c, g, or t
agacatccgagtagatcccgtgaaaagtctcccacgtggggctgtggacagggcccaagggtagcagagctagcagaggcagtgacggactgtgtggcaggtcatttgcaaggagaaaagccgtctgcctcttaatttgtggctcaagtttcagaatttttttcctgagggactttagaaattacttcaggcttgccacctaaccttaaaccacccccttggagactggctaagtgttattgtgtttctgttagtctatcaccatcgatactggtatgactggtgtgtacatggttagcccagcaagtattacttctccagctaacagatgggaactaagcccagagacatgagttgacaccccaccccagagctagagtctcccttcttcgctcctcatctccacagataaatgcaattaatcagactagtgggangcctccgtgggtgactaactgcatccgcgtttcaccnactttgatcaggacttcgcccctctctcttcct

SEQ ID NO: 520654 - DNA, 649 bp, Homo sapiens
  misc_feature (19)..(19): n is a, c, g, or t
  misc_feature (62)..(62): n is a, c, g, or t
  misc_feature (64)..(64): n is a, c, g, or t
  misc_feature (96)..(96): n is a, c, g, or t
  misc_feature (99)..(99): n is a, c, g, or t
  misc_feature (106)..(106): n is a, c, g, or t
  misc_feature (149)..(149): n is a, c, g, or t
  misc_feature (153)..(153): n is a, c, g, or t
  misc_feature (158)..(158): n is a, c, g, or t
  misc_feature (163)..(163): n is a, c, g, or t
  misc_feature (193)..(193): n is a, c, g, or t
  misc_feature (204)..(204): n is a, c, g, or t
  misc_feature (212)..(212): n is a, c, g, or t
  misc_feature (216)..(218): n is a, c, g, or t
  misc_feature (237)..(237): n is a, c, g, or t
  misc_feature (258)..(258): n is a, c, g, or t
  misc_feature (262)..(262): n is a, c, g, or t
  misc_feature (296)..(297): n is a, c, g, or t
  misc_feature (376)..(376): n is a, c, g, or t
atttcttgtaaattaaganaagcgaggggctgagtgtttgtttgtagtggtcttcttcagtntnaggccccttcggatggggttcagcatgtgttnttnttgtggngtatcccttgggctcaggtctgcagggtcactcttctggtatntggnctggngaganagtggtttttgggggttcccgttcctggtnttcagcttcantttttggnattnnntgtttgttctcctcagtgnatactgggcttcgggcctggnagtngagggttaacggatagtttggccgctccacattnnggagggcatgctggtgacaccttgggggccctcacccacagatggcgactcagggctgtgctccccccgctcttctggnccatctggaggggctggcaacacccctgggaggtctgggacggttggggtcttgacagggatcacgggtgtcttgatggggatgggaccagctccaatggttccccggcggacagaaggcttggtggaaggggtccgtcgtgatagttgcaacccctggagtgaccatagcaggtcccagggtggtggggaggccagcagttgaggctggacgcttggcttggaacaaccgtcggtaggactggctgatgtcgctgtttcttggaatggtgga

SEQ ID NO: 520655 - DNA, 600 bp, Homo sapiens
gagcatggggatatggggaactggcaggcacagccatcctggtggattcgtgtagtgcttcacgtagcattcacggactttccgtcttgggccttttttggcgggggggtccagttggctgctcgtggtgtacaggtccccggaggcatccctggctaggtgggaagttcctggcggcacgttctgtccgctttcgctccaggtcacactgagtgctcctgggggaagaagccctggaccaggcattcgacgaccacgttcccatcttggggggtgctgtcgaggctcagcgggaagaccttggggctggtcggggattctgaagagacggtgaccgttgtcccttgggcccagatatcaaaagcatcttcatgcctttcaggcctcgacatactccgagcacaaaagtacagggccgtgtcctcggttgtcaggctgttcatttgcagatacagtaacttctttgagtcatctcttgagatgggtgatctgggtttcacagacgcgggtattctgtcgggtaactattatctttgtttctactacgggcaacccactcccgtaccaggggtccgcggccgaattcgaatctagtcatag

SEQ ID NO: 520656 - DNA, 1682 bp, Homo sapiens
gttggatccccggcgcgatcagccaccacggagccgtggggctcgtgccattagggtgtgctgttacgcaagcagtcagcgagcagcagcagcgagcgagcagtcgatcccgcaggtgtctgaggaaagtccccacgcaccaaggtccacagctctggcaggaagaaatgaggagccaatggagccacgccagagtggcagcgagcactgatgtccagcgtacagacgtcaccaggccgagagccaagccatcgctgcctgtccagtctcgcctggcgtggacaccttgtggactagacgacgcaacagaagactggacgatgcgccatgcagtacgcggaccgcatgggactgtgtgccgcaaatgtcctgggttgtggatgagcggctaccttactactcctggacgaaagaccaaatcaggaacttgacacggctgacatgacacaggcagcatgacccctcggtccgcgtcgtcccgcgaccgccacgccccgcacgcgacccgcgctcagaacacgacgagacgcgactcaccacgcgctcgaccttgacgcaccccttcggacgtgcgcccactggaccactccagacgaacaggacagcgaagcccacacctgcacaaaacccaacccgccaccgcacgcgaccccacccaacaaccaccaccgccaagacccaccacagacacacggacccacacgccgcccgacgcacacccaccagcacgcaccacgcctaaccacgaacaaccgccgggcaccaccacgcaaaacgcaacacaggacacagccacccccacaaccagaaccaaccacacctcacacccaagacaccacgcccacaccacgctctaccccaacaccactgcagacaaccacccttatacgcgaacaaggcacacaccacagacaaacacagaacacacaagcggaagcgaacaaccaaacagagcagcgcaaacacaccagaaaccaacaagccacacacagcagacaacgtccacaacgacacatacaccaaaacgcaagatcaactagcccagcaacacaagcccaacaaaacacaaacgcagcataaccaaacaaacgcacaacacacacaacacacaaacccacacaagacaaaccgacacgccacaaaccagacaacaacaacacacaacaaggcacacgaaacaacaacgacgaccatcacaaccacgccacccaaacccaaccaccaccaccgacaaacaactacaaaacgacacccgatcacattcacccataccaaccccaacacacacatacccaaaccaaaacacaacaccaaattcaaacacaatcactgaacctcgatcaataatactaacaactacctaaaacacataaacatcctcccacaaacctatcatatcaagcccacatctacaacgacacatacataatagtaaataaaaataaacaccaaatactacactctcccaaccaatacctcacaacactctatcataaacaaaaaacccaaccacaacaacatccccatactacacaccacacaacaccatcagcacacacaacataaatcaccataacaaataatacataatataacaatatatataaccgacctaatctgtcacaacatactaactaatcatatataaaaataatacaactcgttatcacaacaaaaacaat

SEQ ID NO: 520657 - DNA, 116 bp, Homo sapiens
tgtctatgtctctgtttttatatcagtaccatgtctttttttttttgggctatagttcggtaatatatttggaagtaaggtaaggtgttccctagagttttttaatgttttttttt

SEQ ID NO: 520658 - DNA, 124 bp, Homo sapiens
tgcaacggcgacatcgagggagaacagcatctcagtggtgatttccaaccaagcctttgttttcggtgtggggttatgggggtttgctttaatgtttttgaaattgtaaatgttggcttcatgt

SEQ ID NO: 520659 - DNA, 325 bp, Homo sapiens
ccggcggctcagcccggctctgactggtgctccctgcagtgccttctccatggccccgccctccccgcgtgtgtgccaggcttggtgtccccctgggagagcagagcttgcgcctcgggcatagggacgtggggtgcaggcgccaacatcagtggcagtagccagggcccgagtgtccagtcccactcggcggatggagtggtgcctggcggacaaaccagtcactcggggcagtggaatgctggcatggagcgctcattccattctatataattgcagtgtacaaaattgtgtcagtatatagaataaactgtctgttgacacg

SEQ ID NO: 520660 - DNA, 713 bp, Homo sapiens
tcgggggatgtgggcggtcgcagctgccggactcggaactgctgttgcacccgggagctgcgtgtcccaggagttccttctcctcactctgggagcagaagaacatagctgttgaaacgtgatgtaagagttagacaacatgacagtcttactgatcgctttatgtccaacatgcaataccattgcctcagagggatttgccgaagaatagatgggggaaaatgatggaaaagaaacagagaacaatcgatgagattgaataaatgagactaataaggagtagcactgtagatgggttagaggaaaagacccctcatcgtattagatggaagttcaacaatgtacagagcatacaaagtgtagacatacagacgagacgacatggagataatgatcgactgaagcctcccccgcaggcgagctttaccatgtaatgcctttaggacaagattactcaagattcctcttgcgaggtgtgtttcaccccctcaattatgttgtgcttgccacattatgcactgatgaagctaataaaactggaacacaagtaactaatgacgctaaatagaagcatgacttaaggcataggaaaagtccttcaggccctgtgaagtcgccactcattgtcccctgttggaactactccagtgaagttaaacgagagctgctcctagagaagaggcagaggccatgaataagctgaagcccccaaa

SEQ ID NO: 520661 - DNA, 110 bp, Homo sapiens
ataattgcttgattatacagatcactagagagctggtctaacccaaaacaagtaggtagagggcaaaggatcccttttccctagttgttacctggaccacccaaggaagg

SEQ ID NO: 520662 - DNA, 614 bp, Homo sapiens
tattttctttatgagtaggtccttttttttcaaagtcgtgaaacatcttcgtttgtaaaggctctttatgttataagtagaattcatccattagaagctttttgatgctctggatattttgatctgtatacgtggtatagatgttagccagctcctggtgggagttgtctttggcgttgggttcagccctagatctgctgtgccaaagtggcctttcagtggagtcagtttgtgttgccgttcggtgcactcttctttgcgttttctgctggagacgttcgtagcgccgtgtgtctggactgggttctctcttgctttgtcgcttgctttgggtctttacctcttcgaaattgtatccccctgggaggcctctctgtcttccccttctcgtcagtgttgcagtgccttctgatctgccgcttcttgccagtgactgtttggatcgcaatccccatcggttcgcggctttctgcttggggtttctatcgggccaatcttgttgctccttgcttaaggtgcgcctggtctatcggggttgtgggtttgcttcggtctttgattcgttgctttcgtcttggtcaatgcgttgggtttcattgtggttctcctttctg

SEQ ID NO: 520663 - DNA, 83 bp, Homo sapiens
  misc_feature (83)..(83): n is a, c, g, or t
ggtaccctggctgtgctgatcatgtgggcacctgagcctccgccttctcctgggtcttccagctcacttagttgagtgtctgn

SEQ ID NO: 520664 - DNA, 237 bp, Homo sapiens
gcacggaagaggacagtggtgtgtagacggggtagatgcttcaaggaggcggaggctgtggtgttgtcaggtaagagtgttgtttcagtggagcctgggctgctgtggaaggtagtagattctggaccaaggtgatgatgctgtgtgtactgtcagggcgacagtgttgtgtcttgtggagccttgggcttgctgtgggaagcctgtagattcctagactgacgcctggcactggtg

SEQ ID NO: 520665 - DNA, 159 bp, Homo sapiens
caagaacgactaagagctactgagtccagagactactgaagggcccctggcaaagtaatagggttgctggctaagcctctccctccagccatgtaggcagcgtgttcttaactatcctaacaagccttggaccaaatggaaataaagctttgtgatgca

SEQ ID NO: 520666 - DNA, 527 bp, Homo sapiens
  misc_feature (395)..(395): n is a, c, g, or t
ctccacccgagcggggtgaaggtgtgcttaaaaagaacaaacaggccaggcgcagtggctcacacctgtaaatccctagcactttggtgaggccgaggggggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccactgcactccagcctgggcaacagagcgagactccgtctcaaaaaaaataatgggacaagcaacccagttagggggatttcattaaccaatggaggacggcctcccttgtcccctgccaggncctgcggggaaggtccacggccatgtcctttttaacgaaagccaggtcatcagggccctcccggtgtttgagacgctagagtccgtcaaggaagcccggtttcctatgggcgccgcctagggacgtgactca

SEQ ID NO: 520667 - DNA, 697 bp, Homo sapiens
aatccgtcccgaactagatgatattgactaccactgacatgactttccaaaatggcacataatttgaatgcaacagcaagccagccacaggctaattattagcatcatccctctgctatgttgaaccagatcaacaacaagctatttagctgtgccccaactttttctccgagcccctaagcaaggccgctcctaatactaactatctgagtcctacccctcacgaatcatggctaagcctagaagccagttatccagggaaccaatttatcacgaaaaaaacttcctacctctctatagtaatctccctacaaatctccttaatgatgacattcatagcccagagaaataatgcatatcttatagcttcttcgagaacacacttatacccacgtggtatcatcaccgatgaggcaaccagggcagaaggcctgaaggcaggacatacttcctagtgctacagcctagtagggtccctttccctgatcatcggactaattaaaactcacaacggcctagggtcactaagattctactagtcagtctcactgccagaatataaaattcctgggcaaattatttgctacgtaacatagtttcaaggaaggtacctttggggcggttgatcctaagcaagtgagcctcgtgtgaaactgcggactgaaaaggaggaaaaccacttaccgaaaaggccttg

SEQ ID NO: 520668 - DNA, 749 bp, Homo sapiens
ggaggttgcagtgagccaagatgcaccatgcactccagcctgggtgacaagagcaaaactctgtctcaaaaacctccgactcaaaaaaaaaaaaaaaaaaaaaaaaaggaaaagaaaaagaaaaaaaacaagggggcctggccggggaataaaagggatggggccggatgcgtgaggtttcacaaaaggattagggaaggtcccccggagaaagcggtgactcatttctgttttgggtcctgctttacaccttttggattaaaaggggtgaccttttggagttaaagccccttgaaggagggtgaggcaagggaagcccttgttgctctagtgcggggaaaggagcattcccagggcagaggggaacaacgcgatgtgcaaaacgcccttgagctgggagaattgtctagactttgtccacagggaattagtgagggaagaccctttgtgggcttggcgagagagggtgtagacttagaatgcggagaaaactgtggcgcgacaactggtggcgcacaatgcaagtggtgcacagaccgcagaacttcgggagacctggtgggcgccacggggtggaggcgacttgggcgctttgggtcccacaggcgatggttgggtctatagacccagggggtgaggagacccaattttatcccggcgggggccaacagggatccctctgggatgcttggtgaccagcccagcctagggggcgccacacgaaaggcacccggaaccctgcaggaagc

SEQ ID NO: 520669 - DNA, 233 bp, Homo sapiens
cctgggccggttacttcgtctctcttgcgatagcgggtgctggatggcttcttttcgcgttgagggtggatgatgctctgccctggtccttttctctttcggtcctgcgcgcctttggatcggtctccgtcgggctcttgcgctactggccgtcgttatagactttggcccgatgttggcttttagcgcgtctgatcctggctcgaatggtcacttgtggtggtccgagcgga

SEQ ID NO: 520670 - DNA, 227 bp, Homo sapiens
agcctttctgggcaagctcctccacagtgcctaaaagagtttctcgtagatgtgtcaggagtgaacagatatattgtagggtgagaatttgcatagaacatttctctttgggtctagggggaaaagtctggttcctttaagggcagagattgcagtaaataaatcacctaaaggctgactgacagtgtaaccatgaggaggataacacgaagggaaaaggtcgacgc

SEQ ID NO: 520671 - DNA, 231 bp, Homo sapiens
gaactggtcaacgccaacaccgtgggcctcgccgtgctgtggatcgacctcgacgccctcaaagaggtcaacgaccgcctcggacatagcttcggggacatcgtgttggcgacgatcgcgacccggcttcaacacactgcgcgccagtatgacgtcgtcggccgcctcggaggcgacgaattcgccatgctggtcacccgcgtcaaggatctcgacggaaacgcggggctg

SEQ ID NO: 520672 - DNA, 429 bp, Homo sapiens
gctcgaatccctacataataatagatcaaatcggccgtggggaacatcatcgctatccagctctttgagaaccgctaccatcagcatgtacaatggtaccctcgtgtcatctgcagcgagaacttcaacgtttgccaaatcaacccaatgtggtgacaaccacacctccgaaatctgctccaaaagatactccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcaggaacgcaaacgctgaaaaactcca

SEQ ID NO: 520673 - DNA, 156 bp, Homo sapiens
aattaaccagctaccatgtactattgaaaaatgttcagtttgaaatcaaatataattttatggttctgtgagtcccccatatttaatatttaatattcaaacgcatgcatatcgacagagcatgcagtgaagagtattaaaaaaaaaagcttcgta

SEQ ID NO: 520674 - DNA, 140 bp, Homo sapiens
aattttgcccacagaaccctctaaatccccttgtaaatttaacttttaggccaaagaggaacagctctttggacactaggaaaaaacctttagagagagtaaaaattaaacacccatagtaggccttaagagccaccaat

SEQ ID NO: 520675 - DNA, 440 bp, Homo sapiens
catacctggaccttctggcatacctggaccttctggcatacctggaccttctggcatacctggaccttctggcatacctggaccttctggcatacctggaccttctgggttctttccagcccttggagccaaaagctctctgaatctctaggcatgtttcccatccagaaatttaggcagtgggtcagtggatggcctctgaggggcctgccagctctgatgttctgaagacctggaaagagcaaagagcccaatagtttttaatgtgtgatccattgagccctagggaatcccacagaggtgtttcaggggctgccatgagcagttctgattctgtcttttatatattagagatctacagatgatttttgtttgcaagggagtgccacttctaaatacaaacaaagagaaacaaaacagaaactttaaagcccctgaac

SEQ ID NO: 520676 - DNA, 111 bp, Homo sapiens
caaaaacagtatggctaccccttccgtgatacgtatccctatgaggcataattataacaagctccatcgtgcctactgacaaacagacctagaatcggcttatatgacgtt

SEQ ID NO: 520677 - DNA, 280 bp, Homo sapiens
  misc_feature (59)..(59): n is a, c, g, or t
gggtgatctcagagatcccaccagaatcttcagtgctaccactggtcgtcacatttgcngaggaacgggtgataatcatgtggcagacttcacatttgcgatgactggccagactaaaaagatgatagataactttttgtcaacatatcttgaagagtttatatcacgcacagtttaaaatcatgatgagatgctgatggttggactatattcatgtctcgtatgtggcaccatatgtgggttcacagtttatccatgatggagcatgccaagagaacat

SEQ ID NO: 520678 - DNA, 408 bp, Homo sapiens
cggccattatggccgggggtcaggcctttaaattaggtagccagaggcttggccatcggttaaaccactttccttccttttggctgaaggcattatgttaaccaaaggaaccctataatcaggccccattggacgttaaactttttaaatacctataagggaatattctccattcgttacactgttaattagggtagaaggaggcaccttttcccctataactatgccatggttaacatccagccttcttggatatcatacccgaattttggcggttaagcctcctacctgaccatcttaatatatgcataaggctgtccagttaataatctagcacttctgagaagggtattacaaaggcattactgagttgggaaaaattaaatttaggataggggtctggtagaa

SEQ ID NO: 520679 - DNA, 1361 bp, Homo sapiens
ggcgccgcggtcgcggtggctggcggagcgggaagctgggtaccctcttctgtgcctgctggttctctgacccacccacctgcagacgcacgtggtgtgtggctgctcacatgttgtggcacgctgctctgcgtgtgccggtgggcggatgtgtttgtgacaggcgacgtgccgaggagcttgtggagccgctggtccactgcgtgggctgtctcgcaggctgccctcgggctgatgtccttgtgctcgcctcctcgccctcgtgtcgccctgtggctgcgctctgcatcctaatctggctccttcagagcccccctcatgaaaccaaggggaggaattccgcagttcacttcccatcacaaacccaaatccttcatctgtctgcctcgggaacagcgcatcctacagcccctgacgccagctccttctgcactgccatgccctgattcttccccgagctgggttctagggccctgacgaggtgaacccctcctctgctgggtgagggagtggagaagagttcgagtaaagattaatcaatatgctgaggacagcggtcttgcatagtgtgtcctgctacgggcaactcgaccgcatcacggcacgctggaagcatgccacacaccagcaagctacgcacacggcgctacgcgaagcgtgctttcgcctgcagccataccaagcactgacgcgcccagccactccaatcagcacctgtccacatattcccattgcataccgcacgtaaccacatgggtcggtacatattgcaaactaccataactacttaggcttgtacacaatcaacagcaatgacttcatgccttcttggcatctcgctacgacatgacaggcgccccaggtcacatagccctcaagacctagcagagcgcatattttatggtccaataatatagaccacacgtgcaaacgatctacacataacccacgggcgaccctgctcacaacttacccttggacagattacatgaaacgaacaccacgtcgtacgctaacatcctccctttacgcaacgatgagacgacgcatacaactacgggagcgtaagtttgtgacaacctagtcgtctctcagcgcgcgtcgtgaggggctagagactgacagagcccaacccagcaaagagatacacgtgcgaactaaaaattgactcatgttctcgccgtgtcggttaactgccgtcagtcgcctcttcctctgccatcactaccatgtctcactcgtgcacccccgtcgcccgcgacacaccccgcgccgggccgcaccctatgcctgtctacgctccctcgaacgtgacgctactatacgcgtcacggctagtaacacacgagcagcacgagggt

SEQ ID NO: 520680 - DNA, 133 bp, Homo sapiens
gagggtgtcaatggctttggtgtgagcaatcaccatcctcccacgagtatgggtcggcggggatgtcgtgcatcaggtacggccaccagaggttggcacccagcgaccttcgctcattgaggttccagatgga

SEQ ID NO: 520681 - DNA, 220 bp, Homo sapiens
caacccatggcccacgatgactttgaatgcgtcgcaaacccgtaaactttcttaaaacgttatgagattttttgagtttttttttaaagctcatcagctattgttagtgttttttttgttttgttttgtttttgtttgagatggaatctcactctatagcccaggctggagttcagtgagctataatcacaccactgtactccagcctggatgacatcaa

SEQ ID NO: 520682 - DNA, 120 bp, Homo sapiens
  misc_feature (1)..(1): n is a, c, g, or t
naggggctgacgtcagatctttgctcctgacgtccctcagaatgcacgtagattgaccacaccaagggcagccgtccgaaggcgagagcaggaaatgttttgacctgagtccgcgaggga

SEQ ID NO: 520683 - DNA, 391 bp, Homo sapiens
gctaacgtattcccaaaactacgttcgaaaagataacgtcaatgaaggtagaaactaaaacccctagagagtggctttggggttattttacggtccaaagtctcttttactggtagggataacctctttaggtattaggccttctttgatgaggtatcgtttacttcaaagaaaaaaaattgttataattttgccataagttatgcatatttagatggctgaataactgttactttgaagagatgaacctgaccacctcagttttttacaggttccctcaggatgacttcccaaaataggactcggtatgaatttgttaagtaatctgatttatgaagttagctgaacaagtttagataagaattatgtgtatgaagcattaaaaaaaaaa

SEQ ID NO: 520684 - DNA, 155 bp, Homo sapiens
tccctttgtccccccgaaagaaaaaaaaaaaaaaaaggggggggggggcctttttttgggtcctttagggggggggggaaacccttaggggccccccttttgggtgggaaatttttgggggcccgggggttttaaacccctttttttttccccta

SEQ ID NO: 520685 - DNA, 377 bp, Homo sapiens
  misc_feature (96)..(96): n is a, c, g, or t
ggagtcctgctcttctccctctcacaccacaccagacaccgatccttcctgtctctttctttcctccaactgtttcctcccaatttccctcctccntttttttttttacaaaattaatggctttccaattaacttttttgaggacaccttccctccataactttttttgagacacctctttgtgaaccaagggtatatagggattgtgacatgggtaacacaatacagtagcccagacttttgagtacagtgaaagacccccatttaaacacgctcatctcaggttatactctgtctcacagatctaaaaactccatgtgctctccctggaggagggctattttcaagaacatgagattcatttctctctccacaca

SEQ ID NO: 520686 - DNA, 254 bp, Homo sapiens
ttttttttttagtagagatggggtttctccatgttgtcaggctggtctcaaactcccgacctcaggtaatctgctcagctcagcctcccaaagtgctgggattacaggcatgagccaccgcgcctggcctaaattggtttatttttaagattaaaatgtgtaggccgggcgcgtgacccgtgcctataatcccaccacttttggagccaaggcacgtggatcacctgaggtcaggagttccagataagcctgac

SEQ ID NO: 520687 - DNA, 389 bp, Homo sapiens
aagatatctgcgctaaaggggagcatatcatggaggacagaactcaggttcacagagatctgtctgttaaccatggtcataatctgaaggccatacaccgatatacctgaagcatctgagtccgagagtgccaatatacgtggcacatgataccgctcgcagtcaagtggcctagcccttgcacagctacactatggaagacgagatgttagcatggcatacatggcgcaagctgctttcaacagagcagccagtggaggacctgagcgacatgtggtgagccatattctggaaatgttggctgacagaatgtagttccaagctctgtaagagacctgacaagttaagctatgagacccggcacatactggtatcctatcgttgcagcg

SEQ ID NO: 520688 - DNA, 681 bp, Homo sapiens
  misc_feature (9)..(9): n is a, c, g, or t
  misc_feature (62)..(62): n is a, c, g, or t
  misc_feature (162)..(162): n is a, c, g, or t
  misc_feature (289)..(289): n is a, c, g, or t
  misc_feature (359)..(359): n is a, c, g, or t
  misc_feature (463)..(463): n is a, c, g, or t
  misc_feature (472)..(472): n is a, c, g, or t
  misc_feature (479)..(479): n is a, c, g, or t
  misc_feature (482)..(483): n is a, c, g, or t
  misc_feature (485)..(485): n is a, c, g, or t
  misc_feature (489)..(489): n is a, c, g, or t
  misc_feature (491)..(491): n is a, c, g, or t
  misc_feature (494)..(494): n is a, c, g, or t
  misc_feature (496)..(496): n is a, c, g, or t
  misc_feature (530)..(530): n is a, c, g, or t
  misc_feature (544)..(544): n is a, c, g, or t
  misc_feature (556)..(557): n is a, c, g, or t
  misc_feature (560)..(560): n is a, c, g, or t
  misc_feature (568)..(568): n is a, c, g, or t
  misc_feature (574)..(574): n is a, c, g, or t
  misc_feature (576)..(576): n is a, c, g, or t
  misc_feature (579)..(579): n is a, c, g, or t
  misc_feature (583)..(583): n is a, c, g, or t
  misc_feature (585)..(586): n is a, c, g, or t
  misc_feature (596)..(596): n is a, c, g, or t
  misc_feature (619)..(619): n is a, c, g, or t
  misc_feature (621)..(621): n is a, c, g, or t
  misc_feature (650)..(650): n is a, c, g, or t
tcaaacccnttcccggccaaaagaatttcataaaataaggaggaaaaaaattggagtcagtnggagcggggtgcctggtcattcctagaagacaggcagtgtctttatgatggttagactttgagcaacgctgggattcttatctgggtcctatggcctgcnatgttgagagcaggcagcaggatggggacctggaagaaggaaaaagaaaaaaagtaataggcttcttggcgctgcacatgaacgtgtgttttacaggcgcacaggttgtgcattttccttgtgcttnaagcctccatctgccatcctctccctgacagcagcctaatacttcacacctacatttctttctgctggcntctggcatccgcgcaaaccaagcgtttctccaacagaactgctagctgattagcgcaacactgcaaagcgctaactgctgtgatttgcgcaacactgcaaaggnaacagctgntccaggnggnntnagananaananttaagaagttgtttgctccaattagatatccttnattttttttctctnttaaaacaacannctnctgacagncattgngnctnaagngnngcatgccttnaattctgctattacgcttaaagngncttcttttttgcattcttagataaaaagnctttaatagatagaggctatttttgcagctg

SEQ ID NO: 520689 - DNA, 428 bp, Homo sapiens
catcattccagcgtatgtaggatgaatcgaaaatagattctggaatttatgatgaactgtaagatgtgatgttgagcatcgtttgtgatctttaggtgcctctaaaagtatcatcatgcgagtcgcagccgtctgccactgcagaacatgatggccagcctaaaatatataaggtcctttcctgtgaacaccctggctacagggcacggttccggctcttgtgtaagaattttgaccgcagagcccagtactttggctgtgtgtaatgaaaagggttgggatgagttagggagagctagcgtggtggcagcttctagggctgtttttaaggaatggaaagaggagtggcgaaaggaattaggatctatggggtcagctaggtttgctaggacagaataatgggttgtggagggaggtattgaggatag

SEQ ID NO: 520690 - DNA, 91 bp, Homo sapiens; identical to SEQ ID NO: 486805

SEQ ID NO: 520691 - DNA, 218 bp, Homo sapiens
ggatttgctggtgcagtacaactaggcttaatagggctcgaattcggcctcgaattcgaggtccctagaaaaagtagttctcggctgggcacggtggctcacgcctgtaatcccagcactttgggaggatgaggcgggcggattgcctgagctcaggagttttgagaccagcctgggcagtatagtgagacgacccccaccccacccccgtctttaaa

SEQ ID NO: 520692 - DNA, 246 bp, Homo sapiens
agacagtagaggatccccgcgaacaggacacgcaagtgcatggaatgcggaatcaatcttacacacagcttccaatatttaactgggatttatttaacttgaggacgatgtgcatttccaaaaggcatgactatgagacgagcagcggcccatccttatatatgtgcgtatgccgactagtagagtcctaaagaattggcatttactgaatacttgggaaaaatagcttttcagagatggacccag

SEQ ID NO: 520693 - DNA, 969 bp, Homo sapiens
tgccaccacgttggtggctatttcctctcgcggagccttccacacattgtagattattcgggttggctcacacctggccgagcatttttcacccaccgaaggggccaccaacattggtgtccggcgtgctcccccctcgtgggggattatgtgttcgtctctcgagagtggttttttacccgggtgcccgtctatgatccgtgggcctatatgtttgtgcgcgtctgcccccatatgtgggtggccgcccccccttgagctgtggccccccccgctgtgtgatgtgatgtgggtcacacacactgtatgatcctctgtggttggtacagcacagtgacaggtgttagacgcatgttcgtggcgcttcttatgtgcgaggcggttgttccccgcgcgattaaatggagatcgtggcccgccccccgctttttgtctcgtggggtaagattgtgtgccgcctccgctcttgtatgtggttgactcactggttgtgtcgtgcgccctctgttggcacgcgagtttatatgatttcgattactgccgcgctctctttgttaagggatggttggccccacaatcttttgttgcgcagtttttttctcagcccacggggagttcacttaggcgtgcgccgccctctctttatagttgccgccaaagtcttaactcacgtggtggatatgataagccccctcttcgttaggtagttataagaatatccctcgtcaacccactgggcggtccactgcttcttcctggttgtccaacatgcatgtagtgaggagcactctcttcgaatatgaatttagttttgtcaatcgtttgtataagggtggcgcaagaggttgcccctaaatgatggttgtatgttggcccaccgtagggaggttgttttgagggccccgggtccttttgtttttgttaatatatttttttttaaaattttgtgaaaccggaaaaaataaatta

SEQ ID NO: 520694 - DNA, 1010 bp, Homo sapiens
ctatcatatagtaaaacccagctcccgtgacccctaacaggggtccgctcaaccctcctaatgacctccggcctaggcatgtgatttcacttcgcatcctcgcattaaactgctgggcctcatacttagggcctactgaaaccaacacaatatctgcgttcaatcccgccaactaatgaatttcatcgttaacattccaggagatcgatcgaactattggctatcgaaggtccggccgccatgatgactggcatattgtagcatgtggcttggacgcaattgcttgctatgtcttcgcatctactggatgagcgcgtccgtacaataaacagtatatcaaagagaaaacattttcgcggcgccgcctaggaggccacacaaaaaagtgctgtgcccgacacactcccgcttggaagagccggcgtgccaccaaatgtctagttgggacccggggcgcccagcgggggtcccacaagcacaatcctgcgagtaccacggagcacgggaggagagtccccgcccaagagaaaaaccgccgccgggggcacaacacggacgggatgtcagcaccaagaggccaaagggggagtctgggagaccacaaaccgcagatgcgacacaagaggcgaggtcgaaggggagcccgaaaaaacgaagaatttccccccggagggcggggggtaataacattagagcagccggcggcggaaaagaacaaagcaaaccacaaaaaacaaaaaacggaagagggaacggagactgcaagaaagaagacagcacaaggcgatgagaagtcaagcgaagcgcaaagtggcgtgtccgaacacgacaacaagacgacaaagctaaaaataacacaaaatgatacagcagcatgagaatcgagtactgactgagcggaacaaaaatcaagtcactaatcacaagaacgacccagaccaattgaccaacaacgaaccgatacgagttagacacatatcaacgcgcaagccagtattcgaaaaagacgc

SEQ ID NO: 520695 - DNA, 365 bp, Homo sapiens
  misc_feature (41)..(41): n is a, c, g, or t
  misc_feature (75)..(75): n is a, c, g, or t
  misc_feature (86)..(86): n is a, c, g, or t
  misc_feature (115)..(115): n is a, c, g, or t
  misc_feature (331)..(331): n is a, c, g, or t
tggcttagactgttctgacaatttaacttgggattattaantgttgagccattttccccaaagcagggaaaccantggtctttgantgcctttcccacagacacagcacaaatgntaggcttttgttgcatggttgtacaaagaacataagagtccatatttttagtggatttgtaaaataagtgtgtgtgagacacttgtgtttgaagaaagatttagggtttcgggttttttgcatttatatgtcagaaaaggggtgatatgttgttgaggggtgagtgcatatgagtgtggccttgaggaccagggctggcagatgttgtttacctgntgaagaataaagattttttttggtaaaaaaaaaa

SEQ ID NO: 520696 - DNA, 104 bp, Homo sapiens
gtttacccctcttgtcttcctgcagtaccacacttttgtcctcttaacctcctcgaggcgcgttctctggtaaggtcttttagggtttggggggacgataaggc

SEQ ID NO: 520697 - DNA, 699 bp, Homo sapiens
  misc_feature (8)..(8): n is a, c, g, or t
  misc_feature (82)..(82): n is a, c, g, or t
  misc_feature (104)..(104): n is a, c, g, or t
  misc_feature (129)..(129): n is a, c, g, or t
  misc_feature (167)..(167): n is a, c, g, or t
  misc_feature (208)..(208): n is a, c, g, or t
  misc_feature (213)..(213): n is a, c, g, or t
  misc_feature (217)..(217): n is a, c, g, or t
  misc_feature (295)..(295): n is a, c, g, or t
  misc_feature (311)..(312): n is a, c, g, or t
  misc_feature (367)..(367): n is a, c, g, or t
  misc_feature (393)..(393): n is a, c, g, or t
  misc_feature (402)..(402): n is a, c, g, or t
  misc_feature (404)..(404): n is a, c, g, or t
  misc_feature (422)..(422): n is a, c, g, or t
  misc_feature (466)..(466): n is a, c, g, or t
  misc_feature (478)..(478): n is a, c, g, or t
  misc_feature (495)..(495): n is a, c, g, or t
  misc_feature (504)..(504): n is a, c, g, or t
  misc_feature (516)..(516): n is a, c, g, or t
  misc_feature (518)..(518): n is a, c, g, or t
  misc_feature (639)..(639): n is a, c, g, or t
  misc_feature (655)..(655): n is a, c, g, or t
  misc_feature (660)..(660): n is a, c, g, or t
  misc_feature (683)..(683): n is a, c, g, or t
  misc_feature (686)..(687): n is a, c, g, or t
  misc_feature (689)..(691): n is a, c, g, or t
acataaangagtcaatatatttaaccatgtttgacactcttcttttatccctttttaatacaatcaccacaacatagagtanaatttaggtttcaactgatgtnaaagcacatttctgtctctggtggnttttaaaaaaattacatattatatatttgacattttanaagacaacagaaacaattttacagattactccacctttacncccantttnagctgaaaggttttaagaaaaatcttgcaggttatgaggaccagatggtagcttaaaaacagatccggaacttttttnttgaaattttatttgnnttttttttttgtatctcaagaatatcttaaaggaaaaaaaaaagggttctatganccagaggaattcccaattcactttgnagattaccntncctattttgccatattanacatttcaattctgttaactaaatgaactacataatatccttanaaatcagccagntaagagtaaaacaaatntcgtcttcnttattgactttnanccaaaacttattctttcaaaggagtagtttaacctactaaatatgtctattataagatcttctttcttatgatagtagtattccttctttttcattcctgaaatggtatttcttacacttnaacaagttatggacanttgtnagctaagtatcagttatgataanttnntnnnattaaatt

SEQ ID NO: 520698 - DNA, 330 bp, Homo sapiens
aggaaataaagcaattgcaagaagtaaaatcttggaaaaaaatttagacgaatgtataactagaataaccaatacagagaagtgcttaaaggagctgtgggagctgaaagccaaggctcgagaactacgtgaagaatgcagaagcctcaggagccgatgtgatcaactagaagaaagggtatcagcgatggaagatgacatgaagcgagaagggaagcttagagaaaaacgattacaaagaaacaaacaaagccacccacagctgcagctgcaacccatcccgcaccagctgccagcagagtccatcccaccacctccttgctgcctctg

SEQ ID NO: 520699 - DNA, 160 bp, Homo sapiens
atttgttcacccccgggtccgggggggccccctggggtttttttttgccctgccaactttttattgcccgggccgggtggtttaaaggcaaataactcccctttggtacccaacggggggatggccccaagcgggcctttttaatccgccccccctaaga

SEQ ID NO: 520700 - DNA, 155 bp, Homo sapiens
agataaactataattcgagggcgcaaacccttcgcgttgggatgcgtactttatcagatcaaacaagccggtcagcccctctgcggcccgtgcgaggacgggcgccggctgatatggtgactctagataacctcggtgcgatcgcacgccccccg

SEQ ID NO: 520701 - DNA, 206 bp, Homo sapiens
acatcgagacggcttagtttattcaatgcaaaagaatcctgttgagtcaacacatgttgattaaacacgtgaagttactgggaggagtccatgatgctggacgcactgtcaaagacaatcatctccgcaatgttcgtgggcttcaggctctcttgctggctgcagataaagatctgccccatctgtcgtcttcgtgcacctgtata

SEQ ID NO: 520702 - DNA, 775 bp, Homo sapiens
agcgggcgcttgccagccagtccgcccgtccggagcccggctcgctggggcagcatggcaggggttcgccgtctgctctgggggccgcggtgccgggggcgctcggccttttggtgcttgctgctgctcggcctgtttcggccgccccccgtagctctgcgcgcggccggtaaaggagccccgtcgggactacgcgcagcgtctccgtccttggctgagactggtgctcctcgccgcttccggcggctcagtgcccccgaggtgacggcggccgggggcggcgcaggagctggcgctgggcgctggcgcatctgctggaggccgaagcgtcaggagcgggcgcgggccgaggcgcaggaggctgaggatcagcaggcgcgcgtcctggcgcaacctgctgggcgctctggggcgccgcccctgtaacatctgattccggcatcatgggctctggacgacgaccccgacgcgccttgcagctgcaggcgtcgctctgcgcttctgtgtccgcgcccggcttgacccctggcgacctcgcaggccagccttgtcccagcgcccgataccaggcgtgggggtccgatgcatggacccctgggcgtacgtacaaaggtccagtgcggcccgccgatgcagtgggagggtagggcagaggaggatactccgaccgcaggaacccctgaaacagtacgagagtacctagctagcgcaacggatacaagcagggcaaacgcgaaatgcccagagcggcgttgggagccccgcgagggacccc

SEQ ID NO: 520703 - DNA, 1359 bp, Homo sapiens
ttacactacagcctgttgtctacaacagagcagctctgtttgtttactagatataatcacagtgttgccattctcacacggaggtggttcacttaatactacgtaatgatcatcaacgctggtggaacacgcgcggcatttttccctatttgcgggggaaaaaaacaccgggcggaactaaacccaacaacaggtgggaggggtgccgcgtacacaatgggccgcggtgtgtgttggaaacccgcgcgcgggggttcccaacaaaggacccacgagtggtgtgcacactatgttgtgtattaccccgccgccctgtgatatgctgggcgcacttctctattattaatttccgggggggctaatacaaatcacaaatagtaaagggtttttaaacaaccctgggctgtattattttcttttgcccgctgtaaagcttatgggaaactgtgccagagaactgtaagtagatgtgtgtgaagtgaggttaatgaaccacagcggtgggtcttaaacgggggccacccaacggggccgtttgtaacgctgttagggactcctccaattcgggggatgaaattgggaatagactctttctgggaaaaattggtgtgcaaagacttttggggtaataggttaaaatccgggttaaatggtaacttacggtgttctctggtgttggtaatatggtttttggttaaaggtacaccccacctaaaatgcgtaaaatttttaaagagggagctccccaaaattgtgcaacatgagaggccacggcttcaacacaagggccttgtggttgccccccgggttaccctatgcaacagctgcgcgagacccacaagggaatttgcacaccccgccttcggggcccacacgtggttgggggccctggccctggcacagggtctactcctgtggcttcggagggcccacttcttcgggcaacaaggggcccacacctccggccccaaccccttccacggacaccgggcttcaacggcttaaccttcaaaccattcctcggcttgcgggcgttcttgttctgaaaccacacgcacgggggccttgagggacgctttgtctgtcgtgaatggggcacaagggcaacaagtcctggaattgttgtgtgtgtcgaagagggcccaaaggctggtggcaaagtgcaccggggcacacacggagagtctgtcctgtgacgcgcaagttctgagggttctgggcggcgggcggctgggtctgtgcatattctggttgcaccgcggcgcttcccagcacccaacatagtaaccggcatagtttccagcagaagaccaaaaagaccaacatgaaagtttagaaattaaactggttaaaccccca

SEQ ID NO: 520704 - DNA, 428 bp, Homo sapiens
ccttctgcctgcttatgggaaagtccccccatctcgtccgttttcttctttccttgaatgaaagagagctgatctcacccaatctaatatcaacctatctcattcgactgctcatccctaggccatgccaggatccatttaattcctacacccgtccagcttagagtgtacatacataaacagtctgcacctagctcttaggtcaggctgggtctcatcttagctgtgtacggcctcagctaaatgaaattcttatcggccgggataggctttcccctaaccaccgtatgttcgctccctcttatcaagctctccattaaacggaaccgtacatataacttcataaaacttccttcaatgtttatttatgcttttatatgtatgtacctggtgtgtgtctcttccaaccaatgaactataaagagagg

SEQ ID NO: 520705 - DNA, 1024 bp, Homo sapiens
  misc_feature (137)..(137): n is a, c, g, or t
gtagcttcagggcagaagagccacagagccaaatgctgcagagatgaagggagacggaaggagccaaatgctgcagagatgaagggagatgaaaggagccaaatgctgcagagatcaagggagacggaaggatgtcncctccagagctggggccacgggcagcgccagggcaggttcatcactgatggcaagtctgtggctgaccacgttcacaggggtggccctgagcaaaggtcggacatgaggacccaggagaattcaggccccggctctgggacggctgtgcacccccaccctggccgtggctggcacctcagaaggcacagctgtccttcactcgcacggagcaacctcgggacagatggtgggagaggaagggcaactcgaggaggcacattttaggaaactgcccacggagccagtttcgattctccaaacctcgtcagcatgcagaggctccctgactcggcagcaaggagggcctcaccagccgacccccatgcccggcacccccttcaccagtggcagggtcctgaaaactccagagagcagtgccctgtgcattaaacacagactgcgcccttgtactcaggaggatgcaattctctctctaaagtcgagagctcaccaccccgggcgttcgtcactgcagacatcactgcagacacagagacggccattagagctcaccaccccgggcgttcgtcactgcagacatcactgcagacacagagacggccattagagctcaccaccccgggcgttcgtcactgcagacatcactgcagacacagagacggccattatgcagcctcacgtggtcactcctgggggcggtaggatattttatcctaaagagaaaacaccttaaattctcacatcagccacccccatggcgactcttaacaccttaatgtagcaccttccaacttttcctgggcatttatgtacaaattgtaataaaattgggttcttactgcatacgctgcttgctggtttctaaataaaattgggttcttactat

SEQ ID NO: 520706 - DNA, 898 bp, Homo sapiens
  misc_feature (137)..(137): n is a, c, g, or t
  misc_feature (804)..(804): n is a, c, g, or t
  misc_feature (808)..(808): n is a, c, g, or t
  misc_feature (814)..(814): n is a, c, g, or t
gtagcttcagggcagaagagccacagagccaaatgctgcagagatgaagggagacggaaggagccaaatgctgcagagatgaagggagatgaaaggagccaaatgctgcagagatcaagggagacggaaggatgtcncctccagagctggggccacgggcagcgccagggcaggttcatcactgatggcaagtctgtggctgaccacgttcacaggggtggccctgagcaaaggtcggacatgaggacccaggagaattcaggccccggctctgggacggctgtgcacccccaccctggccgtggctggcacctcagaaggcacagctgtccttcactcgcacggagcaacctcgggacagatggtgggagaggaagggcaactcgaggaggcacattttaggaaactgcccacggagccagtttcgattctccaaacctcgtcagcatgcagaggctccctgactcggcagcaaggagggcctcaccagccgacccccatgcccggcacccccttcaccagtgggtaaactatgctcgccaccactcagcactcacctcttgggctcagagggcagaaagtctgacccttctctcttaaaagcagggtcctgaaaactccagagagcagtgccctgtgcattaaacacagactgcgcccttgtactcaggtatgaccatttgtcctggacaaaaattaaactgatgagggaacaaaatagggccttatagaaggtgagtggaacaagcagggaaggcaaaccccaaaattccaggagggaggatggaattggcctggggagcngagncaggangttctgtggacagggctggtggagctctggggggagcagaggcggaggtttgtggacatggttgatggacctctgggggaaaga

SEQ ID NO: 520707 - DNA, 572 bp, Homo sapiens
  misc_feature (33)..(33): n is a, c, g, or t
  misc_feature (61)..(61): n is a, c, g, or t
  misc_feature (229)..(230): n is a, c, g, or t
  misc_feature (237)..(237): n is a, c, g, or t
cgcaactcaggccattcctaccagaggaagaanggctggtctctccaccccctggtagganaggcctgccttgtaagacaccacaattcggcggaagtctgaagtcttgtgttttactaatggaaaaaaaaaatacagaagaggtttggtcctcatggctgcccaccgcagccgggcactaaaacagcccagcgctcacttctgctgggagaaatattcttggctctgnnggacatngggctggagggtatcacgttgccaggttctccagccagtgtgggcacacttccccatgttggtcagtgaccgggaaggcctgaactagttctcaagagtctcatccagagagcggccaacgagggaggcttcattacgaggtgatctgccgaagaaataccctttatcatcaagtgataaaagggcccttgaaaggagaatgccttcatcagccttttaagaaccccataatcctgagcaagggtgccgcttcgggtctgattcccaagggattgtctctggggccccagctccctcctgtgttcctacaggtgttttggacccattgctagatt

SEQ ID NO: 520708 - DNA, 430 bp, Homo sapiens
acacgctcatcatccccaggcaacttcctgatacagatcggtaaaaacaaccccttcttccaggaggatgcaattctctctctaaagtcgagagctcaccaccccgggcgttcgtcactgcagacatcactgcagacacagagacggccattagagctcaccaccccgggcgttcgtcactgcagacatcactgacacagagacggccattatgcagcctcacgtggtcactcctgggggcggtaggatattttatcctaaagagaaaacaccttaaattctcacatcagccacccccatggcgactcttaacaccttaatgtagcaccttccaacttttcctgggcatttatgtacaaattgtaataaaattgggttcttactgcatacgctgcttgctggtttctaaataaaattgggttcttactat

SEQ ID NO: 520709 - DNA, 1102 bp, Homo sapiens
  misc_feature (137)..(137): n is a, c, g, or t
gtagcttcagggcagaagagccacagagccaaatgctgcagagatgaagggagacggaaggagccaaatgctgcagagatgaagggagatgaaaggagccaaatgctgcagagatcaagggagacggaaggatgtcncctccagagctggggccacgggcagcgccagggcaggttcatcactgatggcaagtctgtggctgaccacgttcacaggggtggccctgagcaaaggtcggacatgaggacccaggagaattcaggccccggctctgggacggctgtgcacccccaccctggccgtggctggcacctcagaaggcacagctgtccttcactcgcacggagcaacctcgggacagatggtgggagaggaagggcaactcgaggaggcacattttaggaaactgcccacggagccagtttcgattctccaaacctcgtcagcatgcagaggctccctgactcggcagcaaggagggcctcaccagccgacccccatgcccggcacccccttcaccagtgggtaaactatgctcgccaccactcagcactcacctcttgggctcagagggcagaaagtctgacccttctctcttaaaagcagggtcctgaaaactccagagagcagtgccctgtgcattaaacacagactgcgcccttgtactcaggaggatgcaattctctctctaaagtcgagagctcaccaccccgggcgttcgtcactgcagacatcactgcagacacagagacggccattagagctcaccaccccgggcgttcgtcactgcagacatcactgcagacacagagacggccattagagctcaccaccccgggcgttcgtcactgcagacatcactgcagacacagagacggccattatgcagcctcacgtggtcactcctgggggcggtaggatattttatcctaaagagaaaacaccttaaattctcacatcagccacccccatggcgactcttaacaccttaatgtagcaccttccaacttttcctgggcatttatgtacaaattgtaataaaattgggttcttactgcatacgctgcttgctggtttctaaataaaattgggttcttactat

SEQ ID NO: 520710 - DNA, 709 bp, Homo sapiens
agcggaggtctaagaaggagagtatgaggcgagctccggaccgggtgcgggcggtattcagcggcacagagcgccggtgttgccacgccatctaacgctgcgccatgccaggcccgaagcgcggatggtgcagttggaggctcgagtgtgaacacgggtgtccgatcgggatagaaggaaggtgaatatataactcaaagtcttggaccggatagcagtgagattcacttcaaagtgaaaaatgacaacacatctcaagaaactcaaagaatcatactgtcaaagaccagggtgttccgaatgaattcactcaggtttctctccgagcgggtcagcagaattgcctgataactcatactccaacaagaacctgggaatggcggaagaagatgtgatagaagtgtatcaggaacaacccggggggtcattcaacagttcagataattcggtctgaagtctggtgcgttttccctcaagtccgttgtagctattgttttgaacaaagtaggtcgttcacgtaccgtggtgctttcaaaacaggaaattgaaccagacctggcgacccccatcgtctctcgaaacacatctggatcaactagctgaacatcctagtgctcaatccatcccataaattgacactgcgcaacccatagctgccttgatccctctgggatggaccacagccgatccagccccccttcatatacac

SEQ ID NO: 520711 - DNA, 1348 bp, Homo sapiens
  misc_feature (137)..(137): n is a, c, g, or t
  misc_feature (804)..(804): n is a, c, g, or t
  misc_feature (808)..(808): n is a, c, g, or t
  misc_feature (814)..(814): n is a, c, g, or t
gtagcttcagggcagaagagccacagagccaaatgctgcagagatgaagggagacggaaggagccaaatgctgcagagatgaagggagatgaaaggagccaaatgctgcagagatcaagggagacggaaggatgtcncctccagagctggggccacgggcagcgccagggcaggttcatcactgatggcaagtctgtggctgaccacgttcacaggggtggccctgagcaaaggtcggacatgaggacccaggagaattcaggccccggctctgggacggctgtgcacccccaccctggccgtggctggcacctcagaaggcacagctgtccttcactcgcacggagcaacctcgggacagatggtgggagaggaagggcaactcgaggaggcacattttaggaaactgcccacggagccagtttcgattctccaaacctcgtcagcatgcagaggctccctgactcggcagcaaggagggcctcaccagccgacccccatgcccggcacccccttcaccagtgggtaaactatgctcgccaccactcagcactcacctcttgggctcagagggcagaaagtctgacccttctctcttaaaagcagggtcctgaaaactccagagagcagtgccctgtgcattaaacacagactgcgcccttgtactcaggtatgaccatttgtcctggacaaaaattaaactgatgagggaacaaaatagggccttatagaaggtgagtggaacaagcagggaaggcaaaccccaaaattccaggagggaggatggaattggcctggggagcngagncaggangttctgtggacagggctggtggagctctggccacttcctccataaactagagacgtgatccccaggccaggtctgtctctgaggtcataccagctgggacaggaggatgcaattctctctctaaagtcgagagctcaccaccccgggcgttcgtcactgcagacatcactgcagacacagagacggccattagagctcaccaccccgggcgttcgtcactgcagacatcactgcagacacagagacggccattagagctcaccaccccgggcgttcgtcactgcagacatcactgcagacacagagacggccattatgcagcctcacgtggtcactcctgggggcggtaggatattttatcctaaagagaaaacaccttaaattctcacatcagccacccccatggcgactcttaacaccttaatgtagcaccttccaacttttcctgggcatttatgtacaaattgtaataaaattgggttcttactgcatacgctgcttgctggtttctaaataaaattgggttcttactat

SEQ ID NO: 520712 - DNA, 1666 bp, Homo sapiens
  misc_feature (409)..(409): n is a, c, g, or t
  misc_feature (449)..(449): n is a, c, g, or t
  misc_feature (636)..(636): n is a, c, g, or t
cggaagaccgctgcatgcccttgctaaggttcagactgtaatcccaaatagtgaatcaggctcttgggtagcactacagaaagaaatccgttgtagagagtaagaagtctatatagattattaacacgcacaataatgtgtagtgctcttacaagaacacgcacgaccataaattgtaatgaagtagcatgtccctaggcttctagcgaccgcaacttaccatagaggacaattccgctatacaccataataagctttgcaaactccatcctattaccctcaatttttggtgagcgcctaattcattagtcgacaccttaactagaaagaacatatcatgcgcttatgtttttaaagtcaagcgatgtgagccatacgattcattctcatgcctcgctattacaactcnttgcggttcacgtatcacatagtcaactcgaaccctgaanaatattctaaactatgatcgcaactcatactaaacaaacttgcaaaaactcaaacctaaatgtcaattgttaatataacgcgcctctatctggatacatagcgcctaaccaatcgaaggacattgcagtcgataagtggaagacacagcggtatacccgctcatacaggtctcatagcagggaaaancgtactgagtcgatacattcttaaaactcacacgggtcgcattgactaaaggggcgacacacacaacttagtacgacccctccattagggccactaccaacctcagggtaatctaaggaaggacgagggccgccctctcgctctctacaggtgaaaacactagtggtctttctagaacggaggcacgggcagagggtagcagcgctctaaaagccctcgctcgctacaacggtggtgtacgccgaatagaatcaaccaattttgctattcccctcattagaagagttgaggagagtagcgctttgatagagttggaaacctgggggcttcgcaaacaagaaggggggggtacatcaaggatcaggggtaccgtaccttttaaacattatttctcaaactcaccaacggattgtacaagtcatttctggtaggacatggtaccttcccggtttgctacccagggacgcggtctgaagagtgccaagttggtgaaccaaccccacggacaccagacggcaagtccgaagagaacaagaaactcccctaaactggggacacaggccttttttcacacttcacaaatttcctcaatttggccactcaacacaatttacctcggttaaaggcaatgaaacccccaagcaacggggattcggcttacacaacggtcatacccaaaaataccccttggacacaattatacgggcacaaatatcggcggggcaggagagagggcaaacaccacagggagaactgaggaggagaccccccaaagtaccatccgcaaggggaaggtgacccacggggtgtacgagaaactataaacacaggtcagaaagaagagaaaccaaacccacataaacaaagtgcaagagagcccacacagaccacatgtgacccgagcggcgaagaaagggattacccccacggggcgcatacacggacgaagacgacgacttatacagaagccagagcaaacgaacaacggggtgcagacaccaacaggagaagacagcaaaaccgacagaag

SEQ ID NO: 520713 - DNA, 315 bp, Homo sapiens
gtagtagcacaacctaggtcagttttgcatgtggtaagccatttaccaagatagttgtaggtaagaagggcagatttattagagaaattgtgtaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 520714 - DNA, 458 bp, Homo sapiens
ggacggcgatctttaaggtgtcattaatcaagttgtactttaggattcgcgctcattggtcagctgctggacagttagagacggggacgcattcacctcgatcagccaggccttcagccttgtcgctcgatcataatctcttatcccatatctttcctcgtgtgtgaagtcattgttcatcaccggcgccacagccttcagggactgcacgatgatccagtggatctcgtcgaacagcttgctggtcacctccttgccgcgggtgctctccaggtagagccgcaggttactcactgtccacttgcccccatggatgtggttgtagtcttccccgtgtttctggatggcgacgttggtaagatgaacgaacatgttgtccagctcactggtactcggggtgtatttcactgtgcagaaccggcaaaacccaagcttgtacatgtaacagcgcagtggac

SEQ ID NO: 520715 - DNA, 184 bp, Homo sapiens
gttgctctctcaagaaaggtgaggggattctggcggttccaagccccctgaggccacttcttggctgtgtggcttgggcgagttacttaatcctctctgggcctgtttcgccagctgttacatgggagtgctccgaacagaactgccttcgtggggtcactatgcacctccactcccgtaccag

SEQ ID NO: 520716 - DNA, 244 bp, Homo sapiens
tcccgagcgtagagtccagtctgtcgcccaggctgaagtgcagtggcatgatctcggctcactgcaacctgcatcttctgggctcaagcaatcctcccacctcagcctcctgagtagatggagctacaggcacgtgccactaggcccggctaatttttgtattttttgcagacagggttttgccatgttgcccgggctggtctttgttctcctaagagttgttttctccatgaaagttggtcga

SEQ ID NO: 520717 - DNA, 173 bp, Homo sapiens
gtgccaggaggcccctgccgcgcggggggctgggtctggttgagtcgctgttttcccgaggcagcgcagggatccggggaagctgcggcagggagcgggtgccggcttcgtggctcttgaggtgtaacgggggtaggctccctccctcggaggacatcggtctgtgtccaggt

SEQ ID NO: 520718 - DNA, 127 bp, Homo sapiens
tatgaaaaagagctttatccccttctcctatagggaagcggatttgtcttggtgaaggcattgcccgtgcggaatagttcctcttcttcaccaccatcctccagaacttctccgcgatcgaagtgtg

SEQ ID NO: 520719 - DNA, 271 bp, Homo sapiens
gaattgaattagggcccgtccagacaagcaatctagaagtccattctcattggttgaccttctgtggtgttcctgaaattgccttgtagccaatcagacactaagtaaacccagagagccttgtgaacctctggacctcagttttccttgactcactgattttccactggtctggtgcctcagaagaaccagattctcctgttcagtcgtcacttcccttctgctgcttccctgctttagaaactaagccctgtcttgcttttgtcaattt

SEQ ID NO: 520720 - DNA, 380 bp, Homo sapiens
  misc_feature (155)..(155): n is a, c, g, or t
  misc_feature (274)..(274): n is a, c, g, or t
  misc_feature (317)..(317): n is a, c, g, or t
  misc_feature (345)..(345): n is a, c, g, or t
tgagactgagtcttgctctgtcgcccaggctggagtgcagtagtgcaatctctactcaccgcaacctccccgtcctgggttcaagcaattctcctgcctcagtctcccgagttgctaggactacaggcgcgtggcaccacacccggctaattttntgtattttttagtggagactgggtttcaccgtgttagccaggatggtctccatctcctgacctcgtgatccgcccgcctcggcctcccaaagtgctgtgattacaggcatgagccactnggcccagccaatatcagctattataatgagccaacaaacattnaatcgcaaatcttagccaacatcttcgncttttccaaattttggggactttttgtttgaactg

SEQ ID NO: 520721 - DNA, 295 bp, Homo sapiens
ctcaaaagaacttaggccatcagtacagagacacacttagatggaaaagctatgctctagcgctcaatagcatattagtgaggatatagttaacaatagcttattttatatttcataacagccagaagaatggtaatgttcccaagacaaagaaaagacatatgtttgaggtgatagatatccaaatcaccctaatttgatcattacacaacgtatacaggtatcaagatgtcacatgtaccctcgaagtacgcacagctgttatatatcaatacaacttaaaaaataaagaagc

SEQ ID NO: 520722 - DNA, 414 bp, Homo sapiens
actctggcttcaaggcttctctatgctccgatcgtgccttgccatgggcacatgctgggtcgctgatgctttatagatctgcgtggggaagtcaggccctggggaggcaggcaggcaggagtccacgagcccagctcctcctcccctagacccaggtgtccagcttcaggccccgcctccctcagacccagaagcccaggccccagcctctcctccctcagacccaggagtccaggccccagccctcttccctcagacccaggagtccaggcccccatccctaatccctcagacctgggagttcaggcccccatccctgctctctcagacccaggagtccaggccaccagtgcttcctccctcagacccaggagtccaggcccccatccttcccctctcagacccaggagtcgc

SEQ ID NO: 520723 - DNA, 588 bp, Homo sapiens
cttttggtgcggtctcctcgcctctctgggagcctttaattagtgtcctgtctgcggatgtataagaatattgaaagggtattctggtgtctcttcccacacccgtggaaggacgcggcctgtgtgcgggcgaaattattctgacgataatattggtgggcatttgtggccgcctcctcttggcggtgcttcaataaacgtatttgagtgcaccaccaccggtgtggggagatagcccctcctgtgggactcggagatcatttccctcttctcgtcgtggaacagtgggtggcacaagaagcctttttgtagaagtgccgctttgggcgaaaacctctcctttccatggcccatacaatttctttgtaatcccgcatgaaatgttgtttgttgggatccacaagaagggtaaggcaggcccagatgtttcaccccaacgtttcttattaaaacccatcatcacctgcccgctttctatgatggagaacgcccgaatcaatagttgtgtgtcgtaatatgtagtttttccaactattttcagcaataactctccaatatacagaccccagacaattaacaaacacaaca

SEQ ID NO: 520724 - DNA, 203 bp, Homo sapiens
tcgctcgtgaactcatcttttttatgagtcatttggttcatctttggaatccttaagtataaatccccttagtgaacccacagagaggagatacatgatttggggggaaaattaggcatttttggaccctttgatatatttccatcaaaattcaactcattcatctactcaaaaaaatagttattaaggagttcttactgtgg

SEQ ID NO: 520725 - DNA, 382 bp, Homo sapiens
tgagacagactcgctctggttggccaggctggagtgcagtggcgcaatcttggcttactgcaacctccgcctcccaggctcaagcggttctcctgcctcagcctcctgagtggctgggattgcaggtgtgtgccaccatgcccggctgatttttgtgttttaagtagagacggagtttcgccatgttgaccaggctggtctcgaactcctgagctatggtgatccacccggctcggcttcccaaagtgctgggattacaggtgtgagccaccgggcacagcctgacggttcttaatattgagatacttaacaaggcatttcggggagcagagaagtgagggactgactttcacggtcttgggaaggaggaggttcttggcat

SEQ ID NO: 520726 - DNA, 250 bp, Homo sapiens
attccattccagtcgattcaattccattccattccattccgttccatttctttccatttcattccattccattccactcgggttgattcagttctattccattacattaaattccattccacatggtttgattcaatcccattctattccattccatcacactccattccattccattccattccattccattccattccattccatgccattccataacattccattccattccattctgctccgctcc

SEQ ID NO: 520727 - DNA, 174 bp, Homo sapiens
ctagaaaagtgtcactgtcataggttctgttaacacaggcttttcgacagattctaacacgggcttcggcaacgccttggggttcataggaggtctttgtcgagtccaccgtggcgatggcctctaaaaggggagacacactagctgtctccgcttgaacaaaaaacacaagag

SEQ ID NO: 520728 - DNA, 385 bp, Homo sapiens
tctccttactgtatctaacgtatgctatctccgtcatgccccggacgcattgaagccaggctgccttgaagaagctctcccagactgcccttttccccaaggacaggctcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttaggaaagtgctcctacagacgcatctacggttaacatagcatccctatggccactgtctcccttgatccccacagccattctaggagaaaggcagaatgtcataatttgctaaaagggatgctgaggctctgggag

SEQ ID NO: 520729 - DNA, 152 bp, Homo sapiens
  misc_feature (136)..(136): n is a, c, g, or t
tctgcacagtaactcaaagtacggctctacaatgtacccttaaactggcaggacgtggaaatcaaaattgcacaaaagaggtcacgaacagccatgtatccatatacggcaatcaaataaggaacttatgacctanagcaaaggtaaacttt

SEQ ID NO: 520730 - DNA, 252 bp, Homo sapiens
caggctctgctgctcctggaaatgtcaggatgcttccagcttccagcagattgttttttttggaaacagagtcttactctgttgcccaggctgaacggaaatagggcgatcgcaactgagtgaaacctttgcctttggggcttaaacaactctcctgcctaagcctcttgaggagcgggaactataggcacacaccactgcaaagggttaatttttttttttttttgggaaaaaaggggtttcccccatgtg

SEQ ID NO: 520731 - DNA, 995 bp, Homo sapiens
ttgatgccactgacaatgaattgctggccctctgagaggtggaaacatggctgtgatgtcgacatataatatgagctacaagaagattatttataactgaatgatgtggttatcagcatcccactcccgtctggtgtcggcgcgcctgttatcggtgagatcgatggggagtatctacatgacagtcgacgcaaataccctggagtggtgcctgctgtgattgatgccaaaaataagagtggccgcctggagtgctagcatagctgggcagtgccggatgacttcttaccctgttcaagtttcctactgtctccgagaccacaaatcactgtaacatacaggttatcacagtgacccaggtagatggaacacagccccgtgcaggttgccacagtagacccacttacctagtggataagtatgaaggttctgtaatagcaagaagagggagctgaacaaggaaaattttcagattaataaacgaagacgccaatgatggctgacagagtttgttccagatttacaaagccactggagaccccttttttctgatacaatgcacgattctctgcgcgcaaggacccttcggactcgaccccatgttcagtgtcacagagaaaattctttgataagggaatggccccacacattcaggaaaggtgctaatttctttggcagattgtattggcagcacgaaagcagctctcagagaatgaccccggtgtaaaactcctcttccctgagccagagtggcccgaaaataatcaacaaagtacacatagaccaccggacgaggagacacatgctaccaggcacgaagcaaggataaacaagaaaggaacacaggccgggctaagaggcagcaacaagacggaaggacaagaccacaccagaatcggaacaaacaggaacgaccaaggaaactaaagaaccgaccctggaaagcacacgaaaaatacgaacagaacgaaaaacaaagagagaacaaatattac

SEQ ID NO: 520732 - DNA, 1592 bp, Homo sapiens
tggaaacggagttttcgcctcgggtcgcccaagcgtggagtgtgcagtagcagggctcctcagcttcttgtgcaagcctccgccctcccgaggtttcacgccatttctcctgtgcctcagaacttccgtggtgttagcgtgggagttcacgggcacctgtgccaccagtgcgcggaaataattttttatatatatattttttctataaccaagagaacaggtgtctcctcaggtggtgttaagctcgaggaagtggctcttcgaactcctccgtgaacctcgggaactccgcccgcgacctctcagcccctccacaaagagggggcgtgggacattatcacgagggcggtgaagccaccagcgcgggcaccacgagaaaaaggggagggtgacacgtgtggcggggtgttatatacccgagaaacaaataagaacgtgggtctttgtgaactaatccacgaggggggatctccaaacgagaggcatcttcttcccgcaaacactctgcgagagccctctccaccaacgaggtgcgcgtgggaatatataacacgagtgcgaggaaaaggcgcggaacataaaccgccaaggcctataattacaacaacatattttctttattccctctaataagagacaccgagagggacctccattgttgggggtaatgcccccagaggggcgtggtgacaccctgctgacaacgtgtagaatataaccacatcctaactataatgctattcgacatgtagacacagccgctatcaaaatatttttcccccgagggggcgaaaaaacggagagctgagacattctatttaactccaacacctctccaagactcttttttccacacataggtataacgactgtaggagggctcccggaaaagaaagtgcacatgttgccccaagtattaacaaccacccagagagtatacatatttataaaaacaaaaacaaaaaattttatgtgtatgacctacttagtttgagagaacacgaacgcttctactgagcacatttattgagtttgtgcccccccaaagtactttatgctaaatgttgtcaacaacttgagtcgtgctgcgataactcccgcgggcgcatcccaaagtggacaaagacttcaccacaccctcccacgggactacaccacaacgcccccaaaatatcgtcacgagacgccctacagacccacccccagacgaaaagcagctgtggaaaccacaacaagggtaggtcccccgccaccaccaaacaacgcccgagagacaaacaatatcaaacggagcagactactcaaaagcaacaaaacaagcggagggatccgacacacggtgaagtactacccacaggaagaggggctgctgaaaccccaccgtgacacacagtaaaacgacacaggagaagtgggaaccaccccacaagcagtggagcaaacaacaaggcggaactaaccacgagccagcgaggcacacttaaaaaacacttgtagcaacacgatagccgttggccaacaacccaaacaaacaacgcggacacatagaggcgggcacaccagacaaacagccgaacgacagctacacacat

SEQ ID NO: 520733 - DNA, 856 bp, Homo sapiens
aggctattgggcagttattgccacctgtacaaagagaccctttgtgccttacatgagaaagagagcgcacacctggattgatattaggatagggtgctggcatagaaatatatcctgggagtaagtaggggttccctgcgtgagaatggacccgctgttgcagggaacgggctcctcattaaagctgacgcattggccgagacacgtgtgcgtttctaggtagatattgcactccatctaagacttattgagcagcctactgtgtgccaggcactgctctgggaactgagccgcgtgactcaaaggcatgtaaataaagctgggacagaacacagttcacgctttgcctgtctactgacaggtggcaagtcctcagcttcagttgtgtgtgataaaagtttgattatacgaaggagaaagggaagatactagaagcttccaggaaggaaagaaacagatgtgtcatatacatagggatcaggaaagagaatggcgttgaaactagtttcagcagacaatactggaagcgtagaagacagggttggtttaatgccttggaagatgggaaggacgactacttttcagcctagaaatctaacatccagcgaagctaatcaagcaagatgtccagggactgcagtaagtggttccttagacgataaagtctcagtgtacgtctcggtatcaagtttataagcgagaggtgctccaaccaaaagacgcgttaaatcgggggaccggggacccaccagatcatggagatgccggtacctaatggaagaagtcttgaagagatctccggacagaagacgggggccccgggcctgggccaaaataaggggcgggcccagggagt

SEQ ID NO: 520734 - DNA, 120 bp, Homo sapiens
tctcgtatactaaattattaataacgcgctgtgcgtggggtctgagtgggggacttcggctacgcgggatgctttaatgcaaattaaaatactatgtgtcgctttgccgtaaaccactaa

SEQ ID NO: 520735 - DNA, 306 bp, Homo sapiens
aaaattttataatgttttcaaaaaaaaaaaaaaaaaaaaaaaggggggggaaaaaaaaaaaccccccttgaaacccaaaatttaaaactccaaaaaaaaggggcaaaaacaaccccggggcaaaccccccggggaaacccccccccaaaaatataagggaaaaatttcccaaaaaggggaccccccgggggcctttttccttttccaccccaaaatggggggcaaaaaaggggggcgccagatctcccaaaaaaacgggggcccccccgaaaaaaaaaaaacctaattttaaaaccccgtgggcca

SEQ ID NO: 520736 - DNA, 169 bp, Homo sapiens
tgttggggctgctggccctttaagagggcattctgcccaccgcctgaatgccccctcccctagccactggagaagagatccgtttcttggcaacaggaagctcttggtttactgtgtcacccagagcgacgtgggcagccatggtcgctgctctgtggacgtgagcctg

SEQ ID NO: 520737 - DNA, 1172 bp, Homo sapiens
ggcagcagtagcagaggctgtagcatcggacaccctcctctctcccgcaatccaggttcctcttccccctccttctcactgtttgttgtgtgtttgatgtgttaaagcaggagacgagaacccgagcagacgccatgagacaacacataccgatcgatccccagcacatgcaggtccgggccccagccgagacgggcccggatggcggaggtggtaggtggcggcggaggccggacggaaccgaggacaatccaggtgacataatgtctccccgagcgctagactctgagcagatgcggactcactacggaaatcctaggcaagaatcgacgaactgcgcctcttcccagaccggactgaattcgacctatatgaccagatacatcaatctcgatgttctgacttaagataagattccatgaatccaagacatcacagcagatatgatggcaacacgcaatcttgaacaaacacattgatatagcagatagacagcaggcgtaggatagatcgaaccataatgcagaagtgaaacgcaagcacgaacaagaaaacgaagaaacataaaacagcataaggaaagatagaccagcaacaacccctgggagaaaccgacatgaagcaagcaaaccgaatggaacacacactgacacaatcgaagtacaggagtacaaccaagaatgaaaaaaaaagaaaagaacaacagaaggcacccagactaatgcacaggccaggactaacagacaagaagcgaacacaccagaacaaaaaccgaaacaccatacaaccaaaaataggagacagaacacacggacagaaagaaagaacacaccaggaaacgacccaagatgaaaagagaaaccacgacaaaacgatggaacaccaacacacccagcagacacaaaaagaaagtacaaaacaaaatagaagacacaaagaaacagaaaagcaaaccagacaaccaagagacaccacaacacctctacacacccatcaaatctagacaataaaacacacaccaactaactataccaccattaagaaaacaacataacaatccacatcatgcaaacaataaccaacaaaaagtaacccaacaacatactcctccacataaaaaaaaataaacctacacacaacgccacacccgcaactatctgtattgaacaaca

SEQ ID NO: 520738 - DNA, 587 bp, Homo sapiens
caagcagttatacagactcagcaagacttcagattcctttataatcagccacacagactcaaaaacaatcatgcttaagataagagacacctttggaaatctcttcaagaaacaggagaattaatactgttaaaatgtccatactacccaaagtgacccacagattcaatacaatccccatcaaaattccaatgacatttttaacaaaaatggaaaaaataatcttaaagttggtatggaactataaataaacccaagtagtcaaagcaatcacgaacaaaaaggacaaaactggaggcattatactatcagacttcagaatgtactacaaagctatattaatcaaaacagcatgatactggcataaaaacagacacataggccaaaggaacagataaaaagcccagaaacaaattcatgcttttacaattaactgattttggacaaggtgccaaaacacacaatgaagaaaggaaagtcccttcaataaaaggcatagggaaactgggatatccacatacagaacactgaaatgagacccttacctcacactatatgcaaatatcaacctgaagtacattccgaac

SEQ ID NO: 520739 - DNA, 239 bp, Homo sapiens
acatatggagcaatgacaacaagaccatgttccgaagcagactgatgataaccagatatcgatataaaatacagcactgtgcaagtaaaacctgagagccaatacagtgcagaggacaatatccagtttctgccttatggtggtaagtagacagcaaatagacatattggcagtacagttcaacactgtcatgttcaaaaactttctgcaatcccccaaagcacttgatgctaggacga

SEQ ID NO: 520740 - DNA, 125 bp, Homo sapiens
gcgcgttacctgcagctctctctgatggggtgttttgtcactggcgcggagcagactacagggacctgtagccctgacattccatcattttatgaccatgaggaattacagatcctgggcattgc

SEQ ID NO: 520741 - DNA, 100 bp, Homo sapiens
tgtacccagctggtgtgacggagcaagaccctgaaaatagttgacacatttattactacctctttatagatgaggaatcgtgatagtcccaagaggtgga

SEQ ID NO: 520742 - DNA, 234 bp, Homo sapiens
caattccagttcatccaggttgcagggcggtcaggagataagatatttataggtaatgtgaacaacagcggcctgaagattaacctgtttgatacccccttggagacgcagtatgtgaggctggagcccatcatctgccaccggggctgcacactccgctttgagctccttggctgtgagctgagtggatgcactgaacccctaggcctgaaggacaacaccatccccaacaag

SEQ ID NO: 520743 - DNA, 119 bp, Homo sapiens
atctagaggatacccaccggtcctatctggcgactgtacacggtttaattgccaagtgtctaaagcttaatatgccgtgctatgtaaatattttatggatataacaactgtcatatttt

SEQ ID NO: 520744 - DNA, 141 bp, Homo sapiens
  misc_feature (61)..(61): n is a, c, g, or t
gtttttccccctttttaaaaaaaaaggggggcaagggccctttcccccccccccccagaanggggcgggtcccttggttaccaccgggaaattttggaaaaaaaaaggttttggcccgggaagggccccccaattgggttt

SEQ ID NO: 520745 - DNA, 454 bp, Homo sapiens
tggaaagggaatctcgcggtaacccaggtgggagtgcaggggcgcgatctgggctcacggcaacctcgtgcctccgcgggttcaagtgattctccggcctcagcctcctgagtagcggggattacgggcatgcaccaccattccgggctaatttgggctattttaagtagagagggggttccaccatggtggataaggcggggtctcaaactcctggacctcatgatcggcccacctcaatctccccaagtacggggatcacgggcgtgagccaccgcacccagccgtggtttggtccttaattaacttaatccgaccctgagggggggtactactatcggtccggtggatagggaaccagagacaaatgtggagggcactgggggggcagagctcttaagccatggcctaaaatgggccaggtacaatagtcctcccgtatcggctcggggag

SEQ ID NO: 520746 - DNA, 200 bp, Homo sapiens
ggtttagaagagcaagaagaaggaggttcctgctgtgacagacacccttaagaaaaagcgaaggaatttcgcagagctgaagatcaagcggctctagacaggagtttgcccaacagtagcttcgaaaggacaaggagggaaggttatctatttactcaaggcaaagcactatcacacagggtatatgggagagtgtgcag

SEQ ID NO: 520747 - DNA, 716 bp, Homo sapiens
  misc_feature (171)..(171): n is a, c, g, or t
  misc_feature (305)..(305): n is a, c, g, or t
aattttacttcttttagctgtgtaacttggtacgatgcaaagaggttggatcaagtttaaatgactgtgctgcccctttcacatcaaagaactactgacaacgaaggcctgcgcatgccttgcccatctgtctatctatctggctggcagggaaggaaagaacttgcatgntgtgtgaacggaacgaacgtggggtgcgaagaagtggcggtgggcacgacagtggacaatctagaggtaaaaacaagcttggcccaaggtgtcctgcaggctgtaatgcagtttaatcagagtgccattttttntttttttgttcccaaaattgatttaatttattggggaaatgccccaacttttttttcaattatgccacactttacaaaacaaaaacaaacacaacaacaaacatttgttggcggcgggactcgccgcccgagaaaaaagctttttctagaaacccctctcccgtgtggggccgcccgcgcacccagtcagggtcgagtggaccatggggcccaaagagcgtgtcccagagacgaactcgcggcgacgagggacagaggtggctggggtttcctcacgcaaagaaaaaaggcgcgcggggggaacaccgcagggggttctgggaaccaaatccccgaagggagatgcgaagcccaaacgggcactctaccccagggccccagcgagccgattaattaccgcgcgggcggaca

SEQ ID NO: 520748 - DNA, 499 bp, Homo sapiens
atagagaggattaccccatttcgttcacagcggactgttttttcagtccttaaaaggtccacaagtctgggattagcagctagcacttaattattggcacgacacaatgcttattaacaatgtgatacaatcacaaaaaattacaaggtgttcctggattgttgagtgatgatatgcacgcatatggtttctaataagcaacttagatgtgaggtgtcatactcctagctacagatgtgtcaacatcacactatcactagagacaaccagcatcggtacaggtcaactgagtgctgaagcgagagcaataaagggccttgtcgacattgttgaaaaaacatgccgaagatggtacttgcccacgaacaaaatgagcagattatgttgcacgattgtgaccgggaccggtgactcggattctgaggcgtcattcttatgtattggaagcaagaacgtataacgtgtatcagctgaccaaagattacaggatgcatggcta

SEQ ID NO: 520749 - DNA, 123 bp, Homo sapiens
ctcatcaggaactgcagcattgggtcctctgctgcactttcatcttcatcaaatacctagactagctagatcatgtgatagatgcggtagcgagtgggtctaggggatcctacaagggacaag

SEQ ID NO: 520750 - DNA, 1096 bp, Homo sapiens
cacatgccaacggtcttactacatattggcacagaagataatataggaggtgaagagggtaagcatgaggtttggcactaccctgaagaacgggagggactcgtcttggaatgtgctaaggaagttgatgtcgccgaaagtaataggaggttaaatctcagtgtttcgagtgcttgcgaagaatctcaagtatatgtacatgctctatatgatgctcgatgtgtgttggacatggctggagaaagttggcataacgatgaacatgtgagacatgggaggaggatatcacgggagaactggaattttcaattggagagagggttgaatcatgttgatcagaccctactgtagggatgattctacttgtctctgaaaggtatctggtgtataagataatttgcagtaatgcggtaagctatctattgtgtcattgcttgtgatgtatctagctgcggctagttctgacattatcagtaagtcatagagaacagttgagtatgaatataattgactaaagtgtatgcctcatcttgagaagtaagtaaataaaaccgggaagttgatgaaaccatgcctttcactgttattactatgaactgcatgcgctgttctactaggatctcctgtcttgccaatgctaagaacttggttctggagggcactttaacatgtacccacttaccacgcatcggttcaccaaagcaatcattacaaggcaagagtggaggccctcgtggctttcaacaatgtcgagcccttttgggggggtcccactccctcggtggaaatggaacggctttgactcaaaaatacggtgggaacacggcttggtctattctgtccttgaaggctgaaactgtaggcgaagaactcgggcctctactcctttggataatacactgggtgcagtcctagtaattccttttcccccagtggaaaatcctatcctggctcctcaagtcggatttctccaagaatggtcccgcccatcttaatttacccttgcacctggctcattcaggcggatcgggtatctggaagcatgcccacgaccgctctggtcattttactctcagcacctccattgcatgacaaa

SEQ ID NO: 520751 - DNA, 817 bp, Homo sapiens
ggattgttatggtgttgtgggcacagaggtgacagatgtctctgcacggcactcaggcaagctgattctacacttggaactcacatgcaagctatccgatctcgtaataccagggacaggcgcaaggccggacctgaatgccagatccaagccaagttactctcaacatgtgattacttggctggttcctggctcaagtcacctgtgcgtgtctacagagcgtgtatgtagagagacaggtagcgagcgatcgcgcaccatcgcgcgcgcgagcgcggcgcccagcaagcgaacgcaatatgaccgaagagtgcgcaagagaaccaggcggcatactggcgaactctctcggttctctcgggcgtaaccttctctgcctgaacgtcataatgctgacgagaagacacgttcttccacgcccgctaaggtcgtccgccaagcagaacgacccgctaacggcagtgggatccccggcgcgcgcagctgggaggcacccccaccaacaaagcaacgggcacacttgaaggacgaccaagcgtataccgtggggaacacaacggcgggcggcaacgaccaccgggccaacaacggtatggggaaacggacaagaacacaggaacccagtgccgccccacacaaggcgggggccacaacaccaccggccccccacgagaccggtgcgacggcacacccttggcgccacgccacggcaccccggcacccgccttggcacccagcccggggcccccaaagtaggccggccgcccccactcgtcgcgggcccccacacacaccccccaaaacgtgggacgcgact

SEQ ID NO: 520752 - DNA, 101 bp, Homo sapiens
tccgtttacccatctgttttatcacttcccaacatcagcccaggcagcggtggcagcaatccatgtggggcatcgtctcagcagtcgcactgccaggcatg

SEQ ID NO: 520753 - DNA, 972 bp, Homo sapiens
ctgtttcgtggaggagtttgttcggtgcagccactctgccggggcgccggtattattggtccgccccggctttgtggtgccccctccttttgttgggtggtgcgccccaccatgggggtgctcagtagttggcgcacgacgcaccgttttgttgctgcagaacgttctacagggggtagcatgcttttggtcttcccccgtctctcggtgggtcaaaccaacttggtgagggcctgggcgcccctcgatctttctcttgttgaaatctgtcgggtggtacggcgtccccctcaatgtgctgaataataggttttctctcggcgcaaaacgcaccacacagttgcgttgttgagcagaaaggatgtctctcccagaagttagtgctccaccgcttttggtggctgctctgttgtcctgtgtttgtgtggagacataatgagggagcacgcacacaaacgtttgtccgggtgtggggttgcacactcacacaacccacgcgtgtggcacacacaaagatagcagggtgtctttgcgaaatggtccgtgcacagagaggttactccaaacattgttgtcccccgaagatgtctctctgagagggggtttcgatgcgaactatcatcccgctatcgacctcgcgaacccgccacttgttgtaatccacaagggtgtgtagagaacacgtgtctttagagaatgtgtttgttttcccatacatgcgccccatgagaaagttcaggtagaatagaagaacaggggtgaagaaagaaaacaccatcgccgtcttgtctaccacccttctctgaaagaagaaaagagagaaaatcttttttggccaacaccatcttgtttttttttttgtggggtggcaattttaaatttttatttttttaaacaatcacttttttaagggaacaaagggccccaaatttttcccaggaatttggaaccccctaaaaagataaaaagaga

SEQ ID NO: 520754 - DNA, 103 bp, Homo sapiens
cgtgacccactggtgagcaagtgacagcagcatcctttaggctgacacaggggccgtggctcagtcatgacgcgcttggtcgagacaggcggagaaccagagt

SEQ ID NO: 520755 - DNA, 87 bp, Homo sapiens
cagacctctctgtacttctgtgccagcagtttacagggggctcggtacgaacagtacttcgggccgggcaccaggctcacggtcaca

SEQ ID NO: 520756 - DNA, 209 bp, Homo sapiens
  misc_feature (86)..(86): n is a, c, g, or t
aggtcattgattattaatagttctatccagttatctggactttaatccaaaagagtatatctataaagagcatctactctataaangggggtaaactcaaagggtagtaaatacagtattcagtctgtaaatattacctcactgtgtccatgacatttgtgaactcagtaaccaaatttaaggatttactgtgttagcttgttgttaac

SEQ ID NO: 520757 - DNA, 88 bp, Homo sapiens
ggggggaacccccttttccccccccattttttttgcccccctggggcttttttttaaaaaaggggtttttctgtggggggccccccca

SEQ ID NO: 520758 - DNA, 1293 bp, Homo sapiens
  misc_feature (35)..(36): n is a, c, g, or t
  misc_feature (54)..(54): n is a, c, g, or t
  misc_feature (72)..(72): n is a, c, g, or t
  misc_feature (87)..(87): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (111)..(111): n is a, c, g, or t
  misc_feature (129)..(129): n is a, c, g, or t
  misc_feature (133)..(133): n is a, c, g, or t
  misc_feature (135)..(135): n is a, c, g, or t
  misc_feature (163)..(163): n is a, c, g, or t
  misc_feature (165)..(165): n is a, c, g, or t
  misc_feature (177)..(177): n is a, c, g, or t
  misc_feature (186)..(186): n is a, c, g, or t
  misc_feature (188)..(188): n is a, c, g, or t
  misc_feature (212)..(212): n is a, c, g, or t
  misc_feature (252)..(252): n is a, c, g, or t
  misc_feature (265)..(265): n is a, c, g, or t
  misc_feature (271)..(271): n is a, c, g, or t
  misc_feature (274)..(274): n is a, c, g, or t
  misc_feature (286)..(286): n is a, c, g, or t
  misc_feature (300)..(300): n is a, c, g, or t
  misc_feature (310)..(310): n is a, c, g, or t
  misc_feature (318)..(318): n is a, c, g, or t
  misc_feature (321)..(321): n is a, c, g, or t
  misc_feature (330)..(330): n is a, c, g, or t
  misc_feature (338)..(338): n is a, c, g, or t
  misc_feature (385)..(385): n is a, c, g, or t
  misc_feature (393)..(393): n is a, c, g, or t
gtctgcggccggcggtgtagacgccccttcgccgnnacctggcacccgaatccngcctgccgggcctctttntgcagcgccttgctnacgcccagggttctnatntanaancctacaccagggcctgangttntnaaactcatggcagtccacgcctgaaaananaaggcctgaaanaaaaggaanancccatgggacttgccacggttttnacttacatctgcaactccaaggctacaggcaggaagtaanaacagtgctcaantggcancanatactgactatngcttcatttcacancttcacacancagggtancanaaaacaaanaatgtaanattggacccagttgctgctgttcaccaactctgtgatcttcaaaaanccatatancttctccagacctgttaatcagggaagaagcagataactgaaggctggctttgagaagtttcgaggtaacataggaacctgctcatgcaggcactctttccatctgacttgggccaaggtgctccgtgattgacaagcagccagcctctgggagagcactctgatcagatcattgatagaacattcactactctacttatcatacccatttacttatctccatcttctgttagactccttaaaaacagcagcccacagcaggtgtggggataaaacagtcctgggcagtgctcattgtactcacactatgccaggcactgtgccaggaacattcaaatttctaagaatctacaaagtagatacctcattatacatcttacagagagcatcattggtgtttccaaggtcacagggctaggcaagggtggaacctgagtctgcttgtctgtttgccccatgacagcccaggggtggtggcctcactccacctccaggcacccacaagaatataaaatcttgtacaaggatgtcgatattactattgccattcccaagtgcacctgcacctgtagtatcaggtggtttgcagccttggctgcatagctgcatatgagaatcacctgggaagcttttaaagatcccagtatccccacctcttccccagttacagtggagtcttgcgggtggtgggggacatcattatttttgaagcttccaagtaattctggtgtgcagtggggtgaccagctgtcccagggacctcctttaaaaaataatatcccgggcacatgacaggccaattgccctaatgcaaccaaggttaagaactactggtttaatgggagatattttttctgtgcttgattatactgttttattaaactctgaatccatttaaaa

SEQ ID NO: 520759 - DNA, 128 bp, Homo sapiens
tactaccactcagaatttatctagagtctgcttatattataactgccagtgtccaactaaaacctagtcaggtctcacatattatgtagttaacggaatccagttttcacatgactcaaacgacagga

SEQ ID NO: 520760 - DNA, 525 bp, Homo sapiens
  misc_feature (442)..(442): n is a, c, g, or t
ggtgttatcgatgccaccggctcctccaccttcttctttccttcctatttgggcttagttttcaagagaatcttaagttagagtcatatattcattagcctgtgatgtaggaaacaaatgaggctacagtgacagcattaataaaggaggcatacttactattttaaagttagcttttaagaggtgaaactttaaaaaaaaaattgggagactgggtctcgctctgtctctcaggttggagtgcaatggcatgatcttggctcactgcaacctccacctcccaggttcaagcgattttcctgcctcagcctcttcagtagctgggattacaggtgcccaccaccatgcctggctaatttttgtatttttagtagagactaggtttcattatgttggccaggctggtctcgaactcctgacctcttgatccacctgcctcggnctcccaaactactggtattacaggcatgagccaccgaacccagcctgaggtcccccactattatggtgtggcatcgataaaca

SEQ ID NO: 520761 - DNA, 783 bp, Homo sapiens
  misc_feature (5)..(5): n is a, c, g, or t
  misc_feature (64)..(64): n is a, c, g, or t
  misc_feature (73)..(73): n is a, c, g, or t
  misc_feature (145)..(145): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (183)..(183): n is a, c, g, or t
  misc_feature (189)..(189): n is a, c, g, or t
  misc_feature (193)..(193): n is a, c, g, or t
  misc_feature (264)..(264): n is a, c, g, or t
  misc_feature (270)..(270): n is a, c, g, or t
  misc_feature (293)..(293): n is a, c, g, or t
  misc_feature (350)..(350): n is a, c, g, or t
  misc_feature (384)..(384): n is a, c, g, or t
  misc_feature (472)..(472): n is a, c, g, or t
  misc_feature (474)..(474): n is a, c, g, or t
  misc_feature (554)..(554): n is a, c, g, or t
  misc_feature (561)..(561): n is a, c, g, or t
  misc_feature (582)..(582): n is a, c, g, or t
  misc_feature (603)..(603): n is a, c, g, or t
  misc_feature (607)..(607): n is a, c, g, or t
  misc_feature (636)..(636): n is a, c, g, or t
  misc_feature (644)..(644): n is a, c, g, or t
  misc_feature (661)..(661): n is a, c, g, or t
  misc_feature (665)..(665): n is a, c, g, or t
  misc_feature (700)..(700): n is a, c, g, or t
  misc_feature (702)..(702): n is a, c, g, or t
  misc_feature (732)..(732): n is a, c, g, or t
  misc_feature (736)..(736): n is a, c, g, or t
  misc_feature (750)..(750): n is a, c, g, or t
ttganttctgttagttggagagttatatttgatcaggagaacgtggtttctagcacagagagtnctcccagtnggttaatagttgggggtaaggcgaggttagcgaggcttgctagaagttatcaaaaagctattagtgggagtngagtttgaagtncttnananaggattattatgcgactnttagtncgtncgtagtttgagtttgctaggcagaatagtaatgaggatgttagttcgtgggcgattattaaaattactgcnccggtnaagcttcagggggtttggatganaatggctgttactacgagggctatgttgctgattgaagagtatgctatgagcgattntaggtctgtttgttgtaggcagatggagcttgtnataattatgcctgagagggatagtacaagggaggggtaggctatgtgtgtggtcgagggggttgagaatgagtgtgaggtgtatgatntnttagccgcctagttttaagagttctgcggcaagtgctattgacccagcgatgggggcttcgacatgggcttgagggagtnataagtngagtgcgtgaagaggtatctntactatcaaagctattgtgtnagcnagtcatatcaagtagtgggctcaggagtntgagagtnctcgggcagtcagagtnagtngtagaatgtctagtgagcctagggtgtggtgagtntnaattagtgcgatgagtagggggagggagcntacnagggtgtagaatanggagtatgttaccttcctccatgcgtactggct

SEQ ID NO: 520762 - DNA, 107 bp, Homo sapiens
cccatgtcttcttgtcttgaggttagggagcaattagcatcaagggtttggatcgggaaaccactacatttgtgtgcccaatcatggacagtgacctgatagcctat

SEQ ID NO: 520763 - DNA, 321 bp, Homo sapiens
ttgagtctggaaacagcctccttgtttcactacttactttagtgtgtgactccatgaaaactcccccttaccctaaaaagcttcagggttatgtctatgttcattctatagaacaaatccaccctatcactgtacttaatatctcctcttctctcatgaatagaaatttatgtagacgcaagcaaaatacttttgcccacttagaaagcgcatatctcactttatgccgctataatcttttgttttttcagttagagtacaccctgttgtgattatctttatcccgtgttaatatatctttcatcttgaatgtaataagaa

SEQ ID NO: 520764 - DNA, 537 bp, Homo sapiens
tgctggagactgtattctacaacatgtgactacaattagcaagcactatatgatatacttgaaatgtgtaggagggtgagatcttaagtgtgctcatcagctagattagctgaaaaagaagggaaagaaaggaaggaagaaagagagagagaacaaaagaaaatggtaactatgtgaggtgatggatatgtatatgatatatatgcatattatatatatatgattagatatggatatacgcatatatatgcataattgaaatatgtacatatttaaagtgtacgacatgatttgatatgcatatatatgcatatatatccatatatatgcatggatatggatatggatatatatgcatggatatatatgcatatcaaatcatcatgttgtacactttaaatatgtacaatttccaattgtcaattatatctcaatatgggaaaaagtcttgtcatgaaggagatgcttaataaatagtagttaatgttattatctttgattgatttgtctttgaataaatttctgtgcccatttcaa

SEQ ID NO: 520765 - DNA, 592 bp, Homo sapiens
caactcagctagtattctcttaaaaggctcatttcaactttattttagtgcatatcccttatacaccaaacgtgcataacttctgaaaagttatgcttttaccagtattatcatgtcacgcataactctggcagtgaaatttctcactggttatgcataatcgcttttctttccaaaaccatttctcttttcataatacccttaatgacacaactaatttgcactcactaaatgtatatttctcactatatcctgatggacattttcatcaacaaatgatattaatatgttaacatataatctctttgcaccctccatttaagtttaaatcatctatcacaagagactgtgacatcatcctattgtaagttcatatcagtacacctttttataatctacccaataaaaacccccaatgtgttaaaatcccatcaacaccattacctccagatcaatatactgaggccttcccgtagaccataccaattaaattgtttatcttttggcataaaaaacatttgttaatacaacccttaattaaataaaaagagggggcattgaggatacatatagatagttaataaacataagg

SEQ ID NO: 520766 - DNA, 188 bp, Homo sapiens
tttctcctaaacggctcacaagcgagaaggttttgggattcgaattctgtgggacaagcaaactcgtccttccttcataaacagatggaatcctggctctacaacctgccctatgccactttcacagaacatccgatggctggcgcagactgagaagacagcatcctctgctgctcagcttggaaagc

SEQ ID NO: 520767 - DNA, 634 bp, Homo sapiens
  misc_feature (5)..(5): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (93)..(93): n is a, c, g, or t
  misc_feature (110)..(110): n is a, c, g, or t
  misc_feature (116)..(116): n is a, c, g, or t
  misc_feature (124)..(124): n is a, c, g, or t
  misc_feature (133)..(134): n is a, c, g, or t
  misc_feature (136)..(136): n is a, c, g, or t
  misc_feature (138)..(138): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (206)..(206): n is a, c, g, or t
  misc_feature (208)..(208): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (229)..(229): n is a, c, g, or t
  misc_feature (233)..(233): n is a, c, g, or t
  misc_feature (239)..(239): n is a, c, g, or t
  misc_feature (243)..(243): n is a, c, g, or t
  misc_feature (247)..(247): n is a, c, g, or t
  misc_feature (253)..(253): n is a, c, g, or t
  misc_feature (275)..(275): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (294)..(296): n is a, c, g, or t
  misc_feature (300)..(300): n is a, c, g, or t
  misc_feature (303)..(304): n is a, c, g, or t
  misc_feature (312)..(312): n is a, c, g, or t
  misc_feature (316)..(316): n is a, c, g, or t
  misc_feature (346)..(346): n is a, c, g, or t
  misc_feature (353)..(354): n is a, c, g, or t
  misc_feature (362)..(362): n is a, c, g, or t
  misc_feature (368)..(368): n is a, c, g, or t
  misc_feature (374)..(374): n is a, c, g, or t
  misc_feature (378)..(378): n is a, c, g, or t
  misc_feature (385)..(385): n is a, c, g, or t
  misc_feature (427)..(427): n is a, c, g, or t
  misc_feature (449)..(449): n is a, c, g, or t
  misc_feature (454)..(455): n is a, c, g, or t
  misc_feature (458)..(458): n is a, c, g, or t
  misc_feature (501)..(502): n is a, c, g, or t
  misc_feature (506)..(506): n is a, c, g, or t
  misc_feature (511)..(511): n is a, c, g, or t
  misc_feature (513)..(513): n is a, c, g, or t
  misc_feature (516)..(516): n is a, c, g, or t
  misc_feature (524)..(525): n is a, c, g, or t
  misc_feature (535)..(535): n is a, c, g, or t
  misc_feature (539)..(539): n is a, c, g, or t
  misc_feature (634)..(634): n is a, c, g, or t
tcagntgattgccaggtgaacatcaccatcttactcctctgaataactagacacaaattacatagcaagttcgaatntntncncacccaaganacagccagtaaaaagtnaaaaanaaagaaanagccaactnnangngctccagctttctgcccatcttctctcagcagttcctcccatctgctaagntgngcnttcntggtggntntttntnanggtgggtcagggntggncaaggngggntggngcagtntaggtccaccatcacctcccantgggcaccngtnggncagnnngggnatnntttttgtncatnttttgtttcccccttttatctccctctttnttctccnnaagttgtngctttntttcantttnatgtaanaatgggcttagtgtccattaaactgcctgagaagtggtttgngcctgacatattttcctgggcnaaaannggnaaagtacctctgtggccttcttgccattaagatcaagttaaanngggnctagnantantgacaagnntcacgctagntaanccttagaatcctctctccaccccgtgaaggtttctctagctgtagctcttaagggtacaagacggcaaatattctggggtgaaggaggtataatn

SEQ ID NO: 520768 - DNA, 330 bp, Homo sapiens
  misc_feature (31)..(32): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (52)..(53): n is a, c, g, or t
  misc_feature (58)..(59): n is a, c, g, or t
  misc_feature (66)..(66): n is a, c, g, or t
  misc_feature (68)..(69): n is a, c, g, or t
  misc_feature (80)..(80): n is a, c, g, or t
  misc_feature (125)..(125): n is a, c, g, or t
  misc_feature (155)..(156): n is a, c, g, or t
  misc_feature (165)..(165): n is a, c, g, or t
  misc_feature (253)..(253): n is a, c, g, or t
  misc_feature (277)..(279): n is a, c, g, or t
  misc_feature (291)..(291): n is a, c, g, or t
  misc_feature (302)..(302): n is a, c, g, or t
ggaggtgggggctggaggtgctggtagctgnngggacgggcaagcncncncnnagggnnggaagtncnnggaggatcctnagctgctgttgcagtctaacccactaatcagttcttagattcccnggaagggcaggcaccaacaactcagaatcnnggctttccnggagggcgcctagtccccccagctctaagcagccaggcgggacctgcatctaagcatcccggttgccatggcaatcgcatgccccccngctactgtatgcccccgccccccnnngaggcagaatgnacccatagggngctgatcgtaatgtttatcatgttactt

SEQ ID NO: 520769 - DNA, 177 bp, Homo sapiens
tccttctgcacatgatgcttgtcttctttcccttctaccatgaggggaagctttctgaagtccctaccagacgcagatgctgatgccacacttctgtacagcctgcagaaccatgagccaaacaaacctcttttcttatataaattacccagcctctagtattcctttatattatag

SEQ ID NO: 520770 - DNA, 669 bp, Homo sapiens
cccaaaaatgtggaagtgacttggaactggttaaaggcagaggttggaatagttaggagggctcagaagaattcaggaaaatgtggaaaagttggaacttcctagatatttgttgaatggcttagcccaaaatgctgataaggatatggacaataaagtccaggctgtggtggtctccaatggaaatgagaaactttttgggaactggagcaaaaatgacttttgttatgttttagcaaggagagtggtggcattttgcccctgccctagagatttatggaaatttgaacttgagagaaatgattgagggtatttggcagaagaaatttctaagcagcaaagcatccaagacgtaagttgggtgctgttaaaggcactcaatttgaaaagggaaggaaagcataaaagttcaggaaatttgcagcctaacagtgagatagaaaagaagatcccattttccaaggagaaattcaagccagctgcagaaatttgcatatataacaaggacccaaatgttgatccccaagacaaacgggttaaatgtctccagggcatgtcagaggtcttcacagcagtccctcccagatgcctaggagggagaagtggttagtgagccgggacagggtcctgtgttatgtgcagccggggacatgggctttgtgtccagta

SEQ ID NO: 520771 - DNA, 99 bp, Homo sapiens
gagcccattctgcactctctctccctgaggtacatgtgcctttccaaactaatatctctcactttttcccttctgtcgtcttctcgcaacacagtatac

SEQ ID NO: 520772 - DNA, 303 bp, Homo sapiens
taatccacagacactatgcattagcccatgaaacgcccaatggaggaggacggggaggagaagtcgcccagcaaagagaagaagaagattcagaagaaaggtacaggcgtgagccactgtgcctggccttgttgctcctttctttgtgtccatgtgtactttatgtttagctcccacttgtatgtgagaacatgtggcatttggttttctgttcctgtgttaatttgcttaggacaatggcctgcagctccacccatgtgctgcaaaggccatgatctcatttttaaaaaaatacctgtatag

SEQ ID NO: 520773 - DNA, 320 bp, Homo sapiens
  misc_feature (16)..(16): n is a, c, g, or t
  misc_feature (31)..(31): n is a, c, g, or t
  misc_feature (119)..(119): n is a, c, g, or t
  misc_feature (161)..(161): n is a, c, g, or t
  misc_feature (224)..(224): n is a, c, g, or t
  misc_feature (269)..(269): n is a, c, g, or t
  misc_feature (289)..(289): n is a, c, g, or t
  misc_feature (313)..(314): n is a, c, g, or t
aacctcaaacagtttnccgtcattagagatngagagcacgatgtttagattcatattttaatacaagctatttcataagagcttgctggagaagaaaatcttgcttcatgtctgtgacncttataaaaaccaacacatgaaaaaaaatccgataataaggnccggagcagccttcattcaagtaaaattttaaaaatcatagtaaaaaaatctttctattattncctaaattttaattgctcaccagcatcttctatggatggggttgngcaggttttctaacacaatntggtataatgtaccctactttttnntaatag

SEQ ID NO: 520774 - DNA, 414 bp, Homo sapiens
  misc_feature (399)..(399): n is a, c, g, or t
  misc_feature (414)..(414): n is a, c, g, or t
gcgcgatctcagctcactgtagacactgtgcttcagattcaagtgatactcctgtctcagactctcgagtagctgtgattacaggcatgcgctaacacacccagctaattttgtatttttaggagagaccagggttctctcatgtgtcgacaggctgtgctcgaacttccaccttagacttccaaactggtgggattacaagtgtgagcgcacacgtgaccaggccatgtgccttcttatagtgtgtactcatatggctttggtctggccagtggtaacaatgggataacgcctgctacacatcttcattgtgaaaccctctccctgtgctgagagtaaatgagactcttagattattaaataggatattttccttgacaggctaacggttgatgagtntaggctctatggttn

SEQ ID NO: 520775 - DNA, 1100 bp, Homo sapiens
  misc_feature (741)..(741): n is a, c, g, or t
  misc_feature (788)..(788): n is a, c, g, or t
  misc_feature (932)..(932): n is a, c, g, or t
  misc_feature (942)..(942): n is a, c, g, or t
  misc_feature (967)..(967): n is a, c, g, or t
  misc_feature (971)..(971): n is a, c, g, or t
  misc_feature (980)..(980): n is a, c, g, or t
  misc_feature (984)..(984): n is a, c, g, or t
  misc_feature (988)..(988): n is a, c, g, or t
  misc_feature (992)..(992): n is a, c, g, or t
  misc_feature (996)..(996): n is a, c, g, or t
  misc_feature (998)..(998): n is a, c, g, or t
  misc_feature (1003)..(1003): n is a, c, g, or t
  misc_feature (1005)..(1005): n is a, c, g, or t
  misc_feature (1007)..(1007): n is a, c, g, or t
  misc_feature (1010)..(1010): n is a, c, g, or t
  misc_feature (1014)..(1014): n is a, c, g, or t
gggtgtccctgtcacctgctcttgttcgtgcctcccagtcgttgccgtaagcgtctcctggtggtggtcctatcctttgtcgtactccctgtgtgttcctgtgtcctctgcgcctaatcgctgcgccccttgttgttgttctgtgctcatcttgcccacgctttattgtttgaatatggccaccctatgggtcctccttgagctgtttcttcgcgtctcttcctcaggtcgaactgtgactctctttaacggcctcggaagtttgtacgctgtttcacatgaacggatcgctcgtccgtgctgaccagatgttcatttcagctgtgcacctcttgcgtcccacttacttgtctcaccataccaattcaacaacggactaaatacgatgtaatgccttaaaaattatctagttcttggcttccttagttctatgtgattggagatgattcaattttactctagatattatctgtttttgtgtatattggccgtatgatgtatattaacttctttgtagcctttaatggtataattctggttatactattgaattcgatttataatttggtgtgactagatacaacttgtaagattgtagcaataagctggactagtgtcctaaacaaatggctaactgatgaattagtaagcctatctgacagcaggccacttagtgacagtttcttttgtgttcctatggaaacattttatactgtacatgctatgctgaagacattcaanacgtgatgttttgaatgtggataaaactgtgtaaaccacataatttntgtacatcccaaaggatgagaatgtgacctttaagaataatgaaaacttttgtaaattattgatgattttgtaattcttatgactaattttcttttaagcatttgtatattaaaatagcatactgtgtatgttttatatcaaangccttcatgnatctttcatacatatatatatttgnaacnttgtaaagnatgngagnagtnttangnaaagnangnttntacnttaagccaattaaaccccaaacctttggtccatgtgtggtgggccaaaccacctgatataatcccggattttcgctttaaaaaaaa

SEQ ID NO: 520776 - DNA, 259 bp, Homo sapiens
  misc_feature (58)..(58): n is a, c, g, or t
ccccccttttttttttttttttttgggggggggggggcccgcccccccccccccccanaatttttcttcttttttttttttttttttgtgggcccgcccccctctttttttttttttgtgaaaaacccccccccccccccccccccaaaaaaatattttttttttcccccccccccctttttattaaacgggggggccccttttttagaaaaaaatttttttcctcttttttaaaaaaaaaaaaggggcccgcggcgca

SEQ ID NO: 520777 - DNA, 199 bp, Homo sapiens
tttttttttttcccccattgctaacatagaccctgttggggtcccgatggcttccccaacccactgttgggttttttatgtccctgtggccccgtcccacccccgggggtatactgtttgcggggcccatatggttccctttaaagctaaaggaatccggggccccccccgctaatcctaataaatcccatgttttcga

SEQ ID NO: 520778 - DNA, 251 bp, Homo sapiens
tcgcagatggaaggagcagaagctgggagctgtactcagagtggcctgggggcctggggagtggcacagtgctgaaatgcagctcccacatcattgaccgtctgactccaccagaacagtccccccgactccctagccctactgaccctgcaagagcactcccatcatctgcccccatgaccatcagagagcagcctcctgcacctcctcaaccaatgaccctgtggaccatgcacaaccatgtggtgtgt

SEQ ID NO: 520779 - DNA, 796 bp, Homo sapiens
aagcgctccgggcctggaatccctacgcgtcccttggggtgtagcacgatgagctcaatcgggcactgggtatgacctgtcaggctctagattctctcctgacggaagagtttgtcaaggtgaatatgctatgaaggcggtggaaaagtagtagtacagtatggaatcagatgcaaagatggggtgtctgttggggtagaaaaattagtcgttggctaaacttgatgaagaaggttccaagaaagagacttttgtaatgtgaggcgggatgtggaatgggagtagcaggttgtggcagatgctcgtgtcttgtagcagacatagcaagagaagaagcttccaacttcagatctaactttggctacaacatgccactaaaacatctttgcagacagagtggccatgtcatgtgcatgcgtatacgctctacagtgctgttagaccttgggctgcagtgtcatgtagggtctaacaggtgaatgacgggcgcaatctacatgatgacccatcaggtgtttcattaggtgattggggctgtgcatcggaaagggaggaaggtgcaagacggaatagagaagcttcagatgaatgaaatggcctgtcgtgatatcgttaagagtgggacattattacatagtgcatggcgagtagggtaagctttgatagaactcatggtggggattatatggggactgaatgtcgagttttgaaaaggggaagtgtagattgggggaagaactgtgttttgtcaacaagttgtttaatagcacgaggaaaagcggtaaaggacaatgtt

SEQ ID NO: 520780 - DNA, 580 bp, Homo sapiens
ctgaaaaaaaaaaaaaaatttttaaaaagggaaaaaaaaaaaaaaaaaaaaggggaaaaaaaaaaaaaaaaaaaagtaaaaaaaaaaaaaaaaaattgcttgcggccgcatttggggctttttggcccattcccccttttggggggcgttcttccattccttggcccgtgtttttcccccgttttgtcgggtaaacccttggtttcccccctttttttcccttgggggtttttccctttttccctgtttggtgtattcccaaagggccctgcccgtttggtcttccctaatggtggcccccccttattggttccgggaatgtttccccttatactttgggttaattttccctttaatttttggtctcggttctttttttcccccattggccacatgtggctctctctttgttctttgctcatttctcccggttttgtgttttggttttcccgtttggccccgggtccccctttttcagccgcgggtctttcccccttggggggtcccccccttttctgggggcttgcccccttgggggccccctcccctttttcttgtttcttggggctccgggtcccct

SEQ ID NO: 520781 - DNA, 118 bp, Homo sapiens
tttatcactttggtacctagttttcttgtctgtgaaatggaggtacaagtgataactctagacaagtctgcatgatcacttctgagacactctagtactgctgactatgagcatcagt

SEQ ID NO: 520782 - DNA, 333 bp, Homo sapiens
tcccgagtaacccacaagggcttcttgtttaattccaccctacatttttgacacctttagagctcaacacagttcccttcttagtgaccaaaatggtggcctactggctggtctagctgacagtggtacttagcaaaggccactgtttccatagtgaccagctgatacctcttccttgcccctctagtgtgcaatatgggtgtttcctcagtttccctcccagctcaggtttaattagatcaaagctgtttttgggcaccaaggttgcccacttaaatcaccagccaaaatggttcctttttccaccagaggtcaagttcacctctctggtgc

SEQ ID NO: 520783 - DNA, 771 bp, Homo sapiens
gatctctctcgggtggagtctgctgacagctggtggcctgcccggagaaaatcctcttggagctcaatcatggttgttggtctggtcgccaggaacgtgtagatctcaaacctggagaggtgccgtttcgagtgcgaggagaagtgtggctcctgacggcttaaggagcttcggtgttggaacctgggccaattagtaccaggcaagagagaccctgtgccctggaactgtttcatacccctctgccttcaaacggccccaaggggtgaacgccaaaaagccaatctgtgttgctagacaagaaatgtgacgggcgggggccacttgtgggtagcccagattgcatgggaaagagactggatttatcccattcaacgcctgtgaacatgtggtagcgcaagacgggtgtgcattcaccgcttgtcggtaccagaggggccaagctctgttgaccgtgtcaatagtcttgcccaatggtttggattacagaattttgaaagttgtcccaagaagcgggacctttaagtgcttgggagggccattccaactttacattggcgtaagtgttgaaaacgtgtggactttacacaagatccaacttttgttgtgggccttttggagttgaaagtcaaggccatgccccgtgggccccccaattaagggggcagttggcttgtgctccccttcttgaacacaatatgagttacacactcacttcgaaaaacaacattggataatttagacattcaacttctgttagacacatctctg

SEQ ID NO: 520784 - DNA, 224 bp, Homo sapiens
tttttttttttcggggctaagggatgtggggttttcttttgtggtgatgaaacatttttggaactagattggggtgatggtcgcacaacactgtgactactgtgttttttacttaaacactgttaaggtggccaggcacagtggtttttttttgtcattccaggtgctaagggggctaaggtgggaggattacttgggcccattaggaagaggttgcctagtgc

SEQ ID NO: 520785 - DNA, 257 bp, Homo sapiens
  misc_feature (57)..(57): n is a, c, g, or t
  misc_feature (175)..(175): n is a, c, g, or t
cctaggagggcaccatgccagagacgcctggaccccatgctaggctcagtgcctgtnatactcttgggagccagcactttccctctccatcacatggcatacttgccattatttgttgtgtaaaatattgtccttagttttcacctttcctaggagacacaggcagagccttgancactacagcttctggcacacagtaggtaggtgcatcacaaacatctgctgagttcacacactcttgccttctcaaaacttct

SEQ ID NO: 520786 - DNA, 901 bp, Homo sapiens
  misc_feature (901)..(901): n is a, c, g, or t
gactagttctagatcgcgagcggcctccatgactttttcaaaaaaaaaaaaaaaaaaaaaaaaaaaaaaaaaaaaaaaaaaaaaaaaaaaaaaggggggggggggcaaaaaatttccccgcggggggcccccttgtttatcggtacgccccgcgtgttttttgtggtgacgaggtgggtcgccctattatgagggaggcggttgttattattagtactagaggcactggggcgcggggtttttatatcaccggtgctggtggtgttgggaagaaactttgggcgcctcgggggctttttggggaagagaccctatttttgggtgggggcggcgctaattgtggggagaaacatcatctctatcaaagaggtagtattataagcgctttctaggggggacataattatatacatgtattgagggggtgtatatgggtggtgtagcaactactagcacggagctaatttatcgtgctggccgcgagggtaggaagaaaattcggtgcgctcatcgaggagtggtattatattttttatagagagagaattattttatatatactggggtagatttatagtattataaaaaatggtggtagtattgtataatagaatagttgtgccaactgcgaagaaaaacatgcatgaaccgcactgagacatggtaaaactagaggcgaagcagagagatgtgagcaggtagtcggaatgtataattggacaagtaatgatacggaatagtgcattagcgtgtaactatgtcgctacttttcacataccgactacgacgctatgagagactctgcgcgctaagcacaacacacccgcgcagcgtcacccgtcgggttacccatacaacatgtcgtctcatggcgctaccgacacctactcgcagcgctagn

SEQ ID NO: 520787 - DNA, 102 bp, Homo sapiens
gtaccttcgcgacgaccactttctccccacccccacgaaacctcttgtgttcttgcctaggcccaggtgttcctggcagtcaaatcgagtctctcattttct

SEQ ID NO: 520788 - DNA, 182 bp, Homo sapiens
tgaaaaatattccccatttatacttaattttactatctttggcccataatcatgaatatattataaaacatgttggtcttagaaaatagggatgatgatgtataataagttcctggcatgataaatgcaaaataggctgttttctttcaaaaaataaatatgctcatgcctttgaaaaatta

SEQ ID NO: 520789 - DNA, 392 bp, Homo sapiens
tgatcgtaacttggttggcaacgcagctcataatagcctatttgacgtaatttgtactaacaaatagaaatcccggttccagaccgcagacccaccccgtctatccaagcgctcgcaacgccgccagaacatctcggtgcccaccaacatgccgctaatgaagtaacaccacccccgcaaccgttgtgtagattccctggcaattgtgctaacatgtttgtcgttggggcagttcccaaccgttcgaggaatcttgagcgcgcacacggccgtgccgagcacggccgtacggccatgtttcggcatccgaaagggagttgagacatcacgcatgtccttgagctacgttgactctggaatcattctgcgtacccctgccggtatggggtcgg

SEQ ID NO: 520790 - DNA, 220 bp, Homo sapiens
agcagtgttgattcggctgatctggctggctaggcgggtgtcccttcctacctcactgctcatgtgcgtcctcccgaagctaggcgctcggtcgaaagaggacgaccatccccgatagaggaggaccggtcttcggtcaagggtatacgagtagcttgcgctccctggtagaacctccaaacaaggtctcaaggtccatttgtaggagaacgtagggtag

SEQ ID NO: 520791 - DNA, 384 bp, Homo sapiens
atttttttatggggtttttgtttaataggtcctgtgagatttacgctttaaacaggttctattttggtgtgtttcaaggattttttcaagatttagagctccttttagcagttcttgtagggctggcatggtactggcgaattctttcagcatttgtttatttgaaaaagactatctttcgttgatttatgaagcttagtttcactggacacaaaattctgggctgataattgttttgtttaaggaggctgaagataggcccccaatgctttctagcttgtagggtttctgctgagaaatctgctttatcattttgtaaatttgactattttgtattcagcattacttgaccccttatgggcagggcaatgtattaaaatgtgg

SEQ ID NO: 520792 - DNA, 863 bp, Homo sapiens
cctgaatatcgagatgtgtaatcataagcatctgcgaatggaagcatcaaaacggatgatgaactgaatcgcagggtgacttgtgcttggttattttggccacatgtgtgagaaagcgagggagacgaacgaagtgtgtcacaatattgatggacagagagtttaaaatccaacaagcgtgagttgaaaagtcagccgcagggaatcgggggtgtagacagaaagaaagcgactaatttcctccaattaaaaaccccttttagtgcgaaaattaggcccagggtttgtacaccagttagaagacgaccacagaatttcttttggagaacttataatgtgtagaacaacgtgacggaacatcggtacagtggtcataacaactcccagaagccgacttgaaacaacacagttttacaagcttttgctccactgggaaaaaacgggttgtaacaaaggggtgaacacacttagtcccattattcaaccaagtctacaaacggtgctattcatttggcgcataccgaaacattccgcgaatgaagccattcaatcacggcggggccacagatttgttgaacttacagcgccgggattacacaactgggtgcttcaatttctatctctctaaccggtctttaacaacagggccggtacactactccatgcttgaaccagagtcgtggtaaatacagcgtaccatcgcagcgcaaacttgacctgcaaagctgcatccaaaagtgttcttttacggatgcccatggggatattatcaacgcgtggtattatccacgagattcattactccacttttaagctttccttactcctgaaagatccaatacttcggatggcatacctttaca

SEQ ID NO: 520793 - DNA, 1090 bp, Homo sapiens
atataaagataagaagaaaacgactcagacgaaacctgcaaacatgcatgcatgcatgtggcagcattaagcaagcagtggtccaagtcatgaatctcgaattttcaaccaaatgcaggcagcacacagtcagcatcagagcatgcatcgcacactgcaaggctcatttacgcagcgagactcacataaagcccgtcccacgttgtgagttctcacgcagccttgcaagtcgttgggccagcaagcaagaggtcatgcactagcatcatgctccatcgcacaggcaagtctacaagtgacatatgtacccgcagaaggttgccacagcaataaagtgcctattcaccatattccacggatacagctccggccaggtcagacggaatctcattcaaccaccaatcatagactaccagtcattattctccaatcaatcaccaccgaccaagaacaccatcgctcacagtacacatgccagcggctactctcgggcaggagcctgaacagcattgccgggcgtcgccactctgggccttggatggtgactaatgggtgattggcctgcacaatttccacgcgcatggcctacgcaattggtgctgctataactgcacggctactcaactgcgttccgtactacatgtgctgcgtcccgtcatggagttggcctccatgaacttaggtacactcttgcctgtcactactacaacgcgttggcctatgcccgttaagcacggctggcccttactaatgccatggcacagccaatactggagcaaccttggacagggccacaggacattccatggggccaataatgtgccgaaacaccgggttccccaatgagcggccacattaggaccacaccagcacgcaacacacccagtgcacagggtcggcccccgcggcaacaaaggcgcacccgcgaaagggtggcgcccaagagcgacgaagggcaccctgtgacaatacccccacgaggcgagatcaccctacccaaggcaaagcgtgcgagcacaaagtggccatcaggacaacatgcaacgatacacccacataatcacaacaaccaagcaggggcgtgccacaa

SEQ ID NO: 520794 - DNA, 129 bp, Homo sapiens
gtttttatttttgacttttttaaaattccgggggggcggccccccctttttcgcagggttttaaaattggggggggggggggaaccccggggaatttaaacccaaaaaaaagcccccctttccctttta

SEQ ID NO: 520795 - DNA, 522 bp, Homo sapiens
  misc_feature (336)..(336): n is a, c, g, or t
  misc_feature (365)..(365): n is a, c, g, or t
  misc_feature (377)..(377): n is a, c, g, or t
  misc_feature (388)..(388): n is a, c, g, or t
  misc_feature (397)..(397): n is a, c, g, or t
  misc_feature (422)..(423): n is a, c, g, or t
  misc_feature (429)..(431): n is a, c, g, or t
  misc_feature (435)..(436): n is a, c, g, or t
  misc_feature (438)..(438): n is a, c, g, or t
  misc_feature (454)..(454): n is a, c, g, or t
  misc_feature (456)..(456): n is a, c, g, or t
  misc_feature (459)..(460): n is a, c, g, or t
  misc_feature (465)..(465): n is a, c, g, or t
  misc_feature (477)..(477): n is a, c, g, or t
  misc_feature (482)..(482): n is a, c, g, or t
ctcggctctaccttgtctggaactcctgacctcaagtgatccccatgacttaggcctcccaaagtgcttggattgcaggcgtgagccaccgagcccagcctcattaatgtgctttggaccttactagtgagacccacattttgccaccatccacttcatgttgacaggagccctggtctctgtcagccttatgtgtttatgctggagcctttcacttggttctgagtgatttgccaaagcatacagtttccacgtttggagatttaggccctagttactcttagtcttaaagatgttacaggatagtttgaaacagtttaattctctggctagacnaagtttagcccatgctttttcaattgggntagattggcagnttcctagcttnaggacatgnttaagttctgaccttcatgatttannctttannntttnngnggaataggataaacantnggnngaaanttaaaccaggtnggaanaaagggggcaatgccgaatcaagtaatcttttacccttgg

SEQ ID NO: 520796 - DNA, 657 bp, Homo sapiens
  misc_feature (477)..(477): n is a, c, g, or t
gcggggactccgcagcggctccctagttatggggcgccccggtgggttccagcttgaagggtcgcaggagcggctctggcatcacctcggagctgacgaaacgggaagagccccgcaccagtgctgcccctacagagctctcggcggggggtggaggtgaggttactgctcgtccctacccccgtcttcccctccgccgctgggatccgtgagccgcccccgcggagaggtcggggtggctgcgcgggagtgggctgtggcggtgtagcgggcgggtccgcaggccctatgtggtgcggggcccgagccagagtcgagtccctgacgcgggtgggggaaggagagacggttggcgcgacctctgtccccgcctcgtggggccggagcccagggtccccaagccctgcggagcgcgaagacactgcctgaatattccgccgaggctacctgtgcgacttccaggccagtgccttgcanccgggaaatctggggagacccaggccacggactgtcgccgagctggagttggcgggccgtgtcgggaccacaacctacagggtttactagtagaggtaatcgtcgtgaccccatgtgagccacaaaggaatatccgcggctttgccacgggggtgagggccagacagccatgtggagaaa

SEQ ID NO: 520797 - DNA, 350 bp, Homo sapiens
  misc_feature (179)..(179): n is a, c, g, or t
  misc_feature (219)..(219): n is a, c, g, or t
tgtctagagatccggcgagtgatggtcgaaactgacattctgagcacaagcaggcttccggctcggaggacgcgctcagtaccggctctgctaacctgcggcaaggtgcttccaggttccatgatccccgactactgtttccacagcagcagggggatctgggcctgggcaccccagancagaagcccttccagggcctggagagccgcacccagcagncttcgctaacccctctgtctactattaaggcctttgccactcagtcgggctcccaggacctgaaggccctcaataccagctaccagtcccagctcatcaaacccagccattgcactccggccgggtaccga

SEQ ID NO: 520798 - DNA, 653 bp, Homo sapiens
gattgttgcaagatggccgcgcccagtgatggattcaagcctcgtgaacgaggtggtggggagcaggctcaggactgggatgctctgccacccaagcggacccgactgaggggcaggaaacaaatgatctggatggcctgtagtgcttattgtggtgcgtgtgatggggccagtctggagacagtcaaggtagggaagacgtatgagctacgtcgatacgtgtgactaagcatcgaagtctagtattgttgacagaatggacgggcacccgtgtgggaagcgcggggctagatatcagccgagcagagtttgctgatgctgatggatagtccaccgtgagggcgagctggcttgctacaggtttatatccattacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagctggatgtatgaaagttggcacttctttttccatcccggttgtcagtgatgtgcgtgagctggtgcccagcagtgatcctatgtatgtggtaggggcctttggccatg

SEQ ID NO: 520799 - DNA, 1177 bp, Homo sapiens
  misc_feature (650)..(650): n is a, c, g, or t
gaaaccgctaatcgctatctatatgtagatcgtgtgctaggtcgagtatcccattacacttgtatgagccatcactcttggtccctcggagagtccctttttattcatcttggtgatgaagtagtggtgcactttctcggtgcacgcgtctgcgttgctcgtttgcgagtctcgatatgcacagatctacctcgtgcatgtatgatggcgtgaagcacgggacgatggtcgatcgacgggcatgctgaggatcatctgtagctcaagcccgagtgtctcttacactatagattttcttcttcggaaggtcatcggcctcaatcgatagcaccgtctcgggtatgtgataccatcgttgtcgtgtgctcctcgccagaagtctataacacatcggggatagcttgttgcgtgcagaaaccccttgtggcgatgaataacagcgcccaggttgactctttcgggaaacatgtctcgatcacgacgccagctaactatagcaatgtcacaacactgcctgttgtcacttcgattaacatttggacgggggtccctgattgccaggacactgacctactcggagatttaacccacagcagcgtttatatactaggaaagagcgagccttgagccgactacctttccttgcgtgntatattttgacatctcccagaaacgccttcacctctcgtcatgggtggatcgcccaccagcttgacgcgccttgcacttggtgacagccacaggatgtcatgtgtaatcaaccgattctagtagcgtgaccgattccaccagggcaccttcactttgtaggagccagtttcacgtttgccgcaaacagtttgtacaatcggaggagggttaggaaggcacatagtggcgcaaacattgcgcggtccacagtagcggtagtgataccgcgaaaacaggtatcgctcatatgatatttagcatccgggcgataccaaaggcacacgcatcggcggagcgctagtgcgcatacagaccattgggtggacactagccgccaaaggtatcaccccttggagatagcgagtagacagcggtccagcgcaaatacttggtggcaatgcggacctgatcggggagaccgctatagggattggcgttgggtgccatcactatccagttacatcgcacatctacatggcccttacga

SEQ ID NO: 520800 - DNA, 126 bp, Homo sapiens
cacagcaggcaggcagcacagcaggtggtgttacaacttttattgcacgctgcagtgtacaacagtagcagaggtacccctcttgctgtccacctcctctgtgctgtccacctcctctgtgctgta

SEQ ID NO: 520801 - DNA, 457 bp, Homo sapiens
  misc_feature (5)..(5): n is a, c, g, or t
  misc_feature (448)..(448): n is a, c, g, or t
aaagnaactcaacttggtttttgtcccttaaaaaacctatctcaatcccaatggtatgaagggcaactggaaaacaaaccaccctggttcaaatccctggcttggtcacttaatttggccaagtggccctgatatggtttggctgtgtccccacccaaatctcatcttgaattgttagctcccataattcccatgtgttgtgggagggacctggtgggagagaattgaatcatgggggcggtttcccccatattgttctcatggtagtgaatatgtctcacgagatctgagggttttataaggggtttctcctcttgcttggctctcattcttgttttgcctgccaccatgtaagatgtggctttgctcctccttgcctttgtcatgattgtgaggcctccccagccctccccaggtgacacattggaactgtgagtcaattaaacanttcctatat

SEQ ID NO: 520802 - DNA, 668 bp, Homo sapiens
cttttgcgtcgccagcccgagccacatcgactgagacaccatggggaaggtgaaggtcggagtcaacggagttcggatcgctataggtgcgccgggatcaccagggtctagcttttaactctggatagaagtggatattagttgccatcaagtgaccccgttcattgacctcaagctagcactggtttatcgagtgtgccgaattatgagttccaccctagtggcaaattccatggcaccgtcaaggcgtgagaacgggaagctatgtcgtcaactggaaatcccagtcaccatctgccaggagcgagatccctccaagaatcaagtggcggcgatgctggcagctgaatacgtcgaggagtccacttggcgtcgttcaccgaccatggaggaaggcatggggctcattatgcagggtgggagccaagaagggtcatcatctctgtcacccatctggctgaatgcccccatgattccgtcaatgggatgctgaaccagtgagaagctatgacaacgagcgctcaagatcatccgagcaatgccatcctgggaccagccaagcatgcggcatgcaccccatgagccaaggtcaagccactgacaactcagggtatcgaggaaggactcatgaccacaggccatgccatcactgcacccagaagacgtgg

SEQ ID NO: 520803 - DNA, 315 bp, Homo sapiens
aacccccaccactttggaaggctgaggcaggtggatcacttgaggtcaggagtttatgaccagcctggccaacatggtgaaaccctgtctctacccaaaaaatacaaaaatgagccgggggtagtggcacacacctgtagtcccagcctcttgggaggctgagtcaggaaaactgcttgaacccaggaggcggaggttacagtgagccaagatcgcaccattgcacttcagcctgggcgacagagtaagacccatctcaaaaaaattaaaacaaaaaaacactaacaggtattgaggtgttgggcgataacatca

SEQ ID NO: 520804 - DNA, 877 bp, Homo sapiens
  misc_feature (695)..(695): n is a, c, g, or t
ataccaccaaatattaagtcatgcattaattaaggtcgcactcaaaaattctagagaggcatccagattgccacaggcaaaatggtgtctgcagatgacaagattgtatgcatcaaaaattctaagaaatccactagaaaactattaaaactgataaagcgagttcatccaggtcgtagaatacaagaccaatgtgcaatgatcatttgcatttggtttcggtcggtggtttttttgtgagacagagtctcactcttgtcgagactggggtgtagtggcgccatcttggctcactgaaacctctgcctcccaggttcacgcaattcaacatgcctcagccacctgagtagcagggcattcacacggtgtgtgccaccatgccttggtaattttagtattcaacgtcagagatgggatttcccttgttggccaggctagtcatgaactcctggcctcaagcgatccacccatcttggctcccagagtgctgggattacagtgtgtgaatcaccatatcagactcaattgtatttctgtacactctaataaatggcatacattccatgttcatgaatccgcagaacttaagattgaccatacttccccaaatggtttaacggtttaatggttattcccattattccagggggtcctgtgcggatcacaaatccattggaatttcggcacccgaaatngggacaaccttgacagggttgatggcccacccttctggattaggttaggacaacggcatcgaatcttgctgggtaaacggcacataagggacatcatacgggcgcaaagtgaattacaaaacgccgtgtgtggtgagttacacaccggaccacgtagcaccacaccacgttgtgtgatttaa

SEQ ID NO: 520805 - DNA, 723 bp, Homo sapiens
  misc_feature (176)..(176): n is a, c, g, or t
  misc_feature (203)..(203): n is a, c, g, or t
ttttcataaggttaggtctcaatacaagttgcaaaagggtgttccagacttgtatatttttagtctttggctagcttggagagagttgacaggggatgttttcctgcaatgagttaaggtaaggttgcatcttgagtggccggcatcaagttaagccgtgagtgccttcaatgcancaagttgtcatagcatcgtgcattgtnacggcgtttattttttagacctattgtggaggtgtagctgtatggcatgtttcagggtacgcctcattcatgagacaacaatcagtacagccggctctgcctattatggtgtataaaaccttgcagtgttttgtgacacattacttacagcgaagtcttctctggtgccatgagatagtgttgaaagactctccgtcatcgtcgcaagttatagtactcaatgggggctgcatgaggtgtggccatgcgcatgtgaatctgttaaggtggtggtgccgcgaaaaacagcatgtgatcattgagcctcttgggaagtcgtagatcaatagtgaaaaagggatatactgtgggtagggaggttcatcatcctgtccagtatgttttttaaagatcaaagcatgagtgagtgcacttctgtggggattcattagcttcaatagaagagcattgcactcgtgaaggttgtgtttcctggagcgaacagcgagctgtgtgttcatgtctcaataaagagataatt

SEQ ID NO: 520806 - DNA, 851 bp, Homo sapiens
taaaggttttcatctttaatgaaatgacttgggaaataacgtaaaattcccatgacaccaatactacagttttcggagtcacagtaagatacacagaaattacagtccggtaacttaatatgtaagtgcccaaccagtgtgtttaaggcagataaatgtgtgcttacagtggacgaagagcaaacatcaagaaagagcatacacatcaaactaataagaagaccctatagctttcagcacgaagggcaatatcccagggatatgcttagtgtagaaacgagcgtgtgttgtcttcagcagaaaagagggtattcgtgggcattataccacaacgtggaataaggggctggccaaacgagccgtggtctccataataaccacgcaccaagagagccagcacacatcgcatatgcgtggtgtggcgggcacccgtgtcaccaaaataaattctgtgggaggcagttagtcaagtggtcctcgtgggcagtgaagtggggacggggtttcgtgcaaacacgtccccttgggggaattagcgtgcaagacaaagacccatttccgtggggcccccagtatagaatgtagccggtatgaaaggcccgtcttcacaagactctcataaagtaacgcgcttccgtgggtcggaaggagtaaacagcttggtactggcacgaaaatctggtgcctcactggttttgcccaacctcctgagaaactcccaaggacttccggcgaattcaagaagaagggggggggactgactggggccacaagccttttgggggcgcaaggctgaaaccatattcttgttcaatcttctttcgggaggaactggcggccgtctttggaaa

SEQ ID NO: 520807 - DNA, 178 bp, Homo sapiens
  misc_feature (131)..(131): n is a, c, g, or t
acactgggttcgagttctagaactcgggggtcagaaggggatgcagctctgggaccatcagcaagaaggacattatcaacccggacaagaaaaaatccaagaagtcctctgagacactgactttcaagagngccgagggcatgcaccggggaagtctattgccttgtttctaattctt

SEQ ID NO: 520808 - DNA, 277 bp, Homo sapiens
cgtgctcctatgtgcacggcaggccatgagaccagctcagcatctcgcccaggctaccttgagtagcaccttccttgggatacggcgccgggctcgaaggccataggcttgtagaccacttgggcaccgggttgggcaggtgtttccctgtacgtcggagaagtcgaagtccatctcacacccccagggtcatctgagcgacgatttagcgttgcccctatcgttgctgccgccgtagatcgctcggtcttgcggcatttttgaaggtaggtcgggg

SEQ ID NO: 520809 - DNA, 100 bp, Homo sapiens
cccgggatcgcagcaccacagcacacgtcctccgaattctcaaacgacacctggagactgtcccgatacagcgacgctcccctgagaagtttctggggcc

SEQ ID NO: 520810 - DNA, 128 bp, Homo sapiens
cgactctagcacggatccccacacttcgatcgcggagaagagcaaaagtattctcgaacacctgggtaagatttaatcttgggaggaacttgtgattgcattgacattctcatataatatatgttcta

SEQ ID NO: 520811 - DNA, 172 bp, Homo sapiens
actctacaggatcccctgctagcagacactagcacctgtgatgctcccagtatttctactacgatggggagctcttcctctcccaaaacgtgtgagactgagtgaagtggactagtgccctcagtcctccagagactcagaacctatggccaatgagacgtcagagaagttt

SEQ ID NO: 520812 - DNA, 234 bp, Homo sapiens
tccgggcgtttgcacgaatagtcaccgtcagagtcgcaggtcgcctggttctaggaatacatgggggaagtatgtaggagttgaagattagtccgccgtaatcggtgtactcatcaggtacagtaccattggtggccaattgatttgctggtcagggagggatcgttgacctcgtctgtaatgtaaaggatgcgtaaggaatggaagggcgactgacggacatacggatgaatg

SEQ ID NO: 520813 - DNA, 197 bp, Homo sapiens
accgtatcatcagacaacacaaagacctgcggaccagggcttcatcctagagtcgtgccgcagcattggtgaacctcattgatcgtgatggcaactggaagctgggcctggtggagttcaacatcctgttggaaccgcatccggaattacctgtccatcttccggaagtttgacctggaccagtcgggcagcatgag

SEQ ID NO: 520814 - DNA, 121 bp, Homo sapiens
ttgagaattagtatttgggtttcacagatgttatttttacagtcaaggttttgatgatttaatgacttgagaaatagagaggacctgagggagtaacaacaaactgtaacaaattttagac

SEQ ID NO: 520815 - DNA, 290 bp, Homo sapiens
ggcccggtccccggttactgtcatcacacagcctgtttcaccctctgtgacccgcctcctctgagggagtggactggaccactgaatgtcactgttccttgaatcatgggcctagcagattgcctgccagaggcgggactgagccagcccttctgggccccagggacaagccagacacggacgtgacaccaaagagctttgtacactatgtcattgagaggtctgactgccccaagcctggacagcaggaaacacgccctcccacaaacacccgaggagccacatgaccc

SEQ ID NO: 520816 - DNA, 105 bp, Homo sapiens
tgcactgtagttcatacctgtcactgttgttcatacctgcacgtgttgattcatacctgcacttgttgttcataccatccttattcattattatattgcagctgt

SEQ ID NO: 520817 - DNA, 456 bp, Homo sapiens
  misc_feature (291)..(291): n is a, c, g, or t
  misc_feature (371)..(371): n is a, c, g, or t
atagctggtgacagtacccctcaggcagcaagaagattaaattagtcacctgaatttgaccctgccttctagtattgaaaatcaaatgatgtccttgtgatttttttttttaacacttatgtttacttttggctacctgtaaagtctctacccttttagtttttaaaagcatacaggccaggcgtggtggctcacacctgtaatcccagcactttgggaggccaaggcgagtggatcacgaggtcgagagatcgagaccatcctggccaacatggtgaaaccctgtctctnctaaaattacaaaaattagctgggcatggtgatgcaggcctgtagtcccagctactcaggaggctgaggcaggagaatcncttgaacccgagaggcggaggttgcagtgagccgagatcacaccactgcactccagcctgggcaacagagcgagactccatttca

SEQ ID NO: 520818 - DNA, 179 bp, Homo sapiens
cacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtc

SEQ ID NO: 520819 - DNA, 114 bp, Homo sapiens
gcaaggttgggctggtgctcacagctgtaatcccagcactttgaggttggctgggagttcaagaccagcctggccaacatgtcagaactactaaaaataaagaaatcagccatg

SEQ ID NO: 520820 - DNA, 460 bp, Homo sapiens
acagaaaaaaaaaagcacagaaaacacacacaagaaaaacagtcttcatgttttttgggttaacacgagttgggcttcccaaagcctgatccacccaagccttcctccacctccccaggtaaccttaaaatggagttccctatcctctgaaactaaaaatcaaatggctatgtcaagaaaaattataggtcgtggtaacattatgtaccacattacatgtaccaccccgaccacacttcagggccagggcatacaccaccagacacggcatttggtcccactaagcccagaaggctacttctatatcctctacacagcgctccaatcagctacagtcaatggattgagagtgggcagaagagctcaaaacctcattttccctgctgcaaaatacacagtgcctgacacaagaatttgaggccaggcacgggggctcacgcatgtaatctcagcactatgg

SEQ ID NO: 520821 - DNA, 941 bp, Homo sapiens
cgcctaaatactgccggagtctgcgctagttgtgacgcagtactatagcgctgtattcctgcactgataaacgaaaagcaatccaccaggtctcgcggagctaactttccggcactacttatgcccgagcgtgtcgctcccagtgcgcaatgtgcacgcaggtggactgcactggggggcgcgggagtgagtgaggaggaggaggaggaggctggggtggggccggcgagcaagtgctgtgatgcgtcttccgggggatggggccgtcgggtagatgtggctgaataccatgtttcccgatgcggtcaacggcagcgatggcgattatgacgttgttgtatgtggtgaacaaagctggcggcttgatttaccagttggacacgctacgcgccacgggctgacggctgagaaaactttcagttatccgctggatctgctgctcaagctacacgatgagcgtgtgttggttgctttcggccagcgggacgggcatccgagtggagtcatgcattgtctggccatcacatggcatggacgtgaatggcaggtacacggacgacgggcaaagaggtgctggagtatctgggtaaccctgctaattacccggtgtccattcgattttggcggacccgggctcacttctaatgagaagcttatgctggctccatgttccactcggctctttgccatcggtcccagtgtctcctgagcaggcaagctcatggcattgagatgctggacgacagcacacatttcaacattgcactttgtaccagacaactgagcagggatcacgtttgtggtctaagcaagatcctagggcaagctggaatagattctcttctcgaaaagatctactgagatttactccagactttggcctcaaagaatccaatctattcttagaaaatggcccatcaaggtgtgagctcttgacaaaa

SEQ ID NO: 520822 - DNA, 347 bp, Homo sapiens
  misc_feature (245)..(245): n is a, c, g, or t
  misc_feature (325)..(325): n is a, c, g, or t
agacaggatctcactccagttgcccaggctggagtacactggcacaatctcggctcactgcagcctttacctcctgggctcaggtgattctcccacctcagcctcccaagtaactgggactttaggcatgccatgcccaaccagtttttttgttgtttgctttttgttttggtatttttagtagagacggggtttcaccacgttgcccagggctagtcttgaactcctgggaatcaaacaatctngccttgcttcagccttcccaaagtgttgggggttacaggtgtggagctaacttgtaaccccgggccttaattttattatnaaaggatttctttaatctgttc

SEQ ID NO: 520823 - DNA, 212 bp, Homo sapiens
agattatgctcacgcgtggtaatcccagtagctttgtgaggccaaggtgggagtgtcacttgcagcccagcgagtttgagagcagccacgagcattcaaactagagatgatgtcacaaaacaattagccaggatgatggtggtgtgtgcctctagtttcagggtcaggctgctcaacagaggattgcttatgcttgcgtaagtcgaggcctg

SEQ ID NO: 520824 - DNA, 124 bp, Homo sapiens
  misc_feature (123)..(124): n is a, c, g, or t
agctcgggaaaaggggaaagggttgtgaggccttttacctatgtgacatctctatattttatccccggttttataaaacgaggaaactgaagttctgaaaatctccttccagggccccagggnn

SEQ ID NO: 520825 - DNA, 1037 bp, Homo sapiens
agattctctacgactacatgtgactgttggcatcctagatatatgtagcgtgtcggaaggcatgaggaaatgttaccagatgtatatctggtttcttgtacttttacacatatttccattgagaaatgatagccattctgtttaccattgactagagtaggtgcaaaatgactagggaaaaacctcacattttcgtgtaactgacgcttcaagctattgtaaactagacctcattttgcagcccatccaagttggtattagatcacgaatatattgttgaggggatcgtatcgtaataagtatacttatgtgcgtagcactacttttacagaagaggttgtaacgaaatattgaaaagcgatgtaagctttaatcttaggcaagatattgcggtttagactttccggggcttttttaaaatttctgagaaggggtacccagggcactttcaaactaacttaatgttcccataaggaaaattgttcaatacaagtttggaaacctaaaaagaattgattgacaaggtaattttttgattggtaaggaacgagttagggaagttgtgagttcgggagaagtgacgttttctggcgttttcctggggggtttaaaaaaaccgtttaaaggacagttttgtaacttacgtttttccctgtcatttttgggggttaaaattgacggaaacttcttattcagacggtccccagaaattgtccttaggttacagcgcaaccatcttaagctctacaaatccgtaaccccttttagcttggagcgttcacttgcgtgccacgcgtttacaagcggtggggacagggggaacgccttttaaatggttaaacagcggaggcccaataatttgttacacttgccagtgctaatctctggtagagttaatgtgagtttaaggagggacaaaagggtaagagcaaagaatgaagggcttggaaagggtattaattcagggtgctttatgaaacttgggggaggggcaatataattagtgggcacaaaaatgtatgcgctggggagccagg

SEQ ID NO: 520826 - DNA, 390 bp, Homo sapiens
  misc_feature (91)..(91): n is a, c, g, or t
  misc_feature (107)..(107): n is a, c, g, or t
  misc_feature (125)..(125): n is a, c, g, or t
  misc_feature (175)..(175): n is a, c, g, or t
  misc_feature (218)..(218): n is a, c, g, or t
  misc_feature (221)..(221): n is a, c, g, or t
  misc_feature (262)..(262): n is a, c, g, or t
  misc_feature (355)..(355): n is a, c, g, or t
  misc_feature (390)..(390): n is a, c, g, or t
atattagtcagcggaggaaaaaaaaaaaaaaaaaaaaaaaaaaaaagcggccgctcgaattgtcgacgcggccgcgaattcgcggcgtgcnttaaacggctgcgagnaagacggacagaaggggnacgttcagccagaccgagaccagttcccagttcccagggggaaggcctgncaggcccctgggcccctttccaccaccttctggcccttccgtntgncagaccttcgttccattctggcaccagggctctggcctttnacttcccccaagtctttgggaaatttgttcttttcctttgaaagtcacattttcttttaaaattttttgttttgcatccgaaaaccgaaaagnaaataaagcggtgggaaggcaggccattgtgttgn

SEQ ID NO: 520827 - DNA, 175 bp, Homo sapiens
ggacgttaatactgctttacaagaggttcttgaggactgccctcatccacgatggcctagcacgtggagtcgcgacgtgcccaaagccttagacaggcgccaagccatctttgtgtgcttcatccacctttatgagccattgattgcaagttggtgaggcctttgtctgacacca

SEQ ID NO: 520828 - DNA, 182 bp, Homo sapiens
ctagagcgcattccctcgctaccataatcatgctatccccaccggtgtcaaagtatttagctgactcgccacactccacggaagtcgagagtacggaagtcgagagtacggaagtcgagagtacggaagtcgagagtacggaagtcgagagtacggaagtcgagagtacggaagtcgagagt

SEQ ID NO: 520829 - DNA, 276 bp, Homo sapiens
cttttgctataccaatcgccaaacttgtcaggactggctaatgcggattcggactctccatcatgatgggtaggattgttggcaggccagcctgcagtgagcagtcagacatggctttgatttgcttacatgagatgaaaacaaccagtcctatctcaggggacatgacttggaagttaccattatgatggtggtacaagcattatgtgaacttcattgtcctggagctataccgggacttgctgtctggtcatcatctattgttggaacaaatct

SEQ ID NO: 520830 - DNA, 524 bp, Homo sapiens
  misc_feature (254)..(254): n is a, c, g, or t
tgtgctcatctctctctctcccccggacctcctcgccatggccagcctggagctgactctgtgtggtgtgtgggtcactgccaggaacccacgtggcagccacctctcaccccaccatggtcacagccctggtgtgcagcgtggtggcctctgctccctccaccttctctcttgatggggaccctggcccggctctgcccagccctgctgtgcttatcaccgagatgggagccaagggcctgagacaccagcgntgtgtgccacggcccactcgccatctggcacgtctcccagaaacatcaacgaagcacgaggcaggaagaggacgacacaggaacagcagacgaggaggagctgaggaggcccctgtgcctgcagcaagtgaaaatggatcccgaggctctccgtgttggggaagaggacgtgcggtcccccgaaagccagtccatctccgtgtcgttctggggacgccggacacatactggaaatatccagagttcgggaagagagcgggtcaggcccct

SEQ ID NO: 520831 - DNA, 132 bp, Homo sapiens
gtattatttttctgatcatccagaatagatgcatttgtaactgcagttggttagaccagccactgggccattagacctaagcatgtccctacgctgcctgagtctctcaagagtagaataaatgcgtcgaca

SEQ ID NO: 520832 - DNA, 299 bp, Homo sapiens
gggaaggaggaactggagagatgtgtgtgcagtgagggaggtcagggagatggagcggttctcagtgatatagctgagtgggtggggagcccatgtacctggaggactcagagagcaagacagtctcagagcatggtgagagggactggatgacagccaagaagtctggaaccaggggactcattggggccccctgaggtggactttgacaggctgctggcagcctgcggatcttagtgaggctggtggtagagggtgacacccaagcgacaccagtgcccgggggggtaccgagctcg

SEQ ID NO: 520833 - DNA, 103 bp, Homo sapiens
gagtcgtggcttgagccctgtgcggttcctcaggagttatgttcgccaacaacctggtgtatgacaccttcggacagcgatgactcggatgagcaggagggga

SEQ ID NO: 520834 - DNA, 980 bp, Homo sapiens
gaattcagcaatatttcttccatttgcttttgaaagaagagaaatatggctctgttccgcctggctttttcccggcggtcagagtttaaggttatctctcttgtttcctaaacattgctgttatactgttcttttttcaaggtgcccagatttcatactgtttaaacacacatgctctacaatttgtggagttaatgcaattatcacagggtcctgaggcgacatacattctcctcggcttacgagatgacaggattaagagattaaagtaaagacaggcataggaaatcacaagggcattgattggagaagagataagtgtccttgaaatcttcacaatttatgtttagagattgcagtaaagataggcataagaaattataaaagtattaatttggggaactaataaacgtccatgaaatcttcacaatccacgttcttctgccatggcttcggccggtccctccttttggggtccctgacttcccgctacagcctcagcctcccaagtagcggggattacaggcaccagccacaatgcccagcaattttttgtatttttagtagagagggggtctcgccatttgtccagtctggtcttgaactcctgacttctatatgattgtatttgttttttcacaatgtatttcatacattgaaatggtgggcaagtggaaaatcatattctcaatcctctggttttataaggtcaattatcataattaccttccggtcttgctcattttacttctccccacatttttggtggtcatggccaagcatttgtgccagacgtgccccgtttggggtaacggctaactcatggaaagggagccgcttactgggggtcatccttggaaacccctcggaaatatgtaacccgggcagaaaaaacgcagaaaataaaaagccgaagaagagtagtgacaccacagaaaagatgtacaaacaccaagctttgtcgtcacataagatattaa

SEQ ID NO: 520835 - DNA, 753 bp, Homo sapiens
ggggctggggtctcctgaggttgttgccaggtgtgggaaaggagagaaactcctacgcactgcccccgagtctcgaccgtgcccccgcacccgctgtctcagggctatccttccctgacgtcaggcttgaaaggaaacagggaagtgaagccatgctgagagacgctccataactccttcagggagaggcggggagggctcagggtacctgggagccggcaggacagtggtgggattgggggtcccaggtctccggggtgggggcagtcactcactatgagtgaggagtcggcgcgaggattggaggagggaaggatgttgtcagctggggagccagcgtctgcaccgcaaaatcccgaggtggagcgtgttcatgcagatctgggcaaacctccatcatcatttgcccggtgaccctggttatattccctctcatcactgtaggctcaggctgctcctgtggtgcctgtggctggagctgaacgctgtgtatcccccttcccggggagggcttgactggtctctgatggcacccccgtctttccccagcgccggcatcggcgtacaggcaccatcattgtcatcgacatgctcatggagaacatctccaccaaggggcctggactgtgacattgacatccagaaagaccatccagatggtgcgggcgcagcgcttcgggcatgttgcacgacggatgcgcagtacaagttcatctacgtggcattcgccaatcattgaaaccattaagaaaa

SEQ ID NO: 520836 - DNA, 152 bp, Homo sapiens
agtactggttctcgtgtctgagtttgatcataccgaataaaatgaggatgtagtccgtgggcgattatgagaatgactgcgccggtgaagcttcagggggtttgggatgagaaatggctgtgaccacgatgaaccccaggtactcgggtacc

SEQ ID NO: 520837 - DNA, 316 bp, Homo sapiens
  misc_feature (194)..(194): n is a, c, g, or t
cggcacgaggcagcctagggacttggtgccgtgcgtctcagctcctccagtggtgactgaaaggggccaacatagagctcgggctgctgcttcatggggtggaagtcccaaatcttggcagcttccatgtggtgttgagcctgcgagtacatagaagtcaagaattggggtttgggaacctcaatctagatttnaccgtgttggccagggtggtatcgatctcctgaccttgtgatccgcccaccttgggctcccaaggtgttgagattacaggcgtaagccactgcacccggcaataaacctctttcttttgtta

SEQ ID NO: 520838 - DNA, 204 bp, Homo sapiens
gccaggtcatcaccattggcaatgagcggttcggtttcgaggcggcttgttcagcttcctttctggtatggaatcttcggcattcacgagaccaccttcaacttcattatgagtgttacgtggacatcgcaagacctttacgccaacaggttcttttgggcggcaccaccatttaccggcattgcacagtattcagagggagat

SEQ ID NO: 520839 - DNA, 204 bp, Homo sapiens
ttatgctggtcgctctacaggatcccctgctctggtgctgtacccgtcggattcggagtcgtgtgctgctgatgtactagtcggcgtcgcccagcacctggccggagctgatttcgcgctgggcataaccgcgactgcccacttcataagcgcacctgcaacttcggcgcgtcatagccggtgtgcgtgacatagttgaccgag

SEQ ID NO: 520840 - DNA, 167 bp, Homo sapiens
  misc_feature (8)..(8): n is a, c, g, or t
  misc_feature (15)..(15): n is a, c, g, or t
tgagcggnctgcagnctacaccacagcatagcaacacagatctgagcctcgtctgagactacaccacatctcagtgcaacaccggatccttaacccattcagcaaggccagtgatcgaacctgcaacctcatggacactagttggatttatttccattgagaccgct

SEQ ID NO: 520841 - DNA, 332 bp, Homo sapiens
  misc_feature (126)..(126): n is a, c, g, or t
  misc_feature (132)..(132): n is a, c, g, or t
  misc_feature (327)..(327): n is a, c, g, or t
  misc_feature (332)..(332): n is a, c, g, or t
cccttgccccttattaaataaataaataaataaatagttgggcaactgtggcctcatatctgtcatcccccagcattttgggtttgcccaatgcaggaggattgcttgagcccccaggagtttganacccancccgggcagaatagcaagactccatctctacaaataataaaatattaacccaggtgtggtggtgtgcaccctggggtcccagccacctgggaggctaaggtgggaggtttgctcgaggctgcagtgaactgtgaatgcaccactgcattccagcctaggccacagaacaggaccttgtctataaataaagaaagnggtcn

SEQ ID NO: 520842 - DNA, 1582 bp, Homo sapiens
  misc_feature (936)..(936): n is a, c, g, or t
gtcttgtaccatcacaaagttgtccagcagaagctcctcctgcttatactcctcaagctgctgaaggtcactacactgtatcctatggacacagattctggggagttttcatcagttggagaggagtaaataggaatcattctcagccaccgcttcttgagaccttagggcctggatgcagatgaatggatttggataccaaatggagtacagatttcctcagtaaatcctgcaggggaggttagtgcaccttcgtatcctgggtaccttcgaattgtgaggtaccgggataattctctcgatacggttctaaaccgtccatcccgggctttcttcagagtctgtcgactggtatatatcctctagtacctgatagatctccggttctgaaatgtactgcgggacgcttacatgttttcctgatacaagtgctacaagcagcaggatgccatagcgaggggtcgacctgtcctctgagttaccacacgcgatgacagaagaggccccgaagcaccggcaacgccaaccggtcgacctatagggatcaggcaactggacaccgcgccacaaaacagacaggatgccaatcctggacacactaagacaccaccttcgacactaaagaaagctatgggcactgatggtaaccgctggcaccaggccaacacggctgacgaccacagaacccggcgcaaaggcacagcacccacggagcaaccaccgagccaatgacacggcacgcccacaactcccaagctactactagagggaccaagtgaaccaaatgcgtcggctcatccgaacttagtaccaaaccgactaaccgagctaccaccggacggtacctcgtgaactacacaaccagtcatacgtaccaaatcaacctagtacaacgatgtggtctttctcttctcactatctgtttatctatctttntcctctcctcacagatccatcgatcgagagtcatcaatgcagtccaaaacacagcagtcgcagcgcaacacatacaccgagaaacaacgtgacaagacggaaacgacgggccgagcagcgaaccacaagacacagcagagcaacggcaagaagaagggaagcagaacgagaagaacagcgaagaagcagcgaacgacgagacagcgacacgaaacgcctacatggacgagcagcaacagacgaaccaaacagagagccagcaaggagaccagaagcaacacggaaacaacggacagacgaacaaccagacgaggcagcatgatctcgatacagtacgacatgacaaaagcacacatatgaaagctactaagtaccggtctcaaacagcattgatgatcgaaccttcaaaaccaaccaactctaattactcacatcaacatactattagcaatactcacatgacacatctgcagactaactccaatccatacaatagtataaccagcatagtgcctcgcatatacactactgcatacatcataatatactagcaaccatactagaacaccgcacaccatcattgcgagcggtagatactaataggctaatagcacagccgaaaagcgagaacaaacagggagagctt

SEQ ID NO: 520843 - DNA, 357 bp, Homo sapiens
caggcaggttctcgtcacagcgctcagctcgcactgatgtttataccatgagtaggcctgagaaataaacatgcttagcttgcattccacgttctatacactaataaaataaacacctcgtgccagagaagctggcatctagtatatccgtcacgcaagctatcgcatccataatccttctaatagctatcctcttcaataatatactctccggacaatgaaccataaccaatactaccgatcaatactcagtcattaataatcataatggctatagctataaaactaggaatagccccctttcacttctgagttccagaggttacccgaggcacccctctgaagaacctgcctgcg

SEQ ID NO: 520844 - DNA, 284 bp, Homo sapiens
  misc_feature (252)..(252): n is a, c, g, or t
atccaaagaattcggcacgaggcggctgagccgcaccaaaaatcagaattttgcgaaaacccctacggggaagaccaactaccccctgaggggttaaccccctggaaacgaaatgaaaaagttaaaggccaagaacccaggaaaaggaaggaaatttcccccgatacagcagagaccgttcttttttcgtgtcaagcaggcccgtaagaagagacgcgactcattgtagttacacaaatatttcatagaggnggtctttcttgtcatctttgtttgtggaacac

SEQ ID NO: 520845 - DNA, 744 bp, Homo sapiens
gtgagccgcgctccctgtgaggtgggcaagcggcgaaatggcgccctccggtggtcttgcagttccctctggtcagtcctgtgtgctgttgctttgggtgtgctccctggacgcacgggcggctggagcagcgttctgcgtcatcactggacgacaactggagagaactgcgtggaacgcgagactggattgatagaattttatgccccgtggtgccctgcttgtcgaaatcttcaaccggaatgcggaaacgttttgctgccatgcgtgagactatcttgaggttacttattgcgaacattacgatgtcacagagcgagccaggacgtgagtggacggtaatatatcactacactgctcttcctactatttatcatctgtatgacgatggtgaatttaggcgctatcagggtccaacgggactacgaaggacttcataaactttataagtgataaagagtggcaagagtattgagcccgtctcatcatggtttggtccatgttctgttctgatgagtagtcatgtcagcactctttcacggctatctatgtggatcaggacgtgccataactactttattgaagaccttggattgccagtgtggggatcatatactgtttttgctttagcaactctgttttccggactgttattaggactctgtatgatattctgttggcagattgcctttgtccttccaaaaggcgcagaccacagccatacccatacccttcaaaacaaac

SEQ ID NO: 520846 - DNA, 81 bp, Homo sapiens
atcttaaatgaacaggtttcagcggatgttctctccagctttcaacagaccttgcactcaacttgctgaatcccattccaa

SEQ ID NO: 520847 - DNA, 203 bp, Homo sapiens
gtcggcccagcgttcttcactcagcctcctaagtagctaggactaacagacacatgccaccacacctggttatttttaaaattatttgtggagatggggtctcaccatgttgcccaggctggtctttaactcttgggctcatgtgatcctgccatcttggcctccccaaatgctgggattacaagcatgagccgactgagcca

SEQ ID NO: 520848 - DNA, 386 bp, Homo sapiens
  misc_feature (352)..(352): n is a, c, g, or t
aaaacttgggagaaatcagatggcctttaacgggtggctggtgaaacagtggatggtgcctctatgcccggaatactactcagcgataaaaaagaactaattactgacatgggcaaccactgggatgaattccagagaattgtgctgagtgagcaaagccaatcataaaagtttgcacactgtatgattccatttacataacattttgaaatgcaaaattataggaatggagaatagattaggggttgccaggggaggagtggggagaacaagagagttgggcataactattaaaagggtagcacaagagatcccttgtgggtgatgggacatattccagtatctttgaccnaatcaatgtggaaaatcccggggttggggatatt

SEQ ID NO: 520849 - DNA, 157 bp, Homo sapiens
aggagaagacggggtatctagcccaggagaggggctcaggaggaaccagccctgcccacacctggatctcagacctccagcactccagtgcctagtaggagacatcaactgtgtttcgtttctaagcctgcccagcctctggtattctgtgacagca

SEQ ID NO: 520850 - DNA, 285 bp, Homo sapiens
acacaaagacagcaatagaagatctaagaactgaaattgcactggccaggcgcggtggctcacgcctgtaatcccagcactttgggagaccgaggcgggcggatcacgaggtcaggagatcgagaggagatcgagacaatcctggccaacacggcgaaaacccgtccccactaaaaatacaaaaaattggccgggcgtggttgcaggtgcctgtagtcccagctacccagctattccggaggctgaggcaggagaatggcctgaacccaggaggcggaccttgca

SEQ ID NO: 520851 - DNA, 924 bp, Homo sapiens
ggactgctggaggagtctcgctgagctcgaggtaggtggcgcgatggagggactgggaaggaagaatggaggtgtagtccaagtctgcgttatgagatagtatccttgtaagtatcagttgagcattatgaacatttttttcctagataagcgttactaaaagatcattggatcccatgtgccgatgaaagactggctactaaaaataaggtaagagtatttgatgaagagcaatatagagagagtttgaaaggaagttaggatttgtacggaagaggtaaaagatcatcatcgagtatctgaaggcacaatagaccgagacgagttagaaatcgatactatattgcagagagggataacaatcgatagtattttcatttgcataacctatgaaggaggccaggtcataaggcgcctttgcacccgagtctcacttcaacccagcatgcggataggggggcaaaacttgtctcctttccactcactttaccttcccaggcctttgcgttgaaatagaattcccttggatttaataatgttccaaatttgtcccaattaaatgttgtgcaagagtggactgctttccaattaggataagtagccaggcgtagctattgacccattactgccaggtatctccatgttccgggagaggagatcgagaggcaagacaagcgcatcattttgagaggtaaactcttaaaatggaggcgccaagtggtatgcatactgggagttccccattaatggggagagcccctcaaatctatttctgtccgggtaaacaaccaagggttgggtcatttaaggccaaaccaccgggaacctttaatcaaaggtcgagacagagtttcgtccctggatacactggcattcaattcaagacgaatccttttaaggaggaagtttagcaggattggccaa

SEQ ID NO: 520852 - DNA, 696 bp, Homo sapiens
atggcacatgcagcgcaagtaggtctacaagacgctacttcccctatcatagaagagcttatcacctttcatgatcacgccctcataatcattttccttatctgcttcctagtcctgtatgcccttttccttaacactcacaacaaaactaactaatactaacatctcagacgctcaggaaatagagaaccgtcgtgaactatcctgccctgccatcatcgcgtaggtcctgccatcgccctcccatccctacgcatcctttacgataacgagagcgaaggtcaagggatccgctcgccttaccatcgaagatcaatgggccagcaagggtactgaacctacgagtacaccgactacggcggactaatcttcaactcctagatacttgcgccattattcctagaaaccagggggactgggactccttgacgttgacaagtcgagtagtactccccgattgaagcccccattcgtataataattacgtcacgagacgtcttgcactcatgagctgtgccccacattaggcttcaaaaacagatggcaattcccggacgtctaaaacaaacgtcttgcagcgatacacgaacgggggtatacgtacggtcaatgctctgaaaatctgtggagcaaagcacagtttcatgccaatcgtcctagagttagttcccctaaaaatctttgcaatcagggccg

SEQ ID NO: 520853 - DNA, 331 bp, Homo sapiens
  misc_feature (331)..(331): n is a, c, g, or t
agacgccgggcctacaacgggagcgtgaggaaagccgtgcgtttgcgtttccaaggcatctgttaagcccgccggagtatacaccatgagcaaagctcaccctccgagttgaaaaatttatggacaggaggtatcattgaaattaaatgtggcagacatgtccacggatattgcggggatttgatccttatgaccttgtgataatgaatgtgtgagatggcgactagtggacacagacaatattggatggtggtatacgaggaatagtatcatcatgttagagccttggacgagtattaataatggctgttcagcagagaaccatgtcctn

SEQ ID NO: 520854 - DNA, 252 bp, Homo sapiens
ccagtcttcgtcccatcagaacatgctcttaaacaaacagcaagcttcctccattaataagtcctgatgggacgcagatcgtcttctcccatcagtccctcaaccacatcttgtgtgacacgtcgttgactgctattttgataaccacaagaggtcaatgtatagaaatccgctgatggacgcccatcttctcccatcagcaattcctgcaaaggggttaaaaatttaacttggtttttacatactggatgg

SEQ ID NO: 520855 - DNA, 309 bp, Homo sapiens
  misc_feature (70)..(70): n is a, c, g, or t
gatttcagacaaaggcttcacttttcctaaccagttcacaaaatcagagaatttttgattcccacctatngacctgtgagctcctgcttcaagatattccaccttttttaggccaaaccaagtgtataacctccaagtgtcgatttacactttcgactgtaacttctgctttcctgagatttacccctgcctttaaaaacccttgcttgtaatccctcagggaggccgtgtatttattaatcatgagctgcccaattctccttgcttggtgccctgcaaataaacacactcttttctcccactgcaaaa

SEQ ID NO: 520856 - DNA, 670 bp, Homo sapiens
ttctgtgataggaaggcaggactcctgaatgggaagggggtaagggcatgatgagtgtgtcatcatccagagaagaggggtacgggagccccagtatttcagaatatgggaagggggtaagggcatgatgagtgtgtcatcatccagagaagaggggtacgggagccccaatatttcagaatatgggaaggggttaagggcatgatgagtgtgtcatcatccagagaagaggggtacgggatccccaatatttcagaatatgacctcaagccaggaggaggcttcctcctctccaggtaacttcagtctctcttggccacagataaagcagaccatcttggtgagaaatggaatgagccctctgttactttgtaaaagcaagaatgggccaggcgcagtggttcatgcctgtaatcccagcactttgggaggctgaggcgggtggatcacctgaggtcaggagttcgacaccagcccggccaacatgatgaagcctcgcctctactaaaaatacaaaagattaactgggcatggtggcgggcacctgtaatcccagctactcgggaggctgaagcaggagaatcacttgagcccaggaggcggaggttgcagtgagcggaggttgcgccattgcactccagcctgggtgacaagagtgaaactccatctc

SEQ ID NO: 520857 - DNA, 137 bp, Homo sapiens
agcggatccttattcgcgacttgggactgaccggacactatcatccagctgacaaagcagagcacatgaagcgacaaagacatcccatgattgcgccgccaggtcggcccaggtctatctttcccgtccctcccact

SEQ ID NO: 520858 - DNA, 1441 bp, Homo sapiens
  misc_feature (1441)..(1441): n is a, c, g, or t
gatcgtcgttaagtcggacttcccaacatggtcgcagtctcatctcacatccacggagctgcaatccttggctgcacggcttagacaatgctctagaggacactagctggcaccaggaatgtggagtctctatgtccgacgtccattgcgtcagcttcaacagtggtaacatgaccagagtatcgtggaagccaacggactgtcgtgaacgtgctgacagctaagagcacatggaggtggaaacgaacttagatcgttccccacatgatcggagtttctactgatacttgtaccctgggaaagctttgcatgaatgtggcacatccaccgttgcttcatcgaactgttgggaaacttgggagtatcgtcatcgtacacgaactacgagctgacgcgatgccctaatggggacactttcttctccaaaggaggtgcaacgacctagtgactttatatcgtaataccgaaatgccacgtacttgggacgaacagaggtccgatccaaggccttcgtttcacggacgaaaagggcacggcccacttgcaagagcagggccccgtgtccatgggcaaacgattgtatggcacttccggcacaggcattttcccaaggggaggttttccaccataggccccgttgggcgaggcaccagacttcccaggtgccttaagcgttgtcttaaaagggcctcttggcacgcaggttcatggcttggccactcggaccacattcgcggttggcccaagaaggagtgaagcaaccccctttttctggggaacgatcgagtcttccccttgggctatgaatagggggacatcgaggcgtactaaggcgatgggattttgtgtaaaaagtatgggtccccaacatatttaaagcaatgttgacttgacaccaaggtcttttgtggaatcccacagcgatactaccaatttgcatttcggtagagtcaacatgtcattagcgacacaactcgagcacatcgtcggagatgggtgcgcagtcacagctacccatgtggcgcgcacctacggagaaagacatgaacctatactattggtcacacgatacgcaccatacttatggagtacagataggcggaccacagtgctgcgagacggccatcagcaaaacaacgaggcatggacccgccacgcacaccagcgatctggcgcacatagtagcagaccaacagtacacgcacacggacaagacaaacagcaagaggctgaagcactaacaaacaggcatgacaaagcgacgagacgagggtaaatcacccaccagaacaaagacaaaaaactaatcaaatccacacgccacagggggacagctagagccacacaactgacgatcccacaacacaaccaacatgcgaaaacacgatgtgcgaccaacctaacgacaagtagagacaccacagacggggaggactgtaan

SEQ ID NO: 520859 - DNA, 959 bp, Homo sapiens
aacggcagcctgcagaaggtcaatgtaggggttctggggccacagaggagagggcacttcccaccaggacccccaacatgaaggtctaggcctcaggggctcccgcgcttcttcctccagacagcgggaactgccactgctctcccaggccctgttctggaggctaaccttggttcctggagagtgtgcccctaccacctccctccagacagccctgatcacaccatgagagccaggaacgggtcaccctgactgaagatcactctgtgccctgggggaggagccaagccctcaccccacgaggggcaggtgggggcttggttgctgacccggccgagtccccacagagcaccttctgtagctccagacttgtctccctggcttctctttgaaggagaaaaatgtgaaatatgcactgagaaagccagccccgacctgcttagtcagccccggcagcagggtcacgtcgcatggagaactcaggaaaagcaggaaccctttccgaaagcccagagatgccctgggactcagatctgtaattctcccaggagctgtgatagagcaggccgacaaagatgtccctacgcctccctggtgctcccccagatgcctgtgatggcatcacattccccacattgattatcatgcgatgcggcatgacagggactctttagattgcatgaaattatttcatagtgaacggcttcttcacgagagaacaccacaccggaacttcagtagcatttggcattccctggttaagaatcaccaatatttaaaataacaaactttcctgaaatgggacctgtcatgttatccagtatggtggtacttcgccaccattgtcccctgctggtcgggaaccacacaggacctgcgtgtgagcgtgctgactctcacgcccggctccagagccgtcctgtcttgaagctggagcttggttgatccttcgaacggcg

SEQ ID NO: 520860 - DNA, 251 bp, Homo sapiens
cccccatattcaccatgatgccagggagaaccttgattttaccaatagaggtcgccctctactcactaaaaccccatcactaatcaacaggttggattacagcgagggaatcagaggctatttttagattggtcagtactcagctcaccacccataagaccatatctcctctgcgtgtggcactagtcttagatatactgtaatttctttcttccccaggacacttaagatacagtttcatttccatgaca

SEQ ID NO: 520861 - DNA, 988 bp, Homo sapiens
  misc_feature (80)..(80): n is a, c, g, or t
  misc_feature (640)..(640): n is a, c, g, or t
  misc_feature (710)..(710): n is a, c, g, or t
  misc_feature (875)..(875): n is a, c, g, or t
  misc_feature (896)..(896): n is a, c, g, or t
gctgtaggatgatccattctggtcccctggacgtgatagctaggacactaaggtgctatgcaacgttatgaatcagctancgcgcggtgctatgtatatggtcgtctatccactggggtgacatcgagaagcatcctcactgagaaattctctagtaaggcatcacgagagtgccttatgaccggaattaacactaggccgatatggatgacatggactgtgatgaaggcttcatccgcatggttgcaagcatgactcgctcacctagtagcagtggatgatcgcggcttgcgagtgtgaccaattgaatgcctgtgcgcagagtacaatgggctgagtgaggtttacggaggtcaggagagttgtgctatgtggcattacccctaattgtactctactttattggtagacttgccttgaaataaagactctcagaactaggaactagcccagaaagtctcgaagagtagagtgagaagcagtttgaacgcagcgagtagacgaccgtgagtgttacccttggcaaaggatacaggagatgccttctctcttcgacgtaatgattttcttcaactatacgtctggactagttcccgagtcatgtcgcatgggggggttggagccgcgtgcgccaagcggncggctgccgcgctgactagcccgtggtgatcatacccattgctggatggtgcgcacatatgcctaacaanattgtattggctcttgcacccaattctgtggaccatgagttgagtcccatatggctcaggttatgagaggcttctaaattgcaagtgaccagcggatccgttggagtttagctgctcgccggacactagcctaggttagcggctcacaatgcgtcttgttggtantaacgtacggaataggccctnaagttgccctgggcgtgagggttgcccttggccgagccactagtcttttgcgtgttgagccgttgtgtggaacgcgttcgcgtcattattct

SEQ ID NO: 520862 - DNA, 681 bp, Homo sapiens
  misc_feature (1)..(1): n is a, c, g, or t
  misc_feature (4)..(4): n is a, c, g, or t
  misc_feature (8)..(8): n is a, c, g, or t
ngcngccntggccccaaagtgctgggattacaggggtgagccaccgcacccggccactactgatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcaagtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctggaatgttcttcccagctctccatatggctgatttctcatccttcgggacttgccccattctccaaccccatcactagttttatctttttcacttatttatgcagtctgctcttgtcctaggacatgagctccaggagggcgggaaacatctcgctttgtacactgctgtgccctctgtacccagcaaggcgcctgtgtataataggtgctcaataacataaaatgaacaaataatcctca

SEQ ID NO: 520863 - DNA, 899 bp, Homo sapiens
  misc_feature (177)..(177): n is a, c, g, or t
aaaaaaattacgacatagatacgagaccggatgttcatcctatcaacagctacttacgctgagacggtgcgctggcaagacacgatgccccgggctgtgatttgtagacattggaacccacagatcattgatgaagttcgcacatggcacctaccgccagacatcattccaccctgnagcagcatcatcacaggcaaggaaggatgctgccaataactatgcccgagggcactacaccaattggcaaggagatcattagaccatttgtgcttaggaccgaattcgcaagctggcatgaccagatgcaccaggatcattcagaggacttcattgagttttccacagacttatggatggagggaactggttctggagttcaccatccctgctcatggaacgtctctcagattgattatggcaagaagtcacaagactgagagttctcccatttaccacagacaccaccaggtattccacagctgtagatatgagacccatacaacatccatcctcaccaaccacaccaacctggaagacactctgatagtgccttcatggtagacaatgaggccatctatgaacatctgtcgtaagaaaactcgcatatcgagacgcacaaactacacctaaccttaaccgcctctattacgccagcattgtagtcctccatcacatggattcccctgaacgatatggatggagcactgaatgttggacctgaacagactaccagagcaaactgagtgccatacacacgatacactaccctcctggccaatttgccctgtcaatctcggtgcagaaagctaccaagaacagtgctgaagacaaatcaacaaaggtggttgaacaaccaaacaaggggatagactccctggaaactggtgggctgacgcgga

SEQ ID NO: 520864 - DNA, 201 bp, Homo sapiens
gagctcggtacccagtgcatgctgcatctggcgctgatcgacgccggttgaactagccatggcggcagcgatccagcccgcctcgccccttccggtccgggcggattatgaaagcctgaaggtcgcggccgaatggtacgcgcgcctgcagaatgccgatgccagcgcgcaacaacgcctcgcctggcagcattggctcga

SEQ ID NO: 520865 - DNA, 620 bp, Homo sapiens
  misc_feature (1)..(1): n is a, c, g, or t
  misc_feature (4)..(4): n is a, c, g, or t
  misc_feature (8)..(8): n is a, c, g, or t
ngcngccntggccccaaagtgctgggattacaggggtgagccaccgcacccggccactactgatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcaagtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctggaatgttcttcccagctctccatatggtcacttatttatgcagtctgctcttgtcctaggacatgagctccaggagggcgggaaacatctcgctttgtacactgctgtgccctctgtacccagcaaggcgcctgtgtataataggtgctcaataacataaaatgaacaaataatcctca

SEQ ID NO: 520866 - DNA, 146 bp, Homo sapiens
ttcaggcacaccgaggtgatgcatctaggcagccagcttgtacacagaaaagcagctttgctttcgctctggtctttgccttcgcttttaacactcaagccggccggtaggccggtgtgctcttgcttttgatcttgatctgcggg

SEQ ID NO: 520867 - DNA, 721 bp, Homo sapiens
gtctcgctcagttgcccaggctggagtgcagtggcgcatctccgctcactgcaagctccgcctcccgggttcatgtcattctcctgcctcagcctcccgcgtagctgggactacaggcacctgccaccacgcctggctaatttttgtatttttttagtagagatggggtttcaccatgttagccaggatggtctcgatctcctgaccttgtgatcccagcactttggaggctgaggcaggaggattgattgagctcaggagttcgagaccagcctgggcaacatggcaaaaccccatctctactgaaatgcaaaaattagccgggtgtggtggcacacccctgtagcgccagctattggggggttgaagtcaggaggatgtgctttggccccgggaagtcaaggctgcagtgagccgtgatcatgccactgcatccagcctgggtgacacagttgagaccttttctcaaaagaaaacagagattagcacaaagaatgtgcatcatggttcaacgagaataggggtcgtgggaaatgaggtaaattcagttcaaacccgtgggtcgtgccaattttattagcttgaaatagcctggccttggtgtagtcacttaacttcgggagttctttattccttatttttaaaaccaggggttagggtacctaaggaaaggcatggggagaatttagcacgcacagtctgcgtaaaggcatttggcagg

SEQ ID NO: 520868 - DNA, 247 bp, Homo sapiens
ccccttttcccccccccggggtttttttaattaaggggttttaatcccttttttggtcccccggtggaggtgggaaccccattttgttttttaaagttttccccgggtttttttttttttggggttttttttttgggccccgaatttttttttttgtcctgggaaagttaaagggggaaatttaaacccttccggtttgttttggtatggccgggattttttcaaaaaatttaaaaatggggtggga

SEQ ID NO: 520869 - DNA, 733 bp, Homo sapiens
  misc_feature (19)..(19): n is a, c, g, or t
  misc_feature (64)..(64): n is a, c, g, or t
  misc_feature (212)..(212): n is a, c, g, or t
  misc_feature (214)..(214): n is a, c, g, or t
  misc_feature (258)..(258): n is a, c, g, or t
  misc_feature (285)..(285): n is a, c, g, or t
  misc_feature (302)..(302): n is a, c, g, or t
  misc_feature (304)..(304): n is a, c, g, or t
  misc_feature (310)..(310): n is a, c, g, or t
  misc_feature (317)..(317): n is a, c, g, or t
  misc_feature (474)..(474): n is a, c, g, or t
  misc_feature (496)..(496): n is a, c, g, or t
  misc_feature (602)..(602): n is a, c, g, or t
  misc_feature (611)..(611): n is a, c, g, or t
  misc_feature (613)..(613): n is a, c, g, or t
  misc_feature (615)..(616): n is a, c, g, or t
  misc_feature (618)..(618): n is a, c, g, or t
  misc_feature (621)..(621): n is a, c, g, or t
  misc_feature (623)..(624): n is a, c, g, or t
ggggattgctgcaggctcngactcccgtcctgcgatgggttgcgacgggggaacaaaccccaanaggcatgaactggagaaggggccgaagaaggttgagaaggtcgacaaagatgccgaattagtggcccaatggaacaattgtactcaaagtcaggaaaaaaaaagacgaccaaaagttgcctgtgaacttggcagactataaaacaaanangccgtcaaagaatttcccctggacaaacctgcagaaaaggcccntgggaaggcagcatctcacaaaaaaancaaaaagaatgtgacananccgaanccttccnaaaaaccagcccgggaaggggaaaaaggaaacacaaaaggcgacaagcacgacgacccccagcgggcgcgtttcaaccgccccgttgtgggcctggagatgaacggccgacacaggttccgcctccttcggtgcagcggctgagtgtattcagaacnagccttgaaagagaaaaaagcngaagtttgccacacgtgtggggcagccttccaggaggatgaagtcatcgtgactcaaagagcaccaaggaggatgtggacgtgctgaagacaaggatggaggaganaaggctganancnnanttntnnaagaaaacaaagaaacccaaggcagcagagtctgtttcaaaaccagatgtcagtgaagaagccccagggccatcaaaagttaagacagggaagcctgaagaagccagcc

SEQ ID NO: 520870 - DNA, 347 bp, Homo sapiens
tcagtagcgagcacggtcggaaaggcttggattctagtcgatgcagggttagcggatggtcagtctggccaaatgtctcgcccctgcactgttgtgcgcatgaacaaagcccagctcgacaactattacgccatccacattgccaagcattgcccgacggcgacgatctttatcctgtgcgtcaacggtctgagccataacgaagccgaagatgcccggcaccgatgtgctgctgcatgccatgctggctcggtgacagagcgcgggatggcgctttgcccgacccgtcagtagggtcgaatcgttgcaacttgttgcggtagcattgcgcttgctccgcttactga

SEQ ID NO: 520871 - DNA, 1015 bp, Homo sapiens
gtgctgctgccgccaggcgcccggcgccgaggccgcgcccgtcgcccgccgccgagccgccgcccgccctggacgtggcctcggcctccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgagcgcacccggctctgcgcctgcactcagccgccttccgtcgcgcccccgcgcgcgacgagaacgccctagcgccttacgccttactcccgcaccccgggccggggcccagcgccgaccgacaccccagctagcaccgaactatacagccgaatggcgccctggagtaccgaagacaaactgaccttgacttgtaccgacttagggcctataccagtggattaggaaaacgcggtattcgaccaggaatcactgtgctcactaccggaataacgagcccgatacaaccgccataagaacatgggcacacagcaggcactagccatgagcggcgcgcgacgccgaaggacaccacatgatccaccaacgggtacaattacacgataggacaggggataaagaacacgcattctgggaaagccatgagagggcgccaccccacggacacaaatacttggggggtaggagcattggggaagagcgccaaggaaagagcataaggaaccgatagataggggattagaggtaacacaagagagggctattcggaggacgtaaaaaaagcgccgaggggggagaacgaacataataggaataggttaggaagaaagtaggagatagacacgtatatagtataagcgcacggatacgacctattacagaaaacaaataaagacgatggagacgggatgagaaaacagggcaggcaaagccgcataagacttagcttgggagcgcgggagtaggatagaagaaaggggagatgaggcaaaaagaacggtggagatgaagtatga

SEQ ID NO: 520872 - DNA, 535 bp, Homo sapiens
tatgcaaagtgtcagaaggctaaagacaaaataatacgacgagtaacaaatgctggagaaagatgtcgagaaacggatcctcatatattcattacagctacagcaagaagtagtttaacattttatttcagaaaactaaacatgcaactaccagtgtgacccagcaaatgcattcctggatatttatcccagaggaataaaaacacagccacatgaaagccttcacctgagtatttatagcaactttattcataatggctccagaatgaaaacaaccaagatgtccttcaatgggtaaatggttaaacaaattgtgggatatccaaaccatggaatactatttatcagtaaaaagaaataaactattaacccacacaatagactctccgcatgaatctcaggagaattatgctgagttttttttaaaagccaattccaaaaggtgacatactataattccgtttatataagattcttcaaatgccagaattatagaaatggagaacagattagtggctatcaagggttaaggaga

SEQ ID NO: 520873 - DNA, 344 bp, Homo sapiens
ttgtgcacagctgtctgcttcatagcctaatgtcagggaagcccaacccagagggacacatgtctcgtgtgtgccccactgttcattgcctgtgaaccagggcatagtcctcagtttctcccaataaattctacagaccctgtactctcattgagacttaaagcactcctcaatatgaattcttggattacacagttcaaggagaaaaaagtgttaagacctgtccaaatagatccttgcttttataagttaagtttgttcccttcctctcttgtataggtgaggaacacaagatccgagcgttagggggcctaggagagtcttccatagctagtggcgtgctg

SEQ ID NO: 520874 - DNA, 301 bp, Homo sapiens
tacattcaggcgtaggtagcaagtagcaggttaaggcagggtgcatggtggctatgatgggggggcatgatgaggctattgttttttgtgaattcttcgatacatggccccatttgggcaaaaagcctggttagcgggggcaggcctcctcagggagaggagggtggatggaattaagggtgttcgtcatgttagcttgtttccggtgcgagatagtagtagggtcgtggtgctttacgtataagttgagctacgtaggacctgcggtacgtagttaggatacatataacatagttaacac

SEQ ID NO: 520875 - DNA, 390 bp, Homo sapiens
ctaagctctgaaaagggggtggtgcgggtgctgggctgccctcataaggtgctcccagacaggagtgcagtgggcctggaatgtaggaataggcagagaggcccagctgggcaggagagcagtacaggatagcgtctgccctctgctgggcttggagtcggctgtgggcggctccatcctcagacccacgggcctctgctttgtggactctctgttgctccctggtgagcagcgccacagcggggcaacctaggcacttagtagcgtgtctgggaagctgggctccgtgaagccccgttgcagggaggcaggccccgggagcacataatcccccataaaactgaggccgagcctgtgtcctaagattgatcccggagaggccaggggact

SEQ ID NO: 520876 - DNA, 353 bp, Homo sapiens
  misc_feature (53)..(53): n is a, c, g, or t
  misc_feature (89)..(89): n is a, c, g, or t
  misc_feature (128)..(128): n is a, c, g, or t
  misc_feature (132)..(132): n is a, c, g, or t
  misc_feature (146)..(146): n is a, c, g, or t
  misc_feature (191)..(191): n is a, c, g, or t
  misc_feature (210)..(210): n is a, c, g, or t
  misc_feature (213)..(213): n is a, c, g, or t
  misc_feature (339)..(339): n is a, c, g, or t
ctggttctcctcttgtgctcttccattttccaaggttgttccaacttggtggngggggggtatgtgggtatttcaacagcccctctgtntctctttctacccaacattaacttagcaggttggttttnaganccggcagcttagcntggggtattgctgtgttctgtgggtgccgggcaggttcttaattnagtgcacaggggtcttganttncggggttcttctgttcttctcggaacatggttgtccttccagggttgtgcatctggccttgctgtttaagttccatcaggggcgccttccgttctagagtatctgctttccacggcatcagggccngctttccggccttc

SEQ ID NO: 520877 - DNA, 394 bp, Homo sapiens
  misc_feature (193)..(193): n is a, c, g, or t
  misc_feature (196)..(196): n is a, c, g, or t
  misc_feature (382)..(382): n is a, c, g, or t
cgtgtgtggatttgagaccgagctcaatgtccagtttgtcagccacatgtcactccacgtggacaaggagcagtggatgttttcgatctgctgcactgcctgcgacttcgtcaccatggaggaagcagagataaagactcacattggcaccacacacaggggaagacaggaagacccccagcgaatcaaatanccnctcttcatcctccctctcagctctgagtgattcagccaacagcaaagatgattcagatggctcccagaaaaacaagggcgggaacaatctgctggtcatctctgtcatgcctgggagccagccctcactggaacagtgagggaaaagccagagaaagggttcgaatgtgtttttttggcaactttntctggcaagacg

SEQ ID NO: 520878 - DNA, 85 bp, Homo sapiens
  misc_feature (26)..(26): n is a, c, g, or t
  misc_feature (59)..(59): n is a, c, g, or t
aaaactttaaggtgttggtgtatttnccagctttatttgctgtactttatttgtatttnccattcagttctagcttttaagtata

SEQ ID NO: 520879 - DNA, 135 bp, Homo sapiens
atctcggcacctagctctacgaggtccatgcatacttcatattatacttaaattcaatacgggctgtccgatcaatagcgagctattcatcgtgcaccgggtcatagtattgtgcgtgtgttgaattcaactacg

SEQ ID NO: 520880 - DNA, 312 bp, Homo sapiens
  misc_feature (13)..(13): n is a, c, g, or t
  misc_feature (66)..(66): n is a, c, g, or t
  misc_feature (180)..(180): n is a, c, g, or t
  misc_feature (278)..(278): n is a, c, g, or t
  misc_feature (282)..(282): n is a, c, g, or t
  misc_feature (287)..(287): n is a, c, g, or t
ttggacctctctnaggatttcgttggaaacgggataaacttcccagaactacacggaagcattctnagaaacttctttgtgatgtttgcattcaactcacagagttgaaccttgctttcatagttcagctttcaaacactctttttgtagaatctgcaagtggatatttggaccactttntgccttccttcgaaacgcgtatatcttcacatcaaacctagacagaagcattctcagaatgtttcctgtgatgactgcattcaactcacagagggtgnacantcctnctgatggagcagttttgaaactcct

SEQ ID NO: 520881 - DNA, 1385 bp, Homo sapiens
gagcttatatgtctcgatcgttagggtcaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 520882 - DNA, 1371 bp, Homo sapiens
atagaatcgagctggctaccgtacattcgtgtccctctgacttctggagacaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 520883 - DNA, 334 bp, Homo sapiens
ttgactctataggatcccctgccatttactccatggctggcaacaagagtgaaactccatctccaaaaaaaaagaaaagaaaaaagaaaaaaagaagaatgtagaataaagaaagaaatgaaggaaagaagcaagcaagcaagagagagagcaaaaaaaaaaaaaaaaagggaggattgaaaaagaaattaaaaggggggcggaacttgggggttaaaacttttaatccaaacttttggggaaattgaaatggaaaaattatttgagcacaggagtttgaccccagccttggaaacatagggaggctttgtttttattacaaaaaataaaaatt

SEQ ID NO: 520884 - DNA, 1353 bp, Homo sapiens
cgtccggaatcgtcgtcttggtgaaggaagttttcaaccgcctgctgggcaccagcatggtgagggaaactcagccttgtccccgctgaaccctggagagctcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 520885 - DNA, 2031 bp, Homo sapiens
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagacttgacaggatcagcttctcgggggaccgcc

SEQ ID NO: 520886 - DNA, 548 bp, Homo sapiens
  misc_feature (488)..(488): n is a, c, g, or t
  misc_feature (546)..(546): n is a, c, g, or t
agtaataatgagttgttttacttcagaatagataactggaacagaatatggcagctggaaatgagctgctgtggtaatcagaagctacaatatgtgacacgactgtgaggctgacctgtaactgggcctcaaggagaccattcatgcaacctggaagggcatcaagactcttggtcagggcctgaaggacggtgagaaaatgtcattggaaactggagaaaaggtctgagagttacttgctgagggactgtgggaaaactatggccacaacatggaaactgaaagggcactgcaccatctcagggatctgcctaaggagacatctgggaagaacatggaaagtgctaccagcctcccctaactgtcactgaataaatatgacaggagagggacatgatctaaagaagaaggttcagttttcaaacagaatttagagaaaatataaagaaataatttcttgtctcaaaaggccaaagtaaaaaaaaagnaaagaaaacaaaagaaaaatgaaaaagaccactctatgccataagaaagcaggagtcngt

SEQ ID NO: 520887 - DNA, 1023 bp, Homo sapiens
tcagttttgacagaggcaggtatcccacactgccttcctgcctccctccatctccctctcattctgtgggcttgcttgagtacacccacacacactcttggctgtttgttccaagcagaggcgctgacaagttgtcccaggccgctaaaaaccctggctatggtctctgttcccttttagagtgacacctatctgctcatctaactgccttcctccatttccccttccttgcttctcccctatgcaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 520888 - DNA, 362 bp, Homo sapiens
gtagccagatgctgtggcttatacctgtatttccatcactttggaaggccgaggcgggtggagcacccaaggtcaggagcttgagaccagcctggcaaacgtggcaaaaccccatctctacaaaatacaaaaattagctgagcatggtggcaggtgcctgtagtcccagctactccggaggctgaggcaggagaattgcttgaacccaggaggtggaggttgcagtgagttgagattgtcccactgcactccagcctgtgtgacagagtgagactgtctcaaaaacaaaacaaaacaaatgaatgtaaacatttagtgaagtgactggtagctagtgagggttcattaagcgcttatatgac

SEQ ID NO: 520889 - DNA, 1709 bp, Homo sapiens
  misc_feature (1677)..(1677): n is a, c, g, or t
  misc_feature (1684)..(1684): n is a, c, g, or t
  misc_feature (1694)..(1694): n is a, c, g, or t
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacccaggnattcttnatcacctccnattcttccgtccctg

SEQ ID NO: 520890 - DNA, 225 bp, Homo sapiens
ccgaggatccccatcgaccctgaatttattatgcaggtcaaatactagtcgctaaatagtttaaggttgtaaactagcttttttctgttttaggagatggagtctggccctatcgccagactggagtgcagtagtgcgatcttggcaacagggtgagactctgtctcaaaaaaataaaataaaataaaataacaccaaagaaaaaaacaattaaaatcttagggc

SEQ ID NO: 520891 - DNA, 1563 bp, Homo sapiens
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccactgacaatgagataactgacatc

SEQ ID NO: 520892 - DNA, 117 bp, Homo sapiens
cgtaatatctatgaggatgcgggttggatcctgtgcctcactcagtgggttaaggatctggtgttgccgcaagctgcgtcgtaagtcacagatgcggcttggagaccgatcttaccg

SEQ ID NO: 520893 - DNA, 302 bp, Homo sapiens
caaaaaaaaaaaaaacccaaacccccccaaaaaaatagggcaagtgaaccccaaaaagatgttttgggggtttttttaaaaagaagtcttgttagcttttttgttcctggaacaaagctgttttcgaacgggcccaaaaaacatgggggctacccaccagacccccatgggactttccaactgaaaaaaaaatttgtcccaaaaactttgttgtcatagttaagttgattgtaaaggggaattgaaaaaacccctttgaaaatatttcctcaaggatgtttcctgccccttgtgatccctta

SEQ ID NO: 520894 - DNA, 739 bp, Homo sapiens
gtggcccacaaattcctgtgacgggtttctttctggatactggacatgctagtcaactttgggagaggagaatttaaaggatgtctccccgtgagattgttggacacagtgccccaatgaagggccgtccaatccaattggccagaaccttaggatagtaatgggtaacatctccaggcccattaatgtgttttccaaggcgcctattcccccacaggccattgttggtaggttccctgctaagctgtaatgccgtgaagaagatggtggggcctttttagtaattggaactgtgaccattaatttacccagaattgagacccgggatgtctggatgctgacccagggagagccccagtactgttttatgccctccatcctttaggaaggaattgcgtggtttttctgaacatgtgggggaaagggtggtttcttgctggatttcactggcccctaagtaaatttaaatgcctcactttttaaatttggatgtttctgctagagacccttgaatttggaaaattagttaattttgcactgtttgtccacccgtataatgtatgagaaatagaaaaaaaacaccgctttttgtaaaaacccctaagatttgtatatgttcatctttaggctttttgaaagggagagaaatcatattggaaatccgtgttggtgttttgaaatctgcttgtaaaactctcatctccttttaccttgatattataaaccttttaaccgtgga

SEQ ID NO: 520895 - DNA, 1609 bp, Homo sapiens
  misc_feature (319)..(319): n is a, c, g, or t
atttgtggttttattgtttgacgacgtacagacccaactgtgttgtgatctttccgcttggtttgaatgaaccccactacaggcggcgctcgttggttgaactcttctttgggtacgaccatgcctgatctacgatccactgatgggggggggagatttgttttgttggttgggtgtgttttttgcgttgtgtgtcgtccaccatccagttatgtctctgtgttgttctgcatgatttggtctgcctccttctgttgtttgtttctttttttttgcgtgcgactaccagcaccacaccccccgctctgtcggggggggnggtttttttcttcgtggggaggcggggaaaattttggtgtgtccacacactgcgaccctacccgtatggagcggatgtttttgtgcgcccttcttttatacccccccacagggggggcgccctttgtatcaagcggtggtgtactcctttgtgctctcctcgtgtgtgaggccccccacctccttttgttggggtgtggcggccccccttttttggagacacgtctgttgccgcagctgttcttctctgtgttccccctacagtggtagggggagtttgtcccccaccgtctttggtgacaccagaggccttttgttgttgtctctcccggcgtgggtccccaccacgctattatataacctctctgggggcacctcgcaggcgtcttgtgttgtctgctctcgctcttcgagagattgatatagggtgtctgtcatcacagcaccctctctctttttctgtgtggtcacactctctctatgtgcctcctgctcatccgcggccagctctgttcagttattgtttctcacatcttgtggacacacacacgacacacatctcttcacgcgctctctcgctgcgagaaatctcttgtgtagagagacacaccacgctcgcgcagtgttcacacctcgagagccacgcgagactctctcttgagataaccctctcgcgagcaccacgctggggtgtgctcacacacacacgggggtatacacgcctctcgcgcacacgtggtagacacacacgcccctcgctcacacacacgcgctcgcacctcgcgccgcggataacacacacgcgcctcgccacacacacgcgcgcgcgcctcgcgcaccgctgataacacacaccgccctctccgcatacacctctgtgtctctttggccacacacacacacaggtgttcacacgtgtcgcacgcgctctcaacaggagaaaggctcctctataaaagagagcgtcccctcttttctcgtgggctccacaggagctctcacagagaactcctctctgtgggtctcacatggtccacacacatcccgggaacccacaccacggagggcccaggccggcgagagccccgtggagatgagagccctcacggaacccctgggttgcccacacagcgggagaaaagggaataagagaggttgggtttccccccctttatagagatggggccacaccccctgggggttaccaagattgttataggggccatgaataacatttcttgtaattaggattggaatttaatagccacgaattagagtttattttcaaaat

SEQ ID NO: 520896 - DNA, 127 bp, Homo sapiens
acagcaccacatcacatggaagcagctgtggcctctgctcctgcgctcacacggtatctactgcaaccaagtgatctgacggcaggtgggcttccatgattctgctgccccacttgtcagaaattca

SEQ ID NO: 520897 - DNA, 119 bp, Homo sapiens
cttccgccatcgatgcattccagacccccgatgtcttagttcgcaagtcatcctagcagccttctccaaagccacatgtacagacttggttatgtttatctaatgttaggtctacctgg

SEQ ID NO: 520898 - DNA, 481 bp, Homo sapiens
  misc_feature (32)..(32): n is a, c, g, or t
  misc_feature (442)..(442): n is a, c, g, or t
tcccctatcctaaacccagccccaaactatanttactttattaccagacaaccataacaaacccggtggacctagtgaaagttttaaaaatcccaactcacacctcccgcaacaccaatagtatcgaaagccaaagcatataacattatacccaagcacaatatatcaaggcccaacccctataccttcagcataatgcaaaaactcgaaataactcccccacgcatagccaaacccaaaaccctccaaacccagactactctccctaccatacagctcaacgagcacaccctgtctatcaagcaaaacactcgataacacttactaacttgaggttaaaaaagtataaaatagtagtaaaaaaagaaaatacccaatccccactttctccgctacaactcccccccctccctctaaaaaaccactccccccagttgtattngtaattatagaaatataggtaatactttacattctccca

SEQ ID NO: 520899 - DNA, 513 bp, Homo sapiens
atgcgctcttactgacagatttggtcataggtcaggggtgacacattgtcaacagatgtgcaccagaggaccagggcataatttgctctactagaatgcatcaggacatcaacaggtataggccagtgaggcacgattcgatgagtatacttctgctgactgctatggtctcagatatattgagaacaatgggcatatctggtctacgcctgatcttctgtgatgatatgagccatcacgcccagtcaattcctcagatgctgtgatgtaacaacatgttcagagcgacctccatacttagtccaaacgtgatgtaggatgtgtgatcctacaccgaatctcgtatggaatatgtcctctcgcaatgtaaggggagggggctggtgggagatgataggagaataggggctgatatctcataagtggttaagcagcatcccccttgcaactgtcctcatgacagtgagttctcatcacggtcatttaaaagtatgtagcaccttcccactctct

SEQ ID NO: 520900 - DNA, 289 bp, Homo sapiens
  misc_feature (79)..(79): n is a, c, g, or t
  misc_feature (275)..(275): n is a, c, g, or t
ctgtaacttgcggctgaatgcgtccaagccatgagttgtcccccaagctcgtgagttgtccccagctcaattctgcctnttttggagagtgacgtcccacacacctgtgcaaccttgcatgccaaaaggactttgcagacatgactgaggaccttgcatgcgggaggtgatccccacgacacctgtggacccagtgtcatcagggtccttgtaagtgaaagaggcaagaggaccccagaagaggaggtgtgatgacagaagtggaggtcggagtnacatggagacggga

SEQ ID NO: 520901 - DNA, 377 bp, Homo sapiens
  misc_feature (244)..(244): n is a, c, g, or t
ccattgtgatagtgtgaaagtatgtagtagtttgatttgcatctctctaataattaagtgatggtgaacctcttttcatgtacttgctgggccatctttatgttcctccttgggggatatgtttattccagtcctttgccaatttttaaattgggttttgtcattgttgattgatcgatttttggagacagatttcggtccttgttgccaggagtgccatggcatgatctcggctcactgcaanctctgcctccctggttcaagggattctcctgcctcagaatcccaagtagctgggaatataggcatgcaccaccataccaggctaatttttgtattattagtagagacaggtttcaccacaatggcacgtggat

SEQ ID NO: 520902 - DNA, 304 bp, Homo sapiens
  misc_feature (12)..(13): n is a, c, g, or t
  misc_feature (25)..(25): n is a, c, g, or t
caggcgtggtgnngggcgcctgcantcccagctacctgggaagccgaggcaggagaatctgcgtgaactcgcggaagcagaggctgcactaagccgaaatcacgccactgcactccaatcctggtcgatcactgtcgaccacgttggtccgaccagtcttgacagaggtcactgatatatcttcaattggaccattttgacactctatcttattcattttctcagtgtctgtaaagccaggtgaggaagtgatcccaataatgatgtacaatttgaatcaatatctatttgacatcagtggatc

SEQ ID NO: 520903 - DNA, 492 bp, Homo sapiens
cctctccccaacactatgatacaggaaaccaggaaacgtgaatattttctcccacgatcgattagactgggatgaacacagttctgccggcagatatgtttcaagaccctgtaaacctctgaaggaatttatgctttctcaagatgttgaacatgagggtctctttggcctccttcagaaaatggtggaggatgatcccgcccaaaaaatttctctcaaagaaacccttaaggctcccttttttggcccttttaaagaaaaggaataagattgggaatggggcaggcctcccgaaaaagattttccagactggatcagtctaatttttaaattttaaggtattttggacagctttgtaaatttttaacatttttataatgccatgtttattttgtttggggaatttgggtccttaaggacatagctaagggaatgaacatctttttcaggaattgtaaagtgatttattcagaataaattttttggggttat

SEQ ID NO: 520904 - DNA, 187 bp, Homo sapiens
  misc_feature (157)..(157): n is a, c, g, or t
  misc_feature (160)..(160): n is a, c, g, or t
gtcaccaggctggagtgcagtggtgtgaacgtggctcactgtcgtcactgcagccttgatatctcaggcccgggtgatcctcccgactcgaccacctgagtagctgtgccaccacacccggctaatttttgtattttttgtggagatggggtttcgnctngttgcccaggctgatcacaaactcctg

SEQ ID NO: 520905 - DNA, 889 bp, Homo sapiens
  misc_feature (3)..(4): n is a, c, g, or t
tgnncccagagctgcgacgaggggggggatagattaccgtggagggggatgctacgcgtgtcctgttgtggctgctgttgcacgcccgcgtgtgtaattcgactgtgcacgttattggccgccgttctctgggcccgaggcgccccattgtgcgtggaaagaccggtgtggcggttggtggacagttacacgtggcttttgggcccccaatcggtttgacgtatgggtccgcgcctgtctggtggcgtctggaaatgtgaacccaggggttcctggtgtgaggttgaagaccggcggccgtggtttgggggcatgcggggaggtggaaaatatatctttgtacgagggggcatcttaaagtctttgtgacccttcttgggccagaactgtgtttgtgccccccgcaacgcccccctgttgtgttcgcgggaacatacatgtggccgctagttggacagcaacacttgggggcccgctttgccccggggggcccaatggcggtcccgctgagatctatacaggcctcttttgtgggaacaggggggtgtgagggttgagcaaatcattttagccccgttcacttggcataacccagtgtggtatctatacttggctataatggcgcacaaacaccccctggccaaaccgcaaagtcctctgttcaaaagataacaagaaaaggcaccccaaattttcccccattacaccctggtttcgcatatttgggggcaggttcatcaggcaacccgacactcgtgcccctcgggaaccccaacacagttacagtctgaaagaactcctctggctgtgtccctcctcgcccagattctttcttttgacttttaatttttttccccacaaaaactccccttggaataagcccaacaaa

SEQ ID NO: 520906 - DNA, 401 bp, Homo sapiens
agttgccaaatacttccagtcagctgatctttgacaagcaacaaaaacataaagtggggaaaggacacccttttcaaaaaatggtgctgggataattggctagccacatgtaggagaatgaaactggatccttatctctcatcttatacaaaaatcaactcaagatggattaagagcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcaca

SEQ ID NO: 520907 - DNA, 325 bp, Homo sapiens
cagtactgatgacaggtgatagatcaaaatcattgccacatttgttaccattttgccattcctaaaccatccttcaacgaaactcatatatggggtcacaacatcctcacggtagtccaatagagcactcatgccatctggattcatgtttccaccaatcaagaactggtagttaaagacatgagcaaggatgtgcttgatttagttctgcaagcccctgtacataaaaggtataactctttactaggtctctgttcttcaagtttcccttagattgatttcatgtaatcttcgatgtacttcttgtaggctacttttcatataa

SEQ ID NO: 520908 - DNA, 396 bp, Homo sapiens
atcgcttataccaggcagacactcaccgcttagtatagatgctctcatggtacctgcaggtctgagccatgcaaaaccttccattgttgaggatgtgcatgagaacttgaagcaatcccaactacaccagcacgttctacgatggcacccgtactccatcaaagaacacctctgctgtgtttgaagccttgatgcccatcttcttctcagggggcccacctgtgtccaggcagtgtgggaaagcagaggtgtgttcaacacggttgtcactgggggacaaacttgctccttcgctccttatgcaccagggaggaatgacgaccactagactattagaggctacagacaccactttaccctcaggcccctgagggctaaggaggcctggctatgttc

SEQ ID NO: 520909 - DNA, 169 bp, Homo sapiens
cgctgtatctggccacgcctgtccattaacactgaatctgagactgcgtgatgcttataccggcgcacccgcgttaggcgtaaatcggagacgtaccagaaggtgcatcgacaaaggtgtgaccattcacacatccccggttacctatgaagccatgggccgccgagtc

SEQ ID NO: 520910 - DNA, 245 bp, Homo sapiens
aaaaaaaacctttaaaaaacccccccttaaaaccaaaacatctttgggttttgaacaaaggaattttcaaaatttgatgtgggattttgtttagaagttaaggaaattttccacccaaaaaacccccctgttttaggcccttctaattttaaggttgggggatggggggagggcaggggtttttttttttttttttaaagggggggggaacaaatggaaaaaaaccagggcctgtgaccctttta

SEQ ID NO: 520911 - DNA, 212 bp, Homo sapiens
cttgcaagaacatatgtgggttatggtcctcattaccatgttgcagcgggaggttcctaatgtcagtttgtccattataggtgatactgaggagtttttaaactaccacaacattgttctcataagtcctcttgtcttaggtagacagaggcaacatgggacacaaagcaaggggtaacctctgtggatactctttctcccttcctcccaga

SEQ ID NO: 520912 - DNA, 149 bp, Homo sapiens
tgagtatctagaggatccgtgtcatcccccttcgtgtatgtgatgtataatgtctagctgagtactcttatatgacgaattaatcccatgattgtgttattagaagtgcgaatgggcgaactcgggtcaatggaactcaggctccaaag

SEQ ID NO: 520913 - DNA, 140 bp, Homo sapiens
gataaagatgtcagaaatgccccacatgtgattaggtacatggatatagtggcagctcattctaatattatagcttgcaactccctactcctggatccctagactctccaatcctattattctcgtcaatactcagaagc

SEQ ID NO: 520914 - DNA, 897 bp, Homo sapiens
  misc_feature (207)..(207): n is a, c, g, or t
  misc_feature (209)..(209): n is a, c, g, or t
  misc_feature (219)..(219): n is a, c, g, or t
  misc_feature (231)..(231): n is a, c, g, or t
  misc_feature (233)..(233): n is a, c, g, or t
  misc_feature (243)..(243): n is a, c, g, or t
  misc_feature (245)..(245): n is a, c, g, or t
  misc_feature (250)..(250): n is a, c, g, or t
  misc_feature (261)..(261): n is a, c, g, or t
  misc_feature (278)..(278): n is a, c, g, or t
  misc_feature (302)..(302): n is a, c, g, or t
  misc_feature (304)..(305): n is a, c, g, or t
  misc_feature (331)..(331): n is a, c, g, or t
  misc_feature (337)..(338): n is a, c, g, or t
  misc_feature (355)..(355): n is a, c, g, or t
  misc_feature (382)..(382): n is a, c, g, or t
  misc_feature (386)..(386): n is a, c, g, or t
  misc_feature (390)..(391): n is a, c, g, or t
  misc_feature (395)..(395): n is a, c, g, or t
  misc_feature (397)..(397): n is a, c, g, or t
  misc_feature (419)..(419): n is a, c, g, or t
  misc_feature (442)..(442): n is a, c, g, or t
  misc_feature (446)..(446): n is a, c, g, or t
  misc_feature (451)..(451): n is a, c, g, or t
  misc_feature (454)..(454): n is a, c, g, or t
cacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaaagtcctcttaaggccagtaatttatctgaaaaggtatntnatcacacctntgacaccttatntntgagcctatnangagcngcaggtggttncatagggtaaaatccangaaaagagaaggatgtgtggggtncnnatagaagataatttggtcctcatttnaccttnncttttatgatccttctntgctagaacaggttaattctccaaatnggtnggtnnggtnangtacatataagggaactctttngcaaaagcaagggtcggatgtanatancattnaangtatagtggcacttaacttccccgggactggtgccaatctggactaattggtcaatggcttagagtttcccaattaccactggtgtactaaatgctatgatgtaagtctgctacagtttttcaggcccatttagaacttaagaacaaccattttaacattaatggatgggttactatgagcaacttcgctttcagaaaccccctggtttaagctctattgacaacgcttatgcgcattatgaggtcgagcaactatgagacactctgtatcagcgcactctttaaaacacgcttggctgtacttgtgaagatttagcaaacaaccttgagatttttaacggtaacctttttacacaggtttaagattaagttatcaccagtggttccagagcctctgtacattaatccctttggtacccagttggtccactctaccagtcccc

SEQ ID NO: 520915 - DNA, 1227 bp, Homo sapiens
ggtgcgcgtcgttggtccgtgtgtggttggtggtgttggtgtggaattgtctttcctgtggtagtgatgataggtagaagtaatgaatgaagaaaactaagagcgaagacgaaacaaaaaaaaaaaagacagcagcacgaacggtgcatgtaccgtatgatgtagcctgcgtaagtgctactgttgtgacaatgcgtctgtggataagcagtagaagtgtctgtcgcactatggtgttggggacctcctctcctatgggtggccgcgcgcgcacctgttggtggggcatcgataataattggtcgccggagagccgcctccttattgatgaacatttttggcccacggagtgtgtgttcccccccggaacgaggtcgggggggggggcggcgccttttctcctccgctgattattatctgccggatataattgggtgggttctgcccctcttgtgtgggcgcgcccccttataatgttgccgcgcttgttttccaaagcggcgcctccccctcttggtgtgaatgactccatggggggggttgcccccgccccccccgtgtgggtgttagaggggacttatccttggcggcggtccaaagcgctggttggggacgccgcccttttgctgggctcaccctctcaagattggtcggtggacgaacgcggggctgctcgccgaatggatgaagagagtttctttgccgacgcgggttgtccttgatatcgcttccgccgacatgcttctccgcctagggtggtgcaagaattagtctatggggctccacccctgccccctccccgcccgatatacacatggccgcggtagaattttcttgaaccattgaagaaatttttggagtagagaacgtgaccacagcctaatttcccaaatctgggtgaaatttgtccccccttcgagccccgcgccccactttttttgggataaattttgttttgatgatacacacgagggaacactcatacatgtcttttgtaggaagacacatcttgataagtatgggggttctttattctactaacaccagtgatgaggggcagcgccatacatgtaccccccacgttgtttgcagccgccgcaagcaatggagttagattctgtggaggactcgcgaaatagaagatcgaacatagacagtagtgcatgtggggccagaagaaaagcgagaagaggagataaagacagcccatcaataggacagagaata

SEQ ID NO: 520916 - DNA, 775 bp, Homo sapiens
  misc_feature (125)..(125): n is a, c, g, or t
  misc_feature (270)..(270): n is a, c, g, or t
  misc_feature (583)..(583): n is a, c, g, or t
  misc_feature (650)..(650): n is a, c, g, or t
  misc_feature (684)..(684): n is a, c, g, or t
  misc_feature (757)..(757): n is a, c, g, or t
  misc_feature (763)..(763): n is a, c, g, or t
gcccgtctgttccccttcgggtccgaagcttttggctcctccttgttccgagcccgaaggcccgacccttcacgtactcggagctcggatcccagtgtgtcagctggactcgaatcccgttgccngatcgctgctctcggcttctgctccgtggtgcttcttccctgccctgccctggggccctgaccagtggcttcttcccccgtgccttgatctgcgcagccctgtgcggtgtcgcccaagaagtgatgcatggctggcgcgtggggngcgcgctgggcgggggagtgcgtggcctggagctgcggcggcaagcgggcgtgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgcnctggctctggcctggactttctcctatctcctgttcttccgagccctcagctcctgggcctgcccantcccacgcccttcagcaatgccgtccagctgctngctgacgctgaagctggtgagcctggcagtgaagtccaggacctgcatctggcccagaggaaggaaatggctncaggcntcagcaaggggg

SEQ ID NO: 520917 - DNA, 696 bp, Homo sapiens
  misc_feature (125)..(125): n is a, c, g, or t
  misc_feature (270)..(270): n is a, c, g, or t
  misc_feature (504)..(504): n is a, c, g, or t
  misc_feature (571)..(571): n is a, c, g, or t
  misc_feature (605)..(605): n is a, c, g, or t
  misc_feature (678)..(678): n is a, c, g, or t
  misc_feature (684)..(684): n is a, c, g, or t
gcccgtctgttccccttcgggtccgaagcttttggctcctccttgttccgagcccgaaggcccgacccttcacgtactcggagctcggatcccagtgtgtcagctggactcgaatcccgttgccngatcgctgctctcggcttctgctccgtggtgcttcttccctgccctgccctggggccctgaccagtggcttcttcccccgtgccttgatctgcgcagccctgtgcggtgtcgcccaagaagtgatgcatggctggcgcgtggggngcgcgctgggcgggggagtgcgtggcctggagctgcggcggcaagcgggcgtgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctcctgccacgcnctggctctggcctggactttctcctatctcctgttcttccgagccctcagctcctgggcctgcccantcccacgcccttcagcaatgccgtccagctgctngctgacgctgaagctggtgagcctggcagtgaagtccaggacctgcatctggcccagaggaaggaaatggctncaggcntcagcaaggggg

SEQ ID NO: 520918 - DNA, 230 bp, Homo sapiens
tgtttctatgcctcgcatctcagttgttttctttatccatcccagtgatgccttatttgaaagtgggcttaaactgaaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttag

SEQ ID NO: 520919 - DNA, 578 bp, Homo sapiens
ctcggtacccatgccaataacctccctcagcctcccgagtagctgggactacaggcacccgccaccgtgcccggctaattttttgtatttttagtagagacggggtttcaccgtgttagccaggatggtcttgatctcctgaactcgtgatctgcctgccttggcctccccaagtgctgggattacaggcgtggcctattcatcattattttcaatacgggagaatggtcctgaactgctctggctggggaagatgttctggcttctatgttccagcctctaaggatatagtcacatgtctctgtggtaagggcacagcctttggagcctcaaccagggcatgctttgtctcctaatcacagaagcacagccacctctgcccaggtgtcatctgttgtcctgcccttcccaggctactcaaggacttggtcatgtgctctctattctagcaccatgctgaagagttctgttcaattcagaaaacacattgtcatccatccatccatccacccattcacccacccatccagttatccactaacccacccaggaggttattggcatgggatactctagag

SEQ ID NO: 520920 - DNA, 357 bp, Homo sapiens
attggagccagaagtgactagcccggtcatttcatgacatcttgggtcatgctcgcaatgctatacacttcatcaggactgctcttcgttatcactgattctgcactgggattgcataacttctggacggatcaggggtctaatgatctggtttcacatggacgtgatccatgtcgtcggttacatcgtctgtcgcgttctcaccattatgtagccaggacgtcaatggaggcgattgatacagagcgtagtatatagtggagagtgaataagtctcatgagatcggccgggattaccatgaagccctgcgtgtgcgtcatcgtagtttgctcatgtatgaccccagtaaaaagtgc

SEQ ID NO: 520921 - DNA, 407 bp, Homo sapiens
acatccaaccagcgaagcagagcaatccttctggaagcttctctccacggggggctggctgctccttcatcactcccatctgagggcttctgcttgcagccgtctgtcacgctgagcagctctgtggtggattctgtgctgcttgctctgtgtctattttgtcaagatcgccactctctctggattctctcctctgggttggcccacgctcactcatccggctttggaaggacatttgtcctctagcttcctccaggagggggatttgtcttagagagtggcactttctcttccctccccagcccctcgtgcaccttctgcagggaggggagtcccctggtgctgagaggagaggtaggagagccaggtagggcctgtgggagccctagcagaggtgccctggccac

SEQ ID NO: 520922 - DNA, 822 bp, Homo sapiens
  misc_feature (347)..(347): n is a, c, g, or t
gtgactccgggctgaaatttgccacaggctagctgatcttttacttcccccaccagagaagttagttctcatccgtcccggtccctgctgccactatgtactggttctcttggagttcaagtgttctctgtggtccattacatggccaggttttctgtaggtggaaatccctcagctgagaccaactcatgcgggagcttggggaactgagtctgctggccacagctgccgcctttgtgcttccaaccgtctgtcgtgccaatgtgctttgcaggcactcctcaggcgaatgcaccctggcaggggcagcagctggatgcaattcctacaagctagctgtggacaanagtggtaggctgggcctgggtctctgaggccctcgtcgtgagtcagcgccttcatctcattcttctctggtgtaatcataaggcccttatgtgctacagataccgatcgcgtactcagtcgtccgtgcgcttacagcaccggcgtcatggtgccgtccgtgagtgacccgagaattaggtccacgtcaggcagctgatggctttctctctgctcatgtctgactgcactgatgtgctgactcgtgctgggcatgctgaagtgctggtatcatgttccgccaggggttctgcacagatatgtgcctgcttctggtccagggcttccatgcgggtccccaggaatgtgaaagccaaactagcttgaagggtctttctcatgttcttagcaggctgccaggctgtactcttgccagagctggccacgcttctttccttgctggtgggggcctggtctggcctgtcttgtgtggtgccg

SEQ ID NO: 520923 - DNA, 619 bp, Homo sapiens
atgccagatgtggaggaggaggcataggggggctgcaggtgcctgggaagtgcttcttactgaggaacttggtgagctcccaggaagcatgggggccacctgagaaaggggacgggggaggagtgccaagcgggaagtgggctgtgtgtcaccactggccaggaacagctcccgtgggaactgtggtagatgactggaactttacaattgatttactccttcttttcgtcattcacaagtagtcattaagcacttccgtgatctaggtcctgggaatacagcagtgatcccaacagacaaagccttgtcctcacagagcttaccttctagaacgaacaaagaaacacataaacacacaaaatgtcagatggtgggatgtgctacggggaaataaagcaagcattccctaccctacacttccttgtaagaggtaagagtgggttgctagtttgtatcaggtgttcagggaaggccttactgacatttgacctaaaagaaaggtaagaatgtgacacctgatgataaatagggaaagagtatttcaggcaggaggaatggcagtgcaaaggccctgaggtagacgtgtacctgacatggtcaaaaaaaagcattgcggccg

SEQ ID NO: 520924 - DNA, 736 bp, Homo sapiens
  misc_feature (69)..(69): n is a, c, g, or t
  misc_feature (71)..(71): n is a, c, g, or t
  misc_feature (73)..(76): n is a, c, g, or t
  misc_feature (80)..(80): n is a, c, g, or t
  misc_feature (82)..(82): n is a, c, g, or t
  misc_feature (84)..(86): n is a, c, g, or t
taagtaacgggtcggtaagggcttatctctagaaggtccccgcagatgaagtgagggccaggggcctgngnannnncagngntnnnctgtgaggcagtgctggccgcgccagggcatcagtgctgatgtgggagctgtgcttccacctaagccgttggtaggggactgtggcatttaagaatgtagagagcgcatccttttggatctccggggcggagtgaacctgcaggggccaccccagaaacctgtggtcctgatgcacttgtgcatgcaatgtaaccagcttctcactccagtttcaagtgggctacttactgtaacttatatacatttcaaagccacttggtgacatagaacctacatgacaaccatacacttggtgggcccacggacaggttaccagaagtggtaccaggatgtggtttggaccccgggtgagctgatggccccggcccggctctgggcacatttcggtccgggtccccagcactccggtcggagagagtccaccatcttcagctccggggggacactctcccgggtacccctgactcacgcacagggacttttaccgaagtttactgttcctctgcgaccagaaatggctgtagggggttttttccccccatctttgggctagagcggcgatggatacacgttcctggctctctcacctcaataacgagggccctctctggttcccttcccaaaaatccgccctttcgacaacatcgtg

SEQ ID NO: 520925 - DNA, 931 bp, Homo sapiens
agcggcgcgcgggcgcgccgcctcccccggtgggagcggtggttgggccaggctgcggcagagcgtacgctcggagatggcggagcagccgcgaacgcggcccgtggccccagaaagcagggaagccgtggcagcaccccgagaaacagcggcggagccccagggggacaagcgagggacgccaggccgaggtcctccgggctatgaagcctaaaatgcaggcggctaagaaaacggcggcgctcttggcgaaccctgtggacctacggggcccttgacggttcggaattgccccgaaggccacttcacagaaccacatagctcgcattcacctggttcgctggattcccttggggagccacaagggctaacaacgcgtgcaacacgcaacgcactgtgccgacacccatctcagcgtggggaccccttatggcaaaacctgaccagcaacaaggccaagccactccaaccgcgccacagcggaggacaccccacacggggcgagcaagcagaaaccccccctctgcggcacaaacaccaaacttcgtggcccacggccccactgggaaagcgacaccacaccagagcaccaacacaaccggaacatgccacaatatgagcgaccgcgaacaccagcgtggaccgcacgaaagcgatctggatggaacacaatatacaatgacgataccattagagacagtgagggacacacccacccatctgtgcactatactcaccgccagccgatacacccattcaccgcagattccaccgacgctactaactcacccaattgctgcccccataaccgcatggaggacagtgaaaactatatccggtgcgagtccgatgccacctgaaccacctgttagaccgactaaaatcagaagtcgcggacaaccagccatctagccacacagccctaagacag

SEQ ID NO: 520926 - DNA, 1668 bp, Homo sapiens
  misc_feature (1319)..(1319): n is a, c, g, or t
cagacacccaggacttatttaaactctgtgcaagtgcaataaatctgacccagtgcccccactgaaaaaaaaaaaaaaaaaaagagaaaggagacagcaaaaaaaaaaatcacacaacaaaagaagagcccaaagaataaacagagcagaaccacaagaataaacattagaaacaaaaagatagacacacacataataagaagaggatcagcatacataagagctaagcgcacaggagccggccgtacaccacgggcagggctcgatgaacatggggaaaaaccccggcacgagccctgggcacacatcatagaggagggaaagggaacaacctatatcacaaccatgaggcgaagtatgacccagctacaaccgggcacagaacacaatacgctatacacagcagcaccttgaaaaggcacgcacaaacaggagataaaagctacctcacaacaccatccctcacaaacagcaccagataatagaccgcgagcgctaaccaccacagacagccctagacaatacgagagaaaagggcccgcgcacagcgacacacaacacatacaggcacaaccaccacgaaaccacacatagcaacaccacaaccagacacacacaccgactatcacaatacccaacccacgggaacccacagaatggagagacaataacgagagagacacaacaacgcagcgacaagatgaagaacacaccaaaaacaggagacggacatccagcaacgaacagaaccaaagcaacgcagaaacacaacgaggagacgatgaagcagaagagagacaacagacagagagaaataagagagcaacagaacagagagaaacgaacgaaagagaagcaaagaaagagccaagaagaaaaaaaaagaaaagagaaacgacaagaaaaaagacgaaaagaaacaaaaaagaacaacaaagagaacgagaaagagaacagaaagagaaaaaaaaagaagcaagaagaaagaagcaacccgcgcaaagaccaacggacagaacgaaggacaggaagagcgacagagagcaaaggaaagcggaacacaaagcaaagaaaagacgaaaacaagaacgaaaaacagagaaaacagaaagaagaaaaaaacggagagaagaagagaaaaacgaggcaagagacggagaggaagagaaaggcaaacaagagagaaagagaagaaaagaagaagagagcaggagaaagagaaacagaagaaacaaagaaacaagaaagcagaaagcaaaaggagaggcaaaaaagaagcagaggagaataagaacaaagaagaaaaggagagcagacgnaaatataacagcagaaagagacgaggagaaagagaaagagaagatgagagcagagagacagacagagacgaggaagaaaaaaagaacagagagaacagagaagacaagacacatacaagaagaacagagaaccagagaggaagaaaacacaaaagagagacagagaacacacaacaaaacaaaagtacaggacagaaacagagacacaacgagagagagcgagacgcaagcgaagagagacgacaagacatggagcagaagaacgaaagcagaacgaaggcaaagagagcacgcgaaggacacgaggcagcagcgaagagacacaacgagagaagcgcaatgagaagac

SEQ ID NO: 520927 - DNA, 845 bp, Homo sapiens
  misc_feature (9)..(9): n is a, c, g, or t
  misc_feature (75)..(75): n is a, c, g, or t
  misc_feature (95)..(95): n is a, c, g, or t
  misc_feature (132)..(132): n is a, c, g, or t
  misc_feature (135)..(136): n is a, c, g, or t
  misc_feature (185)..(185): n is a, c, g, or t
  misc_feature (189)..(190): n is a, c, g, or t
  misc_feature (192)..(192): n is a, c, g, or t
  misc_feature (196)..(197): n is a, c, g, or t
  misc_feature (212)..(213): n is a, c, g, or t
  misc_feature (238)..(239): n is a, c, g, or t
  misc_feature (245)..(246): n is a, c, g, or t
  misc_feature (248)..(250): n is a, c, g, or t
  misc_feature (257)..(257): n is a, c, g, or t
  misc_feature (259)..(259): n is a, c, g, or t
  misc_feature (281)..(281): n is a, c, g, or t
  misc_feature (286)..(286): n is a, c, g, or t
  misc_feature (291)..(291): n is a, c, g, or t
  misc_feature (315)..(315): n is a, c, g, or t
  misc_feature (349)..(349): n is a, c, g, or t
  misc_feature (356)..(356): n is a, c, g, or t
  misc_feature (374)..(374): n is a, c, g, or t
  misc_feature (387)..(387): n is a, c, g, or t
  misc_feature (404)..(404): n is a, c, g, or t
  misc_feature (411)..(411): n is a, c, g, or t
  misc_feature (418)..(418): n is a, c, g, or t
  misc_feature (420)..(420): n is a, c, g, or t
  misc_feature (426)..(426): n is a, c, g, or t
  misc_feature (431)..(431): n is a, c, g, or t
  misc_feature (440)..(440): n is a, c, g, or t
  misc_feature (454)..(454): n is a, c, g, or t
  misc_feature (486)..(486): n is a, c, g, or t
  misc_feature (502)..(502): n is a, c, g, or t
  misc_feature (653)..(653): n is a, c, g, or t
  misc_feature (742)..(742): n is a, c, g, or t
  misc_feature (780)..(780): n is a, c, g, or t
  misc_feature (844)..(844): n is a, c, g, or t
tcctttganatctgaagaaatcatttcctcctttcttgccatctccataagaacacctctggaagtatgctatgntcaacttatactcacacatntagatttgctcataggttgaacagtgaagtttaagtnaannccattgcaaagactgttcctttcatcacagaaaaaaagaaggtgagggngagnngntatnnggggactggcgaatnntgggccaagggtacatgctcccttnnttgttnntnnntgggagngnttgctccatgggctttttttgnttttnttgtnagggggagatttagggggggattnaaggggtgactgagccttgggcctcttccatggntacaggnatattgttcctgcaggtnctatccagatttnagctctagatgtaactnaaaaaanctgaaantntgaggnaaggnatctaaggnttatagtgcttgantactgatggggaacaactgcagcgaacagcancagggaagctggaggntgctcagtaggtgaatcgcatcttttgtgagtagcccagtttgtccaagttgggatggcaggccagctgcaccattgggggtggcccacaaagcagtaccagcacatcatcccctggagcgggcaggtgttcccggatcatgtcggcagtnacaaagcccttgctgtaggcccaatcttttggggggatgatccagagtgaaccagagcttaaagcgattgggatagcgggcctgcagtncctctaagttctcccgcaagatgatatccttttctgtntggttggcaaaagcagaaagcactgggttggatcttcagggactttcaggatggcccggatcanc

SEQ ID NO: 520928 - DNA, 278 bp, Homo sapiens
ctatgttagaagtttcaatagcatctatagatatgctaacggaaatgtagttactaaaaaatccatcagtgacttagccgaattgcaagaagagtacgaaaactatcgcaaagcagctatagaacgcgagcaaaaagtgcgtcgccagttgcaggacgaaataaataaacaccgttaaaccaatgcgtattgatattatatcggtagtccctgaactgatggagagcccctttgcctactccattatgaaacgtgctattgaaacttctaaaactagg

SEQ ID NO: 520929 - DNA, 1187 bp, Homo sapiens
ggtcagggtttgagatcagcctgaactttacatggtgaaaccctatctctactaaaaatatagaattagccaggcatggtagcgcacgcctgtaatcccatcttcttgggaggctgaggcaggagaatcgctagaaactgggaggtggaggttgcagtagccgagatcgcgccactgcattccagcctgggcaacaaaagcgaaactctgtctcaaaaaagaaaaaaaagaaaaaaaagcacgtgaccttatgaggctctcgctgtacttgttattttaaggactataaagagtttgatttaaaattatgcagggcccctatgtgggatttattaaaaagcaaactggtgtgtattctcatgtggtttgcacagcccagcctcacagcactattgtaaaccctgcatcttactgtctcgctagacagatttatcacgtatcatgtatacttattttctggtatgtaacaaaagtaaagaagtagtagtatgtctttacagctgaaaccaaccagcaagcccttgatgaccaagaggcgtatacttctcaaagctatagggcacaaacaattgacccatacattgactcacgttgcaatacttctgcagcactaattacattcagaggaaccaggacttctccgcaaactaagcaaacttaccctaccggagtgatatactctttgacggggacgtagcatgaaccccttcagcttgcttagaatcaagaaaaacgcctaaatgacataaccattacatatgcactcactgggcctacaacaacgacctgatatattaaagtgcttcagaccaaaccaacgaaaaacccacaaaaaaatatgacgtctttgttatataaacaaaaacaacccccatctctgaaacacttgtgaacattcttaatcacaaaaaacaaaataaccttattcaaaaacatctaccatatttgagaatccacaaaccatcacaaaactgactcagttcatcaattcccgatccaggccaccaataacctcccccactctactccatgccaccatcagacaactcatcataaagacaacacttagcaacaatcataaaagatctaaatcgataacctttataagtaagacaaacacacaaagcataaatatatcagatacgatataaaccaaacaaccaatcaaatcaaacaattaataatac

SEQ ID NO: 520930 - DNA, 301 bp, Homo sapiens
  misc_feature (9)..(9): n is a, c, g, or t
attcgcggncgcgtcgacctgtaatcccagtactttgggaggccgaggtgtgcggatcacttgagctcaggatttcgagaccgagcctggccaacatggggaaagcgtgtcctacgagagatgggccgggtgtggtgtcatgcctcgggaggctgatgcaggagaatggcgtgaacccgggagccggtgatcccagggaggctgaagcaggagaattgcttgaacccagaagttgaggttgcagctgagattgcaccattgcactccaccctaggggacagagtgagtaagactccatctc

SEQ ID NO: 520931 - DNA, 220 bp, Homo sapiens
  misc_feature (177)..(177): n is a, c, g, or t
  misc_feature (200)..(200): n is a, c, g, or t
ataaataaagctctacaaccagtggccgggctcagtggctcacacctgtcatcctagcacttccggagctgaggcaggtggatcacctgaggtcacaagttcgagaccagcatgacaaacatggcaaaaccccgtgtctactaaaaatacaaaaattagccagggcgtcatggcggngcacctgtgggtcttacaggctnaagcagggagaatcacttga

SEQ ID NO: 520932 - DNA, 1215 bp, Homo sapiens
  misc_feature (801)..(801): n is a, c, g, or t
aagtcgatgcctgaatgtatcacaggttttagttagaatgtctggcttctactcacacaagatatgtcgttgcggatcacaaatagtgtggcttgccaacgaatattccgcacaacaagggcgtgtaaagagacaaataatttcttgctcgctctgaggggtgaaatatttgttaccgcacggtatctcaccaccgcctgatgtgtgtcgcctctttgtgtgggagacccacccccaaaaagattgtgggtcgacaacgataactgttgtgttaaggagcagtccttctcttgcccagaagtaaccgcccgtggtatgccacattttttcagagccgcacaatacccgcttgtaatacacagtgttttgacccccacgtgtggtggtacccaataaaaagatcagtgtaacccagttaacgtattaaataatataagttggctttcctttctttcccccacgcgcctgcttgttttgtgcacggttgacaccgcgagttatgtaatgtttgggcggggtagaatgttgcccctgttcgctcactgaaacacttttaagggactcttcccctcgtagtttcccccctttcacgagcggccaccttttgtgagcacccgcaggaccactttgcactctttctgtggaagatagaacaacctcgtgggtgtaaaaaaacaaagggctgtatggaacctatacttggggcttacaatgttcaccaccaaatggggttataaaccacattttataggttcacccacgattctagaaatatacgaggtcccaacaccacaaaataancccgcgttcaatataacaacacccttgtcttttgtattaaccccgcttttccacctcaaagaaactgtgccacacaaaccccccccataatcccagagtcgccactgtaacgtcgaacctttttcccttatggcgcattcctgcaaactgctaacgcgttctcacaccggcgacaactgaacacgtgtttaaccagaataccactggccaacattcacgggagttatttctccaataatgcgtcctcaaaaaggcggagaggcactgtgaaaaatacacccccctgtgtagcaaatcatcacaaaaataaccctttaaatgggcgcacccacaaccctcggggcttctttgtcctatggaggatgaacccttttttattcccttaattttttaaaaaacttgctttaaatttta

SEQ ID NO: 520933 - DNA, 535 bp, Homo sapiens
  misc_feature (516)..(516): n is a, c, g, or t
gtttgctctttctgaagacagctcatcaacttcatcctgaatctcctcgagccactgcatgcacattgtatagcaggagagagactgattcatgcgctcataaatcacacggaggtttgtcataacttgttaccgtatttaaacggctttcttgggatccactatgcgcacatgctcgaaatgctttagggtgtgctgtctgtccttctgttctgcgcggacatacttctttagcatattgaacacgtgacgaggccgaggaggaacagcctgcagagcggtgatgtagttctccagggccaggcggcggcggtcattgagcatggcttccactctggccatgtgtgtctccaccagctgctgtctctcgttggctgcttcctgttccaaagattccactttctcctggaaatgctggataactgccttcttatcagctttaggcaagttctttgcttgacgttctgcctcttcccattctctcatgacctgggacattctctctcggtgcttggncttgccatatgcaacggga

SEQ ID NO: 520934 - DNA, 215 bp, Homo sapiens
gccccccaagctgtcctcaaaagcaaggcaaatatatactgacttcataggaaagggcagcttccaaagagataaacataggattttcaaaccaaaaactttgatttccccagcattataaaagaggcttacaagtggcttcttttaaacttcccagggaagggttttcacgctttgatgggggaaaacacctctatttctctttttctctgtga

SEQ ID NO: 520935 - DNA, 559 bp, Homo sapiens
  misc_feature (3)..(3): n is a, c, g, or t
acngtgcaaacgccccagtcacgacgtctgaaaacgaaccacattccacattttatggcttccaccagctagcccaggaaatacgtgaaattttcattccaattagtgttgagcctctcgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacacgagtgttgacagtttgaggagtcgaattgagattcatcatcaaagagcaatgcagcgtcgttaaaataaaaactgtgcctttta

SEQ ID NO: 520936 - DNA, 180 bp, Homo sapiens
gcgcgttgtggcaggaacctgtaatcacagctactcggagatgctgaggcagtgagaatcacatgaagccaggagtgcagaggttgccgtgagccgagattgagccattgcactccagcctgggagacaagagcgagacttcatctcaaaaaaaaaccacagtacacagcatataagact

SEQ ID NO: 520937 - DNA, 175 bp, Homo sapiens
ccacgcgcttatggactttgctttgcccctggaggtagctcctgggtgaatgggggccaatcaggagtgtccggggggttgacccgctgcgatgtgcgacggtcctacaggaaacccccaacaaaattagttacagaggttgtccagagaagcgcatgtaagcagtggctcactc

SEQ ID NO: 520938 - DNA, 273 bp, Homo sapiens
tcccgtctatattaagtgacaacggatctgctgatcccctcagagtagacttcaagcttggcgaaacctcttattggcacaggcataccttgttcacttgacagggtgaagctgtaatttttcacaaaacagtacaagctggtttctcctaaactattttccttgtggtagtagggatccgtgggtcagaaacaactcctgtacactatgggttccttttgagccgcgtcattcggcggcatttctgtacaactagcacaggtctcccgctgt

SEQ ID NO: 520939 - DNA, 97 bp, Homo sapiens
ggatttgctggtgcagtacaactaggcttaatagggctcgaattcgaggcaatcagtgttaccaaaataaagaatttatgagtcattgcccaaaaaa

SEQ ID NO: 520940 - DNA, 216 bp, Homo sapiens
  misc_feature (13)..(13): n is a, c, g, or t
tgaacatcgtgtncatagggaaaccccatctctacaaaaaaaaaaaaaaaagtacaaaatttacccagcaggtggtggccacttgcttgtaattctcagtctactcaggaggctagggcaggaaattggtttaaccccaggaggcgaatttggcagggagttgacttcgcttcattgcacccagccggggttacagagcaaatactctcattctcg

SEQ ID NO: 520941 - DNA, 1059 bp, Homo sapiens
  misc_feature (1059)..(1059): n is a, c, g, or t
agcgggctcctcctgcacacctccctcgactctcccacagccacgtggcacccaggccccggacacccgttctgttgcacgcgagaaatggatacgtcatcacacgctgtggattgggtactgtggcccatgctggtggggtgctggtggcgaccttggcaggcaggcatctcggaggcctggagagttctccgtcgcagcgccaatcttccagcaggatcatatgattcctgggagtcgccttgggttcagacagcggcgcctcgtacttcctgaagtcgaatgcatggcctccagagtgagaatgaatcggcggcagtgtgtccatggtgctaagtcctagtggtgtggacacctcttgtgcaccggagtattgggttggttcgtcaaatccaatgaacttcctacccttccatcagtgaggaaacgcgagttgtgaagactctcgaaactcgatgcgtgcttgctatgcgccagcgcgggatcactctcggtctctcatacacagcttgcgcgtgaggtcctggcatcgtgcgtggacatgcaccctatcctacctggtgtcaacgtggttggtgaagagcactgatcgtaacagaagcaatggttacagcagctgtcatcgtatctaggtccaagggccatgtgaaatggcgctcgcttgcgtcggcaggaccttttggcgacagttggtctcaacacatttctaacgacgtgcggaaaaaccgctagcaactctcgctcagaggggcgtgatgcttacaatggtaggacacattcccaacggacctatctggcgaagggccccgagaggtgctatcaacgggaatgaatcacctgataggttcttgccatgtccctaacacgcagaattgggatggtatagaacggagaagatagtagagaagtccgcgcaagggcctgatgtcctgggtcaatcctggtgcccaaggcaagagttgaccccgcaatgctggtgggtatggtctctgcatcttgttgcctttcccccgtaggcctcagttgtcgcttggttttcccccggctaaaatgttcccn

SEQ ID NO: 520942 - DNA, 1847 bp, Homo sapiens
gtatattcagaagatcctagacacatggagactagtaagcagtacttggtggatagcacgcgcagaatttggtggatctgaccagaaggagcatagagagttactggccatcgcgcacgagaatatctccctgaattgacctatctgggaatagtggtgacggcttcaactgctttaacacatagactatccagatctcctggtaatccaatattctgagagtcacgaatggacagtgcaggtcctatacgcctcatgtcataatggtatacgatgataccatcatagggtctactaaagcactgatattaggtcaaatcaagaacaatactatagacagacaaaaaccaagattgtcatctacatagcatatgtcataccaattttagtgtacatatgatggaccttactgataaggtatcacttcagtaagtaagttggtcagtatcatacacacaatcaatgtggtactcgtagctatcctaacacggttaccacacgggagatcggatatatgtgaacggcgaactcatgtaacagccgccgaggctctcagggaaatgaacgcttgtatctgttgccacatgccacacgctcgcggattcgctgtggacaatgggtgcggatttggagacccatgaacagcgcttgaacggacccaatggatagggtgaataatgtaggtggcacattccgattctccaaaatcgttcaattcacatagcgaacgggttccacggacgaaacctttttggatacattacccgcttattggatttcacttcacatatcggcgaatctaaggaattattccaactaaatatggtcaatttacatcctggaggggtcctggacttaagtttggaatccccttttcctagtgggtgagacacacatattgaaccaacgtcttaacttaccaaccaaggatcgacggtggacggggctctaccataccacacgcgcgttcccaaaacttcttctgcgttgcctttttatattcgtcgcccccttgtagtactaactattgtccctaccacacactactttagttcaagagggcccccttacttaacataatccgtccgtctgcacattcaactataatacctcaccaacaactatccaatggataaaaacgcgtatccttgacaatttacaggtgtacgaaccgtctttggtattatgaaacccaagcccgagtacggcggacttgttgcaaccgggacagagatgttacgaaaaaaagcaactctaacaaccgagagggcaagggacatcctatacacaacgcattgtgagtccatcgcctacctcagcataacccacggtaagtgaccccaatatcaccacacctcgcgtggaagaaccccaacaacaaaagttctgaccgcgacccaatccacccacacgcagacggctaaacacaagtcggccaaacaagcagacccactataatgacgaaacaacgacacagcagatacacaccaccaggcgtgaaaacacacacgtgcggtccaatattgtgctcagaatcccaagtcaacacacaagggactgataggcgcactccagcgcacagatcagttctctccatgccacaatctattatctctccaagcgtccagtcactgcaatgcgtctcccccatcactacgcttcgcactagccatcacccacttgcacatccccaacacagattacacacatcactcggtcacccaatcaccacctcttctccaacacatgagacggacatccttcctcaccacattcctcaactccctcaacgttgaactttccaactctcccctcagctcttattaagtcacattcatcacacgtcc

SEQ ID NO: 520943 - DNA, 149 bp, Homo sapiens
aacaatatgactaaccagtaccccagagctcttgtctctagctgcatatatatcaaaagatggcttagtcggccatcactggaaagagaggcccattggtcatgcaaactttatatgccccagtacaggtcgacgcggccgcgaattta

SEQ ID NO: 520944 - DNA, 225 bp, Homo sapiens
aatggcccagtcctctcccaagtcttgttattggcgtggctagcaagtgagttttgtctgctattttttattcgcttatcttattgttgtttagttgaatggtgagcctcgtatcatcttccccttatgtccttattgagatgttgagctttggctgctggagtgggtgagcaccagggttactgtaactgacttgagaccagttgaataaaagtgcacacctta

SEQ ID NO: 520945 - DNA, 315 bp, Homo sapiens
  misc_feature (120)..(120): n is a, c, g, or t
aggtttttggggtccccctttggggcccccccccctgtgttcccccaaaatttaaagaacccccctgggggtgggttgtttttttttgggccccgggccccccggctttttccccccttntgcctgggggggggggggatttgggtcctccccccccccccccccccccgtttttttttccattttcgggggggccgggggggcccgttcccccctttggcccccccctttcggccccggggttttcccgtcccgctttcccggcctttttttggggcccccctggggggttttttttttttttgggccttttta

SEQ ID NO: 520946 - DNA, 310 bp, Homo sapiens
tgtattgacggagctccccttttttttttttaataactcctaacaggttttgatggaaaagacatcgacttggggggttattggggaggaattgacagcgtacctttaagtagcagttttggggcccaggcccagccttgggagccacctcctccagttgcccgcagggagtttgggcccaggacagacatcactgccagcatgagcaggctgttgtctggcatctaactgatcatttcccatctggctggttggctccttagagccgcagtgctgagaacacatgtgtgctgtctgcgtacacacagaa

SEQ ID NO: 520947 - DNA, 282 bp, Homo sapiens
tccaagacaagtatgtcatatcaaaaggatagctacaaaatgtgttatttactacctctacttttaacatacttggtgcacttctaaacatctagaaagactagatgtttcaaataaggacttaagttggtccgctatatacacagtagggttgaataaactacacacatgtaacaatggttatatctgatagtgtcttctaattacgaacattctggtctagaacccttcattccttccaactcctctccaccaccaacctgatggcgtggggtaggaggt

SEQ ID NO: 520948 - DNA, 1627 bp, Homo sapiens
tatttgctggtattctgtcatgagcaaagtaggacgaatcgagtgtgtatctgacaagccttgatgcgtagaactgatatatgcctctcagcgtactctacgcgctatagatagggctatctgcatgagtagatagaaagcgtgccacgtgatcacacttataccagtgaacaaactagtgccaattaatactataaacacaaccgaagaagactatcagacttggcctatttcgtgagaagatgaaatgcgagccagtggcgtgtattattcatggtaagcaagttatcttggacagtttactgttggctgtaaagtattgctatggggtgtgttcctcagtagtggctaggtggtctatctgtgtacattgtgtaatcagagaggctcacatataatggttctgtggttggcactatttcagcgcctcatgtgcatgcattccatcaataaggcttctcctaacgaaacaaacgttcggcatcagtggatccgttgcataatgggttggggcgaacgtcgcgaggcccttgactaactagttatgcctggcatgtagtatctaccaataccaaatgtgatgacggatgttgaggggccttatattggctcgacttagtcatgttgtgtgtagaatcctgagaaaattatcgtacccatgagaacactatgtggacctaattagttcacactgaacatgtgatatggttgtgacctgagccgtaagttatttcgattctccaccgatgttcgagttattaagcttcacaggtttaaaaccttcaaaataatagctttggtaggcaagcttacgtcgtttgtcaagacacaaccaggcttgattgtagactaacacagaacaaaggtggttgagtggacagtgccgtgccaattctaacaagctcgaagacgagtcgactagacatttgaccctgtgtgaatcacaaaactttgggaaagtaaactcggtgaacacctttgaggacatgtctggctgtaagacactgtaaggcaggcaagcgacgcatttaggagaggtaactccgataagatggaataacacgagagccaactcaaaagccccccagccgttaccaggatacaatgcagcgggtgtgtgcaacagagccagtaagcacgagcatgtcacaattggccacgcagacccgagaagaagacgaggagtacatagaagcagaggcatataccatggagaaagtcagatcgatacgtggagaacaaacggagaacaactagaaccacaagcgaagagagcagcacacacaacagaatacgagacacagactaagaccgacaaagagacgcgcacggaacaccaagacatcgtcaacagagagcgctcaacagaaacgcggcggacacgcagcatagagacagcacccgagacgcagaaagcagacgagcaaaacgagaacgacgaaagcagaaacggcaacaacaaacagacgacagacgaaacgaacgcagcaagcaaccgactgagagcggacacgaccaaaggaaccgaacaacgagagactagacagatagacgagagaagagcacacgaaagagacatcagacaacacaatgacaaagcaacaaagcagtagacgcatgacaaaca

SEQ ID NO: 520949 - DNA, 241 bp, Homo sapiens
atggcggtgaagagccactgacaagactttaagcaagagacggagagttagcatctaatctggaggaagaccctggaaggaggcagccccttcccccaggctgacctggtatacaggcctttcttctgccaagtgtcaccagcaacccatggtgatagagagatgtaatcactggtttcgtggcctgagcaaggacctccaagattctgtggcagatgagagatgccttggtccttgggct

SEQ ID NO: 520950 - DNA, 883 bp, Homo sapiens
cccgtttatctggcctcgtgcgccgttgtgggcccctttgtgcacatatcccggcccacatgcggatccctcccgggttcctggggccgaaaccgggtccggcgcccccccccctgcccggtgtgttgccaccggcccatgtgtcttccccgggtgccccgcggcaagtcgcccttgccccggggcggcacgccacaacggtgatcgtcccgctttgcccccccttgtgtcacagcttaattgtgcccgccctgtccttcgttagcaccctgagggttgcgccagacttcttgccccacgactacctgtgtacaggcgtggggccccaacatggcgttccatatattcggcgaggggccccacccgtttcaaggtgtacctggggccttacccaaatggctccctctgctatgtcggggcttgcacgcttgtccaaccccacgcacagggggggtccctcttggtaaccccgacggaccctggttatcgcccggggtccccccagggccgcatatgtctaccgcagtcgtctcggccccccacgtgtcgtagccaccagtagggcaacattttcgtctggaggcccctgcgcgccagggccggaactttcagagtcccgcggcccccacaaggaggtcccaactttcactaagaacagggggcgctgacaccagcagtccacgggagccgagattgcaacacacagggtgcggtgaaaaagcaggctcagacacacagggacacccgtgcggcagaagacaagaccccggctgcgcccccttgagaacaagtagccgggcccccacccccacagggggggcgcccccaatggcgaccccccccttttaaccccccccaatttattcccctccccaacataaca

SEQ ID NO: 520951 - DNA, 106 bp, Homo sapiens
cccgtcccccagggtcggctgaaagaagtccaaccaaaaaaggggaaaaaaaaccccaaattttggggcccacccaaattaaaatttccttttggggtattgggcc

SEQ ID NO: 520952 - DNA, 191 bp, Homo sapiens
cggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctctaaaaaaataaaaatagaaataaagtagtgcttattgtttgc

SEQ ID NO: 520953 - DNA, 1545 bp, Homo sapiens
taaaaaaacccgtggtgtttcgggggggggggggggtttaatcacaagagggaggagagagagaattttctttcgcggggggagaggggcgctgggggaaagaagaggtcttttatttttgtgatggtgctacggaaggggagagagaatatggagagagaaaaaagaaacacacgcgccgcgcgggcgtacacacccgcggtcgcgagaacacccgaacacatcgcgcggagagagaacctttaacgcgcgggagaaccaaaagcacaacctcttataaaagagcgcgggggccccccagggggagagagagcccgcggcgccccaacacctggagcgcgcctgaacacacctctatgaggggcgagaagtgtggcgctctccaaaaaagagagagaagaggcgccgggtgaaccccccctccgcaggcgaacacgtggcgccccgggagcgcacaaagatcaagcgggcgagcgcaacaccacagagcgagagatataacgacagagcagacccgacgcacaaacgagacgcgcgcgcggcgagagcagtctcctaacgagcgagacgggcacgacgcgcgcgcgcgacgagacgcggaggcgcgcggcgcacccgcgcgccccaccagagagagcgccccccaccacaaccagcgagaaaacttctctaacacgcacgggccaaccagcaagggagacgacaacacctcacacacgcaaacccagagcggtggaggcgactagtccggcaaacacgcaacacaacgcgtggagagcgcagccatcacatcacaacacaccatctcgcaacgcaacggcccccacaacaaagaggaggaacaccatccccacaacagcatcgagggccaagggcagcatccaacggccccccgcccgcccaactacctcaccacagcggcgggcgcaagcaagacaacaacaccgacaccgcggcgaccacacaccacaaaccagcaacccaccacgtcgacacacccccccccgggcgggcacacaccaacaacaaaagcacgaggccgcccccccctacatcagccgtaagccaccaacaagcagcaccaccaagccggcaccaccagtagcggcgaccaagcagaacagaaagaagcgcacaccacgcgcgcccgcacaaacaacaacacacgatgctacctactcaggcaggccacggcggcgcgcgccccacacaaaaccagacggaggcgcacgaccgccacaccacgcgcaagagctgtctagcgaagaaacaccaacgcggccgcgcagcaaaacaacctagccccacacgactctacaacactcactcacaaacccgaccacctaaaacaagacacaagacccgcaaggtacacgactaaccgcccactggaacgacgaacaaaacacctccgtagcgagcaccacagaacacacacctcgctgactgaacacaaaacgcacacaactccacgcgcagacgccacacccacccagcccggcagagacaaccgccactgacacccacaacccccccccacagcag

SEQ ID NO: 520954 - DNA, 178 bp, Homo sapiens
tgactactagtctcaatctccaaagacaatatggcctagactacgtacataaccctaaaacctacctccaatgcctaagactaaatcgatcacaaaacaacttatattcactaaccactgtacaaatgaactattcacaaagaaagcacataatttcgaatcaacacaaaacacacca

SEQ ID NO: 520955 - DNA, 779 bp, Homo sapiens
gaatgacgctacttcccctatcatagaaagagcttatcagctttcatgatcacgccctcataatcattatccgcttatctgccttcctagtcctgtatgccctttgcctaacactcacaacaaaactaactaatactaacatctcagacgctcaggaaatagaaagccggtctgaactatcctgcccgccatcatcctagtcctcatcgcccgtcccatccctgacggcatccgtttaccataagcagacgaggtcaacgatcccgtcccttaccagtcaatagtcagagttggcgcaccaagtggtactgaagcctacgagtgcacgcgacatacggcggaacgtaatcttcaactcctacatacttccctccatgaattccgtagaagcgaggcgaccatgcgattccttgacgttgacaaatcgagtagtacgtcccgcattgaaggccccattcgtcataataattacatcacaagacgtcttgcactcatgagctgtccccacattcaggcttgaaaaacagatgcaattcccggagcgtctagaccaaagcactttcaccgctacacgatcgggggtatactacggtcgaattgctctagaaatctggtggagcaaatacctacagattgcatcgcccatcgtcctagaattaattcccctaaaaatctttgaaattaggggccgtgtatttaccctatagtagcccctctaaccccctctagagtcgatatagaaatgggggattgtgacccttgtcgaatgtgggcccaac

SEQ ID NO: 520956 - DNA, 283 bp, Homo sapiens
ggaagtactttgaaaaactacaacaacaagcagttattagtagcagcagcatattataatttttgggaaaactaagattcttcttgtcagattcctcctttcaacttcctaactgttgtggtagaagttttgcggagttccaagatgatggtgttaacagtgttcctagtaaggaaggaaggggccctctttatccttatctgtggagaaaaaacaggcgtttctaggcccctttgttgtcctgggctttgtacccacttccatttttttattaccataactt

SEQ ID NO: 520957 - DNA, 2541 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520958 - DNA, 2565 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520959 - DNA, 710 bp, Homo sapiens
atataaatgggatcgtgtagcatgtacttttgtaatggttcttcacacacaaggactttgaaattcaccaggttgcagtgtatcagtagcttatgccttttattgctgagtagtgtcccatgtatgtgaatatgccattatcttgtttactactcacctgttgatggacctgggaatggtatccagttcggggctactgtgaataaaactgttaggaacatttgtgtacaacgccacttgtgtagacataggtttcctttctcttgggtaaatacctaccagtaaaatggttgggttgcatggcagattttctgtttacataaagtaacttgccaaacgtgttggtttaccaaaggggctataccctttatattcccaccaggttgtatagagttccaatgtgccaacactcagttttcagccattctgatgggaatctagtggtatctcattgtggttgatttgcatttccccgggtgactaatgctggtaagccatcgttttaaggtacttcttgcccaagattgtatatcttcgtgtgaagtggatgtcaatctgttgcacattttaaattggatggttgtcttattgagttgtaagagtctttaatatataggtgtataaggtccttgtatgacaagaaataaaagccataagaagaagaaagaaagaaaccttttagtgggagataagcagagaaggattttaga

SEQ ID NO: 520960 - DNA, 2580 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520961 - DNA, 777 bp, Homo sapiens
  misc_feature (455)..(455): n is a, c, g, or t
  misc_feature (569)..(569): n is a, c, g, or t
  misc_feature (777)..(777): n is a, c, g, or t
atggagtttcacccttggtgcccaggctggagtgcaatggcatgatcttggctcacagcaatctccacttcccgggttcaagcgattcttctgcctcagcctcccgagtagctgggattacagtagagacggggtttcaccctgttagccaggatggtgtcgatctcctgacctcatgatccgcctacctcggcctcccaaagtgctgggattacagacgtgagccaccgcgcccggccctggagaattaatttgaaggggaggaaaattcagtttcagctcagctagggatttagtcttactaaagacgtgggaggaagttctccagctgaccagctttccccaacgtggaaaggaccacggcaaggtcacctgacctctccaacagacattacacgccaagggattcacagtcccgccttggccatgagggagattgtgctcacgcagacggngcagtgcgggaaccggatcggcgccaagttctgggaggtgatctctgatgaacatgccatcgactccgctggcacctaccggggggacagggacctgctgctgaagcgtatcancgtatactacaatgaggccagcggtagcgggtatgtgccccgcgctgtgctaactgatctggagccgggcaccctggactctgtgcgcctccggccctttcggccagatctttaggccggagaactttttcttgggactccccagtacaacatgggctggagatctttccatgttcctctgtacagatctggcttcgatttccagccn

SEQ ID NO: 520962 - DNA, 1481 bp, Homo sapiens
ccccctgttccgaaggatacggctgggctggttgataaggctgtggctgtggataaggtggtacctggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520963 - DNA, 494 bp, Homo sapiens
gcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacag

SEQ ID NO: 520964 - DNA, 791 bp, Homo sapiens
taacatggatggccaatttttaaaacactaaagtggaataaaatgcatgacaatagaaaaatgctgaacattatttgggatgctagctgtgggacataactgtgtaatttctggcttggagatgcaacatatatattcatcttgtgctaatttaatcccagatgtgtctgaatatccttcttcataaatcatgaaaactcatgctgagatagtaaaccatgaaatcgccttttcagtggtgccatgtatctgacagttccatctgggacggttccaaaattacctttaaaatgatctcagaagtcggtagattctcaatgatactgaaagcttggacctcttgtgtagaaaccaggtctatttagaaaatggctttatgataaatgtggcctcctgagtgatcatgaagtgtccctcgatatggtatggtacttaatgtgttaccaagtgccacatttcaatgagtcagagaaaaattaatttctcttcactacaataatagaccaggtagcctattctcttaaaaagtatgtgccagcaaactttattgacgacctatggattactaaatgaaaggatgggttaagtaagacttacatacctttcatcggagcttaagtaccttggaagacacttgggggacgttttcctacatcaattcacccaaacgtttatataagggaaacctctccgaatctgtttacaaatttatgggccagtcattcacaggtaacagggggtcaggctatgtttaaacattttcaagctggcggggagtgacaaactggccc

SEQ ID NO: 520965 - DNA, 198 bp, Homo sapiens
  misc_feature (49)..(49): n is a, c, g, or t
  misc_feature (113)..(113): n is a, c, g, or t
  misc_feature (175)..(175): n is a, c, g, or t
ccgcctggtccggccgggaagcccggaagacggggtcgggctgggagtnatggagccagaggaatgcctggacaaactggccccaagggtgaccggggtttcgacggcctgantgggttgccaggcgagaagggccacaggggtgaccctggtccttccggcccaccaggacctncgggagacgatggagaaaggggt

SEQ ID NO: 520966 - DNA, 2652 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactggacgagcgctgcactaacgcaggatccggctgccgaagtcctcgccagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520967 - DNA, 2378 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520968 - DNA, 348 bp, Homo sapiens
cttatttcacgggtgtgtttcgtcgagatgcacacacgagagaggttgctcatagggttaaagagatgtgagaagagaaatttcaaaggctctgggtggagatgcgctttgctcagaatcttcagcagtgtgcatttggagatcatgtgaaattagtggatggagtaactggatttgcaaaaacatgtgttgctgatgagtcaactgaaaattgtgacacaatcacttcataccctttttggagacacattatgcacaggtgcaactcttcgtgcctatggtgggctgactgtgtgtgcccccttccccgattggtgagaccacaggttgatgtgtgtgccctggttt

SEQ ID NO: 520969 - DNA, 2245 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520970 - DNA, 626 bp, Homo sapiens
  misc_feature (625)..(625): n is a, c, g, or t
ccgggctgtaggagtagtagatcacgatagcgtctgtagagaggagaaacacaatgagcacatgtggcagcagaggctactcttagacaaaggcccacactcagaagcagaccccctgtgctctgtaaccccaaggccctgctgaagagacactggacctctgaggaacttcttacttccggggcttcgtatgcacaggaagacattcaccagaggtggtgacgccggtggctgggggtttgaggtgccaggaagtaagcgcatgccacatacaagctgtagaccccagaggccctgcaggcgcaacaggaatgggctgtcaggttggcggctctgtcaacgggctcaatggcctgcatgtagactaccggaccgcgaacaatctgagtctgaccggcccacggaccaatgtgaaggaagtcatggaggagttagagtgctcagattctgtgccttccaagccttcacaggcctgtggctgagggaagccacaatgacacacagccatgcgtagacacaggatgccatgcacaaggataggattggacatacgcagactttacgcacatacatgtgtcaagttgagagttatacactgaatgtgggagcccgtatcatatctttnt

SEQ ID NO: 520971 - DNA, 2337 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgttagaattgcccctactgtcactacctggagtaacaaaactcctactgcccttcccagccatccacctgcagcctctccctctgacacacaggagaaaatcctccacctccgggtttcataatgcatggaaatgttaatccaaatgctgctggtcagcttcccacatctccaggtcatatgcacacccaggtaccaccttatccacagccacagcggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520972 - DNA, 356 bp, Homo sapiens
ttgtttaatcgcctaatgaataaatcttgataaatttacatattatttcatcttaaaacaaatctttgcaatagatagtatgttttatgttgaaggaaatgaaaacgggttcagagaagcctttgattgcatatgtcattaatggtgtttcatgctaagtatggcttcagaaactttactcttagaacttcaaaacaggtgattttaaatattacattacaaatatcagtgtaaaaagaacactatagtgttacattgcagattgcttgagcccaggaggtttaggttgcagtgagccatggtggtgccactatactcagcttgggtgattgattgagaccctgtctcaagtaaaa

SEQ ID NO: 520973 - DNA, 1368 bp, Homo sapiens
  misc_feature (18)..(19): n is a, c, g, or t
  misc_feature (23)..(23): n is a, c, g, or t
  misc_feature (29)..(30): n is a, c, g, or t
  misc_feature (33)..(33): n is a, c, g, or t
  misc_feature (35)..(35): n is a, c, g, or t
ccgactctatgaggatcnnccgnctcagnngtncnctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520974 - DNA, 113 bp, Homo sapiens
ttagtcaaaatatactgagatgtctgggcactcaggtgctgtaatcccagcacttggcgaggctgaagcaggaggatagcttgaacccaggagttcaagaacagcctggacag

SEQ ID NO: 520975 - DNA, 2527 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacagaaaaccagtctatccaagaccaggcacctatgttggaaggtcctcagaatggttggaatgaccctccagctttgaacagagtacccaaaaagaagaagatgcctgaacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 520976 - DNA, 179 bp, Homo sapiens
tctgaggatcctgtaagacgacagaagggaaaagggggttcgcaaaatcactcggggaagggaaaggttgctttgttatcatgcctatggtgggtgattaactgcttgtaccattacgtttcacttttaaattaattgtgcgttaggctttaataaaatttgggggtgcccctctgtcg

SEQ ID NO: 520977 - DNA, 417 bp, Homo sapiens
cacgagggtttcttccctgtcgcagctctgttcgatcacgcggctgtagtaggcgcggtcgcgcgccgacgcttcgggcacgacgatgaactgcatcaggccgaggcggccggcgacgatccagtcctgcgtgttcgccggctcctgtccggcatttgcgccggcagacagcgtgagcgcaccgagcagcgcgcacagcatgcggttcatgacttctcctccggatcggcgcaaatgcgccgcttgccggtcagaccggcccggcgctgcccggttcgtcgtcggtgccggtgcgacgcgtgcgcaggctgccctcgaccatgcggtactcgaacagccggcattcgagcgcgccattgaacagcggcgtgcgccggctcgccttcagcttgatcagcttcgggaaatccggatcgg

SEQ ID NO: 520978 - DNA, 345 bp, Homo sapiens
ccaccacgtctagagctgcccccactacatgtctctactgcttcttcacaatctgattaatcccagccaggtgcagtggctcacacctgtaatcccagcactatgggaggcaggcggatcacttgaggtccaggaattaaagaccagcctggtcaacatggtgaaaccccatctctactaaaaatacaaaaattagccaggcatggtggtgggcacctataatcccagctcacttggcaggctcaggcacacagaatcacttcaactcacgaggcagaggctgcagtgagccgagcattgcaccactgcactccagcctgggtgacagactcagactccatctca

SEQ ID NO: 520979 - DNA, 518 bp, Homo sapiens
tcgggcgcatggatgggcgaggtccacggtgcttcctaacacgtaggtgccttctctcctcagtcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520980 - DNA, 238 bp, Homo sapiens
tcagggcttttagcagactgaagccatggtttttagttttgtctctagtgatgagcagaaaagagggatgaggaagaggctggacgtgggccaaccagaaagagaagctaagaacccatgactggattctctcccttggacaccccacagaccagtatcttaccttccaggagaagacccttccagctcttgcttctttaaacctattaacttaggtttctttagctagactaccaaa

SEQ ID NO: 520981 - DNA, 534 bp, Homo sapiens
cgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520982 - DNA, 181 bp, Homo sapiens
  misc_feature (93)..(93): n is a, c, g, or t
gtcacatgacactcgccttctgccaaagctttcctgtcttcttgaccctgaacctcctaatgcttcttgccgacacttcttcttcctcctgtntccaaagggctctttttttcccaataaatggaactttctttttctttctttttttttttttttttttttttttttttttttttatatt

SEQ ID NO: 520983 - DNA, 169 bp, Homo sapiens
ccttgatgttagcatttgggacttgtgacttccaaaactgtaaggaaataagtttgtgttgttttaagcccctaaatttggggtaattttttacagcaggactgggatattaatacgctgcacttctgtaaaaacctttttaattaaattatcttcagttaaagcccca

SEQ ID NO: 520984 - DNA, 1776 bp, Homo sapiens
  misc_feature (252)..(252): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagacaggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagcccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520985 - DNA, 322 bp, Homo sapiens
gatcgacgacatgtacctcactcagcaacgcatctgctgacccagtgatggagggtctgcgatcagccgtacgctatgacaaaacctatttcgacaagatcgtggccagccttctgccattgctggaaaaactgaccacaggccggattgcagactgctatctcccgactacatggatcttgaggacccacgaccaatctttgactggatgcagatcatccgcaaacgggcagtggtctatgtcggcctggacgctttatctgatacagaggtagctgcagcggtgggcaactcgatgttcagcggtcgaccggccgcaatt

SEQ ID NO: 520986 - DNA, 1461 bp, Homo sapiens
  misc_feature (252)..(252): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcagcagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagcccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520987 - DNA, 766 bp, Homo sapiens
  misc_feature (342)..(342): n is a, c, g, or t
  misc_feature (431)..(431): n is a, c, g, or t
  misc_feature (447)..(447): n is a, c, g, or t
  misc_feature (449)..(450): n is a, c, g, or t
  misc_feature (462)..(462): n is a, c, g, or t
  misc_feature (466)..(467): n is a, c, g, or t
  misc_feature (470)..(470): n is a, c, g, or t
  misc_feature (476)..(476): n is a, c, g, or t
  misc_feature (478)..(479): n is a, c, g, or t
  misc_feature (505)..(505): n is a, c, g, or t
  misc_feature (517)..(517): n is a, c, g, or t
  misc_feature (526)..(526): n is a, c, g, or t
  misc_feature (529)..(529): n is a, c, g, or t
  misc_feature (550)..(550): n is a, c, g, or t
  misc_feature (554)..(555): n is a, c, g, or t
  misc_feature (568)..(568): n is a, c, g, or t
  misc_feature (588)..(588): n is a, c, g, or t
  misc_feature (607)..(607): n is a, c, g, or t
agcgggacccggaagccgccgatggccgccgcacaagctgcgctcgtctctcggctggggagctccgtgtcgcaccgggttcttgggctggcgtgtccttctccctcggtcgccactggcccatgagtccccatggcgacggcaggggccaggcccaggggcgggcagtccgagtggggctgcggcgctccgggggcatccgcgggggtggggtgttcgccgcgtggccgcagtgttcaccttcaccctgcccccttcggtaccggggggagactccggggaactgatcacagccgcacatgagcttggagttgcccatcctcctggctatccttgttcacnctggtggctaaactggcaattacactgtttcctttggttcaatgcctaccgcgtcaatcttctctgtggcttatttggagcagtagctngcatcattactttttntnnacggtttcaggntttnnggntcatcngnnggaggaatccttggtggggggtgttncattttctcgtntaacatggnagnggtccattgcagcagaggttnaagnntaaacaatctctngggggctgttatggtcttantgtacatttgaggaagcanactgtaaggagagatcaaaggtagctaaaattggtgcttctgtgtgcgcttagttatgtaaccagcacacaataatactctatggtgcgggcctaataccttgggattctcgtttccacacttttagaaagcaagggactctccctggggccatgggac

SEQ ID NO: 520988 - DNA, 1875 bp, Homo sapiens
  misc_feature (252)..(252): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagacaggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagcccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggctggagtcagatggtgccatctcggctcactgcaagctcctgcctcccgggttcaagtggttctcctgcctcagcctcccaagtagctgggatttcaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520989 - DNA, 1846 bp, Homo sapiens
  misc_feature (252)..(252): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagacaggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagcccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggcaggtaagtgccggtgggtctgggggcacctcccgtggcggcactcaccactctgtgtcttcgcctccccacaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520990 - DNA, 306 bp, Homo sapiens
ctttcgactcggtacccgacagggtctctctctgtccacccaggctggtgtgcagtggcacaatcacggctcactacagcctcgacttcctgggcttaggtgatcctcccacctcagcctcccagatagctgggaccacaggtgcgagccaccacacctgctaatttcagggttttaccatgttggcatggctggtcttgaactcttggcctcaagcaatctgcttgcctccgcctcccaaagtgctgggatgataggcatgagtcaccacgtccagccaatcatttttattgtctacactaacag

SEQ ID NO: 520991 - DNA, 174 bp, Homo sapiens
aggagacgtaggtccctaggctcactatgcatgtagcactagctgagcttatgaggtgccttgtcggtggcggtgcggatatctcgcgcgctagcggtatccgcatagcacactaggtgtaagaatattcagagattacgagcgattggatactattggtcttccacgtttggg

SEQ ID NO: 520992 - DNA, 1678 bp, Homo sapiens
  misc_feature (252)..(252): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagacaggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagcccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgatgtgctggtggccaggtacatgtccagggccgccgggtccccttccccattgccagcccctgaccctgcacctaagtctgaagctgccggccagcaagaggtgagagctgccagcctgaggtgcccactccgccagccacaggaccacctcctctgccagcaggaataaagacttgtgcatccctcaaaaaaaaaaa

SEQ ID NO: 520993 - DNA, 770 bp, Homo sapiens
  misc_feature (252)..(252): n is a, c, g, or t
  misc_feature (375)..(375): n is a, c, g, or t
  misc_feature (390)..(390): n is a, c, g, or t
  misc_feature (401)..(401): n is a, c, g, or t
ggagcgctccgtggctgtcggtgctggccccgaacggcccggcgccacacggtgaaggtgacgccgaggcaccgtgctgcttcaggttctggaggacacgtgtccggcggcgaggacattcaaaccacctgttgacatatgatactgagaggttgtcaagagagatgcagtgtctcggaccgttatctcctccaggtggagatttgcacaagccgtagcccagaacagagtagcgctagagtcgtggagatngtgccacgcttccacggagccgtgaggggcctgagaacatggttcgcatcgctttgcagctggacgatggctcgaggttgcaggactctttctgttcaggccagaccctctggaaaaggggangcctttttttctttnaccaaaaaggncccatgagcttctcagccattttccacagatcagggagtgcctgcagcaccccggcggggccaccccagtctgcgtgtacacgagggatgaggtaggcggcctgctcttgctcacccagtccccgctcactttcagcccactttccaactggaaaatctgctgtcccgcagccgtctccagggcagtggcgggagactcgggctcttgaaagcacgacgtgtttcatggaaaaagagggagtggccggccctcggagcccgggctgccccgaaacctccctcggcgccctgtttgttttttcagcttctctcaaagcccaagagtcacaaaagtggtttcatttaataaatatttgctttgcaaaaaaa

SEQ ID NO: 520994 - DNA, 332 bp, Homo sapiens
agatcagcacttaagttagggggaacggggcatacagatacacacaagtcactgtgttcagctttcaaggagttgtaggcgagttctcattctcttccttagaaccggcactacgtgggctcagcagctggttttggcagggacccagaggctgggacattcccagggcagtccctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccacttt

SEQ ID NO: 520995 - DNA, 378 bp, Homo sapiens
agcatgcagctacgtataacactacacctggaatgcatctgtaacttggctccgtagagttgaatgagcctgagaactagggtaggaaaaaattacaattgtattgtccctaacctctaactgaaatttagcatcactctcaagtacgagcgtaggcaacaaaccacagaggtattatcagccgtacctgtgaccttgtcaccaacagacgtcacagatacttacatatcacattacagttgctgcaggttgctctaaatatcttttatgctcatcacaacttcaaaaccatggttgtcattaggcccaatgctagatcttatttaatacattgaataaagcagcacatttaccacaatttttaaagtatttcgctat

SEQ ID NO: 520996 - DNA, 417 bp, Homo sapiens
tgatttgccacggcctcgtctagtaggcgaatgcggcgcatctcgtgctgatcagcgttgccaaagtgacggcttggcaccgcagcgtaagtggcacggctccgctgactgtcccctgcgcgtttgaagaccctcgtcgacgagaggcgctgggaaacgttcttgcaccagcgttgcagtcgcaatcttaagcgcctgcacagcagggaagccgcggcccctacggagacgggcgtcgccgtcaccctctcgctcgtcgatgagtggcttctctgggtcgagccgttgaacgcacagtcactgcagcctgcgtcgccgcgcgactcatagctgtccaacgtacgagcaaagcaaaagccgccaccgcgccgctgaaccggaaagaggctggtggaggtgctaggtgggagaaggatc

SEQ ID NO: 520997 - DNA, 192 bp, Homo sapiens
actcataggctcatactactgtctactccaggctcttctatgaaacagttacaaagctacggccaggccagtgcagtggctcacgacctgtaatcccagcactttggaatgctggggcaggaggatcacttgaggtcaggagctcgagaccagccagggcgacaaaagcaagactccgtctccaaaaaaaaa

SEQ ID NO: 520998 - DNA, 310 bp, Homo sapiens
tttcgacggtgttctgcagtaatgttagcggttaggcgtacggccagtgctattgtttgaatgagtaggctgattgtttcgataataactagtattgggataaggggtgtaggtgtgcttgtggtagaagttgggtaagggcattttaagtcttagagcgaagagctataatcactgtggcccgctcataaggggattggcatgggtaggtttatagatagttgggggtgggtgggtgtaaattgagtgaggcaggagtccgaggaggttagtttgttgggataaaaatgattaaggatactagtataag

SEQ ID NO: 520999 - DNA, 144 bp, Homo sapiens
tctttctttcattcactctttctttctttcttactttccttgtttctcgctctcgctctttggctatttccctcgctcgtttcctttctcaatctctttctctctctctatctctctgactatctctgactatcggtatggccc

SEQ ID NO: 521000 - DNA, 303 bp, Homo sapiens
  misc_feature (175)..(175): n is a, c, g, or t
  misc_feature (180)..(180): n is a, c, g, or t
  misc_feature (205)..(205): n is a, c, g, or t
  misc_feature (242)..(242): n is a, c, g, or t
  misc_feature (244)..(244): n is a, c, g, or t
  misc_feature (297)..(297): n is a, c, g, or t
ccgtgtggtcaacctcaatgccctgctcattatggcagtggccgtgttcctttgggggttttatgcctaaaaccaactgggttgggccccataaaccccaccctcccaggaagtgggggttaggagccttcggtgctccccaaaaaaagggaaggggcagtggggttaaaaggtnctggntccccttttcccggccttcctttgnctgggggcccctgcatttgattggcagtccctttccntnaggggctggccccccccctgcagttgccctaaggaaaaataaaactgcctttnccctta

SEQ ID NO: 521001 - DNA, 155 bp, Homo sapiens
ttcttgcttgatgtgactagagatgagccttcctgggcaggatctgtaagtgataaatctttgaacttatttctttttgtggtggtgtattaaatttgcaccccccattggaagagccagggactatcccagaccaggttttctcgagaatgctg

SEQ ID NO: 521002 - DNA, 181 bp, Homo sapiens
  misc_feature (131)..(131): n is a, c, g, or t
  misc_feature (164)..(165): n is a, c, g, or t
  misc_feature (169)..(169): n is a, c, g, or t
ttttttagctgaaataacttcgattctggtttatttccatcacatatagtacatttttccaactagaaagactgtaactattgctggaaatgttctatattgaatgtacatgctcttgttggaaaaatgtnctatatgtgatggaaataaaccagaatcgaagnnttantctagctaaaac

SEQ ID NO: 521003 - DNA, 264 bp, Homo sapiens
tgttcgcatcatgcagtgtgactcgtagagtgatccccatcgttcgatcgccgcttgcccgtcgcccctcggttcagcgccgtcttggctcgggacaaaatcctgaagcatcggacgccttctgggcagcctgctgcgacttgagcacttcgggcgacacgttcagcttgcggcctgccgggtcctcttccttcttcgcggcggaagcgggagcagaaacggcgccgccggtcagcgctagaaccagcgcgatcaactgcggtc

SEQ ID NO: 521004 - DNA, 895 bp, Homo sapiens
gcgcgatgtatgaccacaatggctggcgccaccctgcatgcgctgcgatgccccacttcagctggtctcgccgcctgtgcctggaccttcctgctgcagggtctgttgctggctgctgaaatgcccctggcattgcctctcttgtgcctgctggctggcctgtggatggccaatgaatgacttactgtgcgctgacaatgccacattgtgaatgtgggtaccatctggccatgtggaccacgggaagaccacgctgactgcagccatcacgaagattctagcttgagtgcgacggtggggctaatgttcaacgacagtactgatggacgatttgaccaattgcccctgtgacggagctgagcctcgcgggtattcaccatcaattgctggctcattgttggagtatagcacttgcctgcccgccactactgcccacacatgactgccctgggtcatgcagattactgttaagactattgatcacagtgcactgcacccctcgacgggtgcatcctggtggtagcagccaatgacgtgaccccatgccccagacccgagagcaattattactcggccagaccagatctggggtggagcattgttgtctgcgtcgtcattcgtgcaacaagtgcttgacgcctgtcccagcgcactccttgcacactgcgtgcgaaccttggtgccaactgtgacgatcctgtcgaagcttgcttcaacctgaagtcctgacctaattcaaatggctcaccccactgaacacccaaggcacaatccagtaagcgccaccatgcgacctacattgttgccccctttgcaaccgggcatccgcgaaccccctggaaggttaagcggccttgcaaagcactcttgtcgccccaatccctaacttggcaat

SEQ ID NO: 521005 - DNA, 551 bp, Homo sapiens
cccttgagagatggtgagatcactgcagtaccgatccagtctctactagaatgtaagtactgcgatcaacatataggacgtatgacactcgtccggcggagttacaacctgtatagtgataagaagtatgcattaccatatgtataatgagtatacaagcttctctttgaactcccagggggtgatgcttgactactctatctaaagcgttaggctgggatacatcctgatctaatattatgaaaattaatccatctgggggaaccacgcatacaattacccaagacctccttctgtagcagaagaagtgctacttcagagacaaaacctgaatcgtggtctcattagagccgttgactccagcaacagttgccggcatgcatacctactacaatccggaattagtggagcatacagaagcactttcttgaataacataggaggggactactgaagaatatattcctggcgcagcccagctaagtcatgatgactccatgaaagagagagagttgttgaactttaagtagtcaccagtctgtacctgtgac

SEQ ID NO: 521006 - DNA, 2434 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctatcctgcagatattgggggagtaccgagtctcgaatttcgatat

SEQ ID NO: 521007 - DNA, 1299 bp, Homo sapiens
cttgttcctattaagagatgtgagtgtgagaatccagggctacatagtgatccccacactcggctggtaaaacctttgtgacagttatttcagggttaaggcagaattttgaagtattaggtgatcgattcagttttattttttttcctttcaggattctaaaggaaaacattctctgttatctgttataggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521008 - DNA, 457 bp, Homo sapiens
  misc_feature (17)..(17): n is a, c, g, or t
cagtccaacatccgggngtagttaaaaatatatatatattttgggtagagaggggatctggctatgtgcccaggcgggtcgcaaactccgggcctgagtgatcctccggcctgggcctcccaaagtgatgggattacgggtgtgagccacctggccgggcatagacattttttaaggactatggtaattcagataaaaggctcgggaaagaatactggcccagtaagggcatctccaccagtgaactgaagacaactctggcttggatcctctaggaaactcatgaactctttttttcctttttgggagatgagtctcgctcggtcaccaggcgggaaggcaggggcgtaatctctcactgcaacctcggcctccggggttcgagcgattctccggcctcagtttccggagtagctgcgactacgggcatgcgccgccacacccaggaggtgggagg

SEQ ID NO: 521009 - DNA, 1099 bp, Homo sapiens
gagtgaatcatatcgagagggacaacatcaccaaacaaggcggggctctgtagcctagaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521010 - DNA, 2514 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctctttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521011 - DNA, 498 bp, Homo sapiens
cgttgccctcctttaagtgaattgaacccgcttgcctcagccgatcgactaagcgcagcgagtcattaggctagatagggaaagagcgcccaaaacgcaacccgcctctccccgtgggttggcctattcattaacacagttggcgcgcatggtttcccaactgtaaagcgggcagtgagcccatttcaattaatgtgagttagctcgctcatcaggccccccaggcttttctttttatccttccgcagagactcttgtgtggaattgtttagcggaaatttatttcacgcaggatggataccctgaccttgtttccccccctctcgatattgaccctctctaaaggcacgtagacctgaagctccagagggggggcgtcctctctagtgctagtgggtcccccgggctgctcagccaaggcctgtggcgtcgttgtctcccaggttgccaaggaatccctctcttgccaacctttgtggaataaaatttcaaataaac

SEQ ID NO: 521012 - DNA, 2607 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacacgttcacttttgtttcagctttcacccaccatcacccgtggtttattacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521013 - DNA, 1842 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagcggtcctcagaatggttggaatgaccctccagctttgaacagcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521014 - DNA, 896 bp, Homo sapiens
  misc_feature (93)..(93): n is a, c, g, or t
  misc_feature (103)..(103): n is a, c, g, or t
  misc_feature (127)..(127): n is a, c, g, or t
cgtatacatctagatgagtatatattaaaacattttttaaaaatgagatcaaaataggccaccacgcccggccataatctgttcaagtttctnagttgtagtngcctccatttctttataaaatgangccattcaacattttaagtataaggtttagtgcaatgagatagggcaagttcttaggttaaaagttaatgttcaaatataacatctattttttctttcctgcagcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521015 - DNA, 1191 bp, Homo sapiens
  misc_feature (141)..(141): n is a, c, g, or t
  misc_feature (147)..(147): n is a, c, g, or t
  misc_feature (209)..(209): n is a, c, g, or t
  misc_feature (222)..(222): n is a, c, g, or t
  misc_feature (258)..(258): n is a, c, g, or t
  misc_feature (288)..(288): n is a, c, g, or t
  misc_feature (326)..(326): n is a, c, g, or t
  misc_feature (379)..(379): n is a, c, g, or t
  misc_feature (413)..(413): n is a, c, g, or t
  misc_feature (422)..(422): n is a, c, g, or t
gggaggcggaggttgcagtgagtcgagatcgcaccactgtactccagcctgggtgacagagtgagactccatctcaaaaaaaaaaaatccaaataaagtcttctgtaaagtatggacacctatgccaagtaatgacatagnaaaaanctacaggtttatagtttaagagatgacaggattataaaaagcaggtaagaattagtaaattngggcccttccttngagatattatgattaagaatctttaatctccttttngtgcataggagaattttttaaaggtctgangctctcttaagtggagagagaaattagcatttcagttnggagaggaaatcgggctgcttttctgtaagaaaatacctggcttatacatgtntaattcataaataacttatttatgtaaatcattntgtgtggtngtacttgataactgttgcttggttcaagaaactttctagaaatgctaaatggtttatatatttttataatgtttgtttcaaattccacttaaatatctgggtttaatgtttatggaggatctcatgggaagttatcccttaatttaattctttctcttggttcacttttgtttcagctttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521016 - DNA, 271 bp, Homo sapiens
ttttttttttttataaagaagtaagcctttatttcctgggtttggcaaataaaaggggctaagtgggtggcttttgggggattagtcaaagagaccaaatcccatatcctcgtcggactcctcggactcttcctgggcttcaaccttagcgggggcggcagcagcagcaggagcagcggtgggggcagcagccacaggggcagcagccacaaaggcagagggatcagccaagaagggctggaccttttcagcaagggggggaccaggaacg

SEQ ID NO: 521017 - DNA, 472 bp, Homo sapiens
agctgcataaattccattatggctgtttcatatttttttaaacaattctcgtattgatgtgatcatttaagtttctaatttttcactcttagaaatgagactttatgaacatgtttgcatatatatctttgaatacctgtccagttatttcctagaataaattcctaggagtagaaatgctggagcagccgggcgcggtggctcacgcctgtaatcccagcactttgggaggcagagacgggcggatcacgaggtcaggggatcgggaccatcctggctagcatggcgaaaccccgtctctactaaagatacaaaaaaaaagttagccgggcgtggtggcgggcacctgtggtcccagctactcggaaggctggggcaggagaatggcctgaacccgggaggcggagcttgcagtgagccgggatcgcgctactgcactctaacctgggcgacagagcgagactccgtctca

SEQ ID NO: 521018 - DNA, 2284 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggttaccactgcagggctgaatcgaactatcgaaggtgctgctaccccttgttgccgcaatcgtggacttgcttctgcgttcaagtgtgtccgccatagctggggctaaggggctctcccaatgcttcccgacttaaattacgtcgtcctgtgtgcccacttttgttactacgacgggtgtttgggacacactgacaagtcgttcacagaccgccaaatgagactcttagt

SEQ ID NO: 521019 - DNA, 322 bp, Homo sapiens
cctacgctgcactgtctcgtttgtcgtcagcggctggagcttgttataacattatgcctcatagggatagtacaaggaaggggtaggctatgtgtttagtcaggtggttgagaatgagtgtagaggcgtattataccatagccgcctagtattaagagtactgcggcaagtactattgacccagcgatgggggcttcgcaccagtgggctatcagggagctccataagtagagtccgtacaagagggtctctttcactatgcacacagctattgtagtaagcgcaggtcatcttcaagtatgttggcctccaggcagtttgc

SEQ ID NO: 521020 - DNA, 1913 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccaggtaacagtaaatttgtagaagtggaatgggaagatggctgtgtttcagtatattttctttaatgtgctaacttttatgattgcatgattattattaaacatctagacaacct

SEQ ID NO: 521021 - DNA, 148 bp, Homo sapiens
  misc_feature (48)..(48): n is a, c, g, or t
gagaagacgacagaagaggagaaaagtacccctttaattggtcctttnagtgaatgttcagttcagaaaaacaaaaaaaagggtatttaaaaaaaactggctggggcacgggggctctcgccggtaatcccagccagcacaagggtgg

SEQ ID NO: 521022 - DNA, 1128 bp, Homo sapiens
  misc_feature (310)..(310): n is a, c, g, or t
  misc_feature (440)..(440): n is a, c, g, or t
  misc_feature (463)..(463): n is a, c, g, or t
  misc_feature (475)..(475): n is a, c, g, or t
  misc_feature (481)..(481): n is a, c, g, or t
  misc_feature (485)..(485): n is a, c, g, or t
  misc_feature (487)..(487): n is a, c, g, or t
  misc_feature (527)..(527): n is a, c, g, or t
  misc_feature (530)..(530): n is a, c, g, or t
  misc_feature (534)..(534): n is a, c, g, or t
  misc_feature (615)..(615): n is a, c, g, or t
  misc_feature (635)..(635): n is a, c, g, or t
  misc_feature (659)..(659): n is a, c, g, or t
  misc_feature (721)..(721): n is a, c, g, or t
  misc_feature (727)..(727): n is a, c, g, or t
  misc_feature (783)..(783): n is a, c, g, or t
  misc_feature (791)..(791): n is a, c, g, or t
  misc_feature (832)..(832): n is a, c, g, or t
  misc_feature (834)..(834): n is a, c, g, or t
  misc_feature (892)..(892): n is a, c, g, or t
  misc_feature (913)..(913): n is a, c, g, or t
  misc_feature (947)..(947): n is a, c, g, or t
  misc_feature (964)..(964): n is a, c, g, or t
  misc_feature (1032)..(1032): n is a, c, g, or t
gagatggtgggagcatgctacccagtgcttccctggaatcgggcccacgtggatcatgcggctggtggtcgaagtgcatctcgagtcctatggtcctgggacaggcgagcatgtggctgtcgcgatgggacaggtggccactccttgatgttcatgccagatggagcacgcacggccgaacatgaacgggcagtcacagacctgaacacgactaggcatcgctcctggcgttgtgtgcgccatcgtgacgctgtgtgccaagtacgcatatccagtcctggcgtctacatgtgctcttggacccctgaangctcgtatcctacgacagacgctcgaactgtgctcgtaccatcggaccttcactcgagagttgtgcgcttcatataagttcgttgcgtgatagctgtgacgtcagcgccggagccgaggtattgaccacntgaagtcgagttgtgcttgcctntgtgctcgtgcntgcgtntgtncncacgactgcgtttgacccgtgacagcgactgagcgctagntcnctgnattctacccttgcgatcacacgtcgccgttagcgaggaacggtggcgagacattgtattgacctctccgttggcgttgacngtcacctcgtgtagacgganacacttcacagctcgccatgaagntctccgatcgatatttggcagtcttggcgtggcgtactggagatcgacagtcagttcgattnggcgangtcccttgggaacgagaacagttcgtgctctcacgacaacgataacgcgttgcggnaacattgngtcggcccaacctgatcgcttgcgcactgggaaggcgcccnantagcatagcaccgtgttccacactcgcaagcatgcgccgtggagaccccagggtggcnattttaggcaatgcgcgcacntcaatgcccgcgacccgtgaacacacgtcatganagcccatcgtatctgcnctagtatactctcaggagctcgcgcgcctggcacctgccaaggagttctcgcaggcgtccaactcttngcgctttgacagaagcatggacgcacacgcgcagcactgatgcgcatgtggcttccgcgcacatcgtgagggcccctgtagccgaggagtgttgag

SEQ ID NO: 521023 - DNA, 337 bp, Homo sapiens
  misc_feature (26)..(26): n is a, c, g, or t
  misc_feature (47)..(47): n is a, c, g, or t
  misc_feature (72)..(72): n is a, c, g, or t
  misc_feature (199)..(199): n is a, c, g, or t
  misc_feature (229)..(229): n is a, c, g, or t
  misc_feature (241)..(241): n is a, c, g, or t
  misc_feature (253)..(253): n is a, c, g, or t
  misc_feature (271)..(271): n is a, c, g, or t
  misc_feature (316)..(316): n is a, c, g, or t
aacttaagatgttgaggtgactgttngatatttgaatccagagtttnggaaagaggtctgtaatatcccttngtatgtgttaaaatccttaggccagtacatacagttcatttatttaatcagattgttaagataatagttttctccttatcctatatgtagagccaatacaatttatttttcaccttagggagttagnaaaagaggtaacaaattcaaccccaaatangttgggaaatanggaaattcatgnaaatagggaaacaaacangggaggaaattttaaaagtggaaaagttgggccttttggaaaggntaaataaattggataaacccc

SEQ ID NO: 521024 - DNA, 338 bp, Homo sapiens
actttgtgctttctgggtatatgttaaaagcctaaaactgggctgggcatggtggcttacgtctgtaatcccagcactttgggagactgaagtgggaggattccttcagaccaggagttcaagaccagcctgggcaatgtggcaaggacagttctctacaaaaaaaaaaaaaaaaaacaaaaaactttatttagctggttatggcaatatgtgcttatagtcccagctatttgggaggctgtggtgggaggatctcctgagcccagtagttcaagtctgcagggagctatgattgtgccattgcattccagcctgggcaacagagtgagctctgtctc

SEQ ID NO: 521025 - DNA, 747 bp, Homo sapiens
taattaaaaaaaaaggacacaggtgtctggctcgtgtctcccaggctggagttgctggtggtgcaatcacagctcacgtgcagcctcgacctcctaggctcaagcaattcctcagcctcccgaacagcgtggcatcagaggcgcattgccaccacacagtgggctaattttcaaaattttatagaaaactaaggtttggccatgtttgccgaggctggtctgtgaactccgtgggcttaatggatgctccgtgcctcggcctcccagaaggtgctgggattataggcttgagccaggctcaccagttgccagccggttactttaaaccttgaactcctcgaagacatttagggtcagaagccacaaaaacttagaattattaaaattttaaataagcggccaagaaggttgatggatttcatacattggattatagatttcaagggaacactcaccttatgagtagacggggttttccatatactttaaatgatcttggcttcgtagattcttaactagtgaattgggtaatcacatttacccaaatgtagttacactctgtcttggataatatggtctgtacaaaaattaacaggaagaaattatgctgatggggaaaggagaaccattgggagacggaagctggttctcatgggtactttaaaactgatgctatattatccaaaagaaaaaatggctaaactttttaagggacgctacagggtctcaaactggattacgggtgaa

SEQ ID NO: 521026 - DNA, 182 bp, Homo sapiens
gctgtaagggagctctacgacgagctgtgtctcatctgagacttctgacccagcctgcgggaagacgtactggtatctgattgttctttaaccagaaaaccttcagggatgaaaaaccggaagaagaggcccggactcatacagagattgaaatgttccttagaaaggagcagcagaaactt

SEQ ID NO: 521027 - DNA, 279 bp, Homo sapiens
acgactcgagttagtaccctcgatcgggctatccgtcgatagtttgcagatagctccacaggcttcaggatgtctgacaggacttccataagaatcgtggagctgtggttataccgtgccagtgactcaaactccttaatgttacttgcctgtacttcctgttcactcacatccccacaagttcccaatctgaatcccattctctgaccattctctgcttccttgtctttaatctcatttgagagtgatcctcacgggttcccttggccccttatcgag

SEQ ID NO: 521028 - DNA, 153 bp, Homo sapiens
aaactgatctgaatacatagaggtagaagatgaggcactagacacctacttctccgcctcgtccctcagggccctttaagaaatccccccgcccacaacaacaaaacgtgttagacggtcgtgacggtgtcccctcgggttttctctatttct

SEQ ID NO: 521029 - DNA, 1536 bp, Homo sapiens
  misc_feature (487)..(487): n is a, c, g, or t
atctgatagggccttggaggagaaggtccagcttttaaaaaatgacagtttgtgtttaataaatgcaaggcatgagaggaagtcaagtagcacagttgaaggacaggtcagttgacgatgaacacacttcaaaaccctggcttatacgactgtactgtttggatgtagccatagtcttgagtctagcgtccacaaagacattattcaaatgatcatctctcagacagaattataactattacattgacatggagtcccttggatattcttggatcagtcacacattaatcagccataacagtcctaggactgcgtgtagtttgcaagcttcaaacagttccgcttcattctgcacacacagctctgcacaagtcttcatgcagacgttgtgcaagcatgtgcggtacaagttaacactacacttatatagcgtccgaaaaaaaaccaaagaacagtatacgtatggtactactgttccaccaggagnaaagacaacaacatgcaaagacattctcataagtagcagaattacaagttacagccctctgctcaggtacataccgtgttccacgtggagtgtccgttactatgggtattagaacttcaaaagcttcagggccaataatcactgcggcgagaaaaaaagggggaccatacccacacaacacaggaagcccacggcccgaagccgtgcacacaccatcgtagaacggggacgcatgacggcacgcacaagattcacggaccactggctcgcccttcaaacaggaatcacgagtaaccacgcacgctcaccccgacaaggaactaggttcggtgactcgacgctgagcgcgccaaaatcccaccgcggcacactgcaactcggacaccaaacatcgcagggacagcaaaaacacacccacgagcgcaggcacgcggtccagcacgaccccacggggaccaatccgaggcaagagcaccggacaaaccgaaacgacgacgcgaccaagccacaaacgcacaaagcacgccactctacacacacagcggggtcgcaacaacacaacacaggaacggccgcgacgatccggaaaggaggaggctgggcacaacgcgacgagggccgatcagcgcagacacgtacgacggcgacgcggctgtgacccgtggccgacgcaaaacgtgaccacgcgcaaacaagggacacagggagagggccgacctagtcgggaaggcggagagagtcagtccacacgactagaagagggtagcaagacaaagtgaaggggacgaggcacacacgagcagcaaggtggcaatcaacgaatagcggcggaaaaagaagaagagagaaaagctagcacaacaaaggcgaacagaaaggcaacgcagagactgcgacgagagcgacgacggagacgcgaagcaataacaaacacccaacgctgcgagagggaaaacgagtacagagagacgaagacagcgaaggaaacaaacgaggcgacggcgtgagatgaaaggcagacaaggaacaaaaacggcgacccaacgacg

SEQ ID NO: 521030 - DNA, 161 bp, Homo sapiens
  misc_feature (27)..(27): n is a, c, g, or t
  misc_feature (49)..(49): n is a, c, g, or t
gaaagtgtagaaacacacaacaaagtnaaattaagaaaagaaatgaacncaatataggataaagacaaatgccagataggagaaaacacctatggtggcacatttagaccaaatactcttcaataaagccaaaataaattgtttgataatattctgtttac

SEQ ID NO: 521031 - DNA, 471 bp, Homo sapiens
gacgtaggtcaactgggcaaccggcaccacctgcacacagcagaactagcagggtcaaccatgcgcacaggtacctaccggcacccaccttcactcaccggaacctaccatgcacccaccctcattcaccagtacctaccggtgtccacccttgctcaccagtacctactgcacccaccttcactcacctgcaactacctgcacccaacttcactcagctgtgcctacctgaagctaccttcactcacctgtacctacctgtgcccaccttcactcacctatacttacctgcacccaccttcactcacctatacctacccgcacccaccttcactcacctgtgcctacctgcacccaccttcactcacctgtacctacctgcacccaccttcactcaacagtacctacctgtgtccacccttgctcaccagtacctacctgcacccaccttcactcacctgaacctacctg

SEQ ID NO: 521032 - DNA, 245 bp, Homo sapiens
agcagacattgaaattggccatttgtaagataaaaggctgggcatggttgctcacacctgtaatcccatttctttgggaggccaccacaagaggattgcttgagcccaggaaggagttggagaccagcctgagcaacaacaacaacaaaattagccaggcatagtggggcacatttgtagtcccagatacttgagaggctgaggaaagagaattgctttgatctcaggaggttgcggctgccgtg

SEQ ID NO: 521033 - DNA, 865 bp, Homo sapiens
ggctctttccttgccctaacgcagccatggctcgtggtcccaagaagcatctgaagcgggtggagctccaaagcatcggatgctggattaaattgaccggtgtgtttgctcctcgtcgcatccacgggtccccacaacgttgagagagtgtctccccctcatcattttcctgaggaacagacttaagtatgccctgacaggagattgacagtaaagaagatttgcatgcagcggttcatgtaaagatcgatggcaaggtccgaactgatataacctaccctggtggattcatggatgtccatcagcattgacaagacgggagagaatgttccgtctgatctatgacagcaaggttcgttgtgctgtacatcgtattacactgaggaggcaagtacaagtgtgtgaaagtgagaaagatcttctgtgggcacaaaaggaatcgctcatctggtgactcatgatgccgaacatccgtaccgatcccctccatcaaggtgaaatgatagcatgcagatggatttggagactgaaaagattagtgattcatccaagttgcgaaatggtaactgtgtatgggtgaatgagaggtgtaactagggaagaatgggtgtgatcaccaagagagaggaggacctggatctttggacgtggtgcacgtgaaggattgcatgagaaaggtctggcatcgattcagattttggatgtgggagggcacaaccatggtttcttccgggaaggttcgtaacaatgtgaaaaagcaaagggggggaaaaacgggaagggccgggaaggattgggcgtaaaatgggggaaaaaaaaaatgggggcgaaataatgggggaggaaagaagcaaggggggtgacg

SEQ ID NO: 521034 - DNA, 372 bp, Homo sapiens
gtgcaatcaatcgaatgctaggcttggtttaaaaacaaatcagttggccgggcacggtggctcacacctgtaatgtcagcacgttgggaggcaaggcgggtgaatcacgaggtcaggagatcgagaccatcctggctaacacggtgaaactccatctctactaaaaatacaacaattagccaggcatggtggtgagcacctgcaagcccagccactggggaggctgaggcaggagaatcgcttgaacctgggaggcgaaggttgcagtgagccaggattgcgccattgcactctagcctgggcaacaagagcgaagatccgtctcaaaaaataaagaaaaatgaaggctcactgtcaaacattttcacttaa

SEQ ID NO: 521035 - DNA, 129 bp, Homo sapiens
tacgtctctagcaggatccccggcggttaaagttactgaaagcacgtgtgagttttcgcttgagccacttctgggtgtcagttagctttcttttccttgacaggcatcacatcacagaggtgataatca

SEQ ID NO: 521036 - DNA, 717 bp, Homo sapiens
  misc_feature (43)..(43): n is a, c, g, or t
tatgctcgtgtgttgtcctggcgttactggttgggcgtgtttnttctcttttacaaaccaagaggaagctagatgatgccagcaaacgtttggagtttctgtatgataaacttagggaacagacactttcgggacagtgaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatcagattaaagtgtgtaatccta

SEQ ID NO: 521037 - DNA, 1253 bp, Homo sapiens
agaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagccctgttgcttcctcgtacttcacacgctatatgacgttggtaccgagctcgatt

SEQ ID NO: 521038 - DNA, 211 bp, Homo sapiens
acacaatctaaaaataagggacagacccgggcgagagaccattgttatatccacatctaccctcatttccaagagccacactacattacccaggaacctctggagctgagtcccgtatacagactaatcctgtcttcatagcagcacatgtgagcaatgtccagtatactcattaaatcatattgcttctgaagcaagcggactcgtcaat

SEQ ID NO: 521039 - DNA, 501 bp, Homo sapiens
gccccccgggttttcccttttatgtttcgggttggtatgttggggggaattgtgaggggataccattttcccccgggaaccagttatgcccatgtttcccccaagttggaatttacccctccttaaagggaccaaaagttggggttccccccgggggggggccgttttaaaaataggggttcccccgggctccaggaattgggcccaaaaaaaaccagttttttcaatacaaaaagaccggggtacctccagccatgatgggggagatgtttaaaaaggctcatgttgttataggagagaatccggtttatgaaaaaaagcccaaaaaaaaagttaaaaaaaaggggtggacccgtcccaaaatgtcccttgctcaaaaaaaggttggggtagctcaaaaaaaggcaagtttcctcagagttcaggagggggttgttgaaagttaaccccaccatttttttatgtttttttcagaaatagataataaacttaggacccgca

SEQ ID NO: 521040 - DNA, 285 bp, Homo sapiens
taacctgcacatagtacacatgtaccctaaaacttaaagtataataataataaattaaaaaaagaaaaatatataacaaaaaaaaaaagaagttctacctctggctgaaggccaaccaatgcaggccatacaacaactcataacagaacaccattgctccaaagcaagaggaaacaacagctaatcccactgtttgcaacatcctggctaaccagagtttctgagtctatctatgtgacactttcactgctagcaaaactagcatttgaggtaacatattacggt

SEQ ID NO: 521041 - DNA, 372 bp, Homo sapiens
  misc_feature (91)..(93): n is a, c, g, or t
tcttggtggtgctctctctctatactaatctttatacaaatcttcttaattataacattcacagccacataacgagtcgtattttatatcnnntaacaaaccacacttatccccaccttggctatcatcacccgatgaagcaaccatccataacgcctgaacacaagcacatacttcctattctacaccctaataggctcccttcccctactcatcccactaatttacactcacaacaccctatgctcactaaacattctactactcactctcactgcccaaaaactatcaaactcctgagccaacaacttaatattactagcttacacaatatcaggttcccatcttcaatacataatcatagtcataact

SEQ ID NO: 521042 - DNA, 671 bp, Homo sapiens
tgcagcttgctgctgcggtgactctaaggatccccgcttcctgcttctgccgcttcctgcgtctgccgcttcctgcattctgctgcgttcctgcttctgccgcttcctgcttctgcctgtaatagtgatgaacaagattaaatggaagttgaagaccagggagtagtatagaagccaaataaaaccaaacatcataaatttagacaccagtctgccgacatcacatactatacctaggtgctgatatggaagaatttcatggcatgactttgcacgatgacgacagctgtcacgtgattccagttcttccacaagtgatgatgatcctgattcccggacagacattacctcttcagctttttcaacctcaagaagtcagtatggtgcggaatttaattcagaaagatagaacctttgctgttcttgcatacagcgaatgtacaggaaagggaagcacagtttggaacaacagcagagatatatgcctatcgagaagaacaggattttggaattgagatagtgaaagtgaaagccattggaagacaaaggttcaaagtccttgagctaagaacacagtcagatggaatccagcaagctaaagtgctaaattcttcccgaatgggtgttgccttcagacatggctgcagttcaattagaatccctcaataagt

SEQ ID NO: 521043 - DNA, 231 bp, Homo sapiens
cagtgttctgtagaaaacaaaacaagtcagagaaagaaaaattacctattacctatggcacatttctgttacgtcaagtctgggcttcagccctgtgggtcctgttaaggctctttttgttctgtatcaagcaggagtgtcttgagtgtcttactaatccccatacatcatgtctttgaaatgacagaagtcccatcctttgtggcccgtgcagtattctgctattggaac

SEQ ID NO: 521044 - DNA, 644 bp, Homo sapiens
  misc_feature (6)..(6): n is a, c, g, or t
  misc_feature (49)..(49): n is a, c, g, or t
  misc_feature (67)..(67): n is a, c, g, or t
  misc_feature (75)..(75): n is a, c, g, or t
  misc_feature (102)..(102): n is a, c, g, or t
  misc_feature (104)..(104): n is a, c, g, or t
  misc_feature (116)..(116): n is a, c, g, or t
  misc_feature (123)..(123): n is a, c, g, or t
  misc_feature (326)..(326): n is a, c, g, or t
  misc_feature (328)..(329): n is a, c, g, or t
  misc_feature (350)..(350): n is a, c, g, or t
  misc_feature (358)..(358): n is a, c, g, or t
  misc_feature (433)..(434): n is a, c, g, or t
  misc_feature (454)..(454): n is a, c, g, or t
  misc_feature (535)..(535): n is a, c, g, or t
  misc_feature (557)..(557): n is a, c, g, or t
  misc_feature (633)..(633): n is a, c, g, or t
tattangagcgaatcgatgagtccagccactgtaaacatgcccccaatnatggtgcacacacctgtnaggaagtnggtgaaggacctgtacttctccgtcancntcaccatcatgngcgaaanctcataaaggacgaagactccgggaaggccttggtctgcccaacagcccattggcaaccttctcatgtctggtcacagagaactgatttgtcctcagtacctctccgtccaccttcatgtacacagtgggcaccaccttcacaaagtactggaacatcatggaggcttggggcgcagtgacattggtgtggtccagggggttnannttttttttttttttttttttntatgatangtgctggatgtagtgggtcatgttgatgttgtcaaggccaaagctctgcaagtcatggacgtgcacatgggactnntggaagctcttcccaggggnaaagtggaagtttccggccaccttattgacttccaagaagccatacacctggcagccttcattcttctgctcctgcatctnctggctgaagcctctcgccggnactgctcaatagtatctgggttcttgaaggcccagcctctacggcgatatgcctcccgcacatcttcacaggtgtnacagcacttga

SEQ ID NO: 521045 - DNA, 406 bp, Homo sapiens
tccaggaggagaaccaaaaccttttgctagaaagtcagctattactttgagaaaactcatggccttgtagttgagaggcaggttttaagacagcgcttggggatcgatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttc

SEQ ID NO: 521046 - DNA, 117 bp, Homo sapiens
ggggggcggagggagagcaaatggtctctctccaaacctgcagtcagtgctcttggaccggtctcacagacagcacatattctacgtcacagctctgccagtgggggggggttacct

SEQ ID NO: 521047 - DNA, 199 bp, Homo sapiens
aactaattctcttttcttgtctgccgccatgtgagacgtgcctttcaccttctgccatgattgtgaggtctccccagccatgtggaactgtgagtccattaaacctctttttccttataaattacccagtctcaggtatgtctttatcagcagcatgaaaacagactaatacactacataataaagactaaaattcaaa

SEQ ID NO: 521048 - DNA, 213 bp, Homo sapiens
tgacgctggtaccacagagttgctcgtagcccagtgtgagtgcagtggtgcatctcggctcatcgtaacctctgcctccccaggttcaagtgattccaagccatggcttgtgcctctgcctcctgagtagctgggattataggcgcaaccacacacctggcgaattttttttttttttttttttttttttttttttttttttttttttttttt

SEQ ID NO: 521049 - DNA, 730 bp, Homo sapiens
agcgggagattcctgcaggttcgagaaagcatgagatgctcccagaatcctggattggacttcattctggagagcatatgacaatggacgaggaccccgtattctagccagttaatacgctggacagaatttttaaaagcgatgaagccagttcctatggatatatccacgggcttgcgtttgagaaggaactgagtaggcagtgagaagagtcgagtgaagcctgggccgtgagtgacgcaagaactgagaggaacgtcgactcgcgtgcaggcaaggttgtcacctcagcagcgatctgagacgtgaatatccgggttccagaaaaggcagaggttcttagccgaaagcagcggaggaagccgcaggccaaggaggtcagtcactggccaggaaggtggctcgggccaggcggcactgcaaaacccggtgctctggtgtcgacactgatgacgggggcagagccaaggaagcttccacttcttccccacagacagtgcctaacagcggatatccaaaggagccagcagccattgtgtcctgggatccccagtcgcctggagaatgacccacgcatgatctgagcatcacagacaaactcatcaactggaggtgtagcagggcgcgagggggtgacctggcgtgttccccatgcgagttggccaagactcgtctgcagaaccaggatggggaaagccatgtacaaaggaatgatcgaatgcctgaatgc

SEQ ID NO: 521050 - DNA, 187 bp, Homo sapiens
gtttgcagtgagccaagattgtgccactgcactccagtggcactccagtgcactccagtggctctgggtgacaaagcaagaccctgctctcaaaaaatatttttttcttattatgaactatattttcctgactgctttgcatgtgtagtgccccttgatttcaagagtgcagcatctgagcaatgaa

SEQ ID NO: 521051 - DNA, 448 bp, Homo sapiens
  misc_feature (10)..(10): n is a, c, g, or t
  misc_feature (45)..(45): n is a, c, g, or t
  misc_feature (89)..(89): n is a, c, g, or t
  misc_feature (95)..(95): n is a, c, g, or t
  misc_feature (106)..(106): n is a, c, g, or t
  misc_feature (143)..(143): n is a, c, g, or t
  misc_feature (254)..(254): n is a, c, g, or t
  misc_feature (398)..(398): n is a, c, g, or t
cccatctccnagaaccctgtgaaatatgttacccctacgtggaancaaacaactttgttgacataattaatgatctttaagatgaggcnatcatnccctggattancctggggaggctcaatgtaattcacaagtgtctttanaagagggggtcagggctgggcttagtgctcatgcctgtagtccccaggactttgggaggctgaggtggttggatcacttgaggccatgagtttgagaccagcctggccaanatggcgaaaccctgtctctactaaaaatacaaggaaattggttgggcatggtggcacgcacctgtaatcccaactacttgtgaggccaaggcataagaatcgcttgaacccgggaggcaaaggttacagtgagccgaggatttngccacagcactccagcctggatgacagagtaatactctgtctcaacttac

SEQ ID NO: 521052 - DNA, 187 bp, Homo sapiens
ctcggtacccatccttcctctctacggggaactgtttttttagacggagtcttgctctgtcacccaggctgggatgcaatggcatgatctgagctcactgcaacctctgcctcccgggttcaagcgattctctcgcctcggcctcctgagacagggatttttttaacaacgtgagagaggtaaggat

SEQ ID NO: 521053 - DNA, 409 bp, Homo sapiens
atgggtgctcctcccctagcaatacttgcccatcttttaaggctcaactcaaagattactgttatccctagaactttccctgacctgagttgaactgtcctctatgactctaagaagctcttctagtaccagacctaacccactggtaggcgtttattgttcctatgctttaagtgccatgaagccagcatccttgtgtgagtatggattaagacctttttggcattttatttaatgaatgctggagagctataaatacttccgaatagttctgcatgtgttctttatggctaatgcattgggtatgagtggcaagaggtgaggctctagacagggaccaacctagtttggaccttactgtagtttgccaagatgttcattttttttaaggtggggggatggagcaccc

SEQ ID NO: 521054 - DNA, 459 bp, Homo sapiens
aaaaataccaaaacacggggcaaacttggatccacacaaaaaaggattgttttaattttattattcccaaaaaatcaagcccatcatgagtagcccacatggttgctgttcaaaggtactgaaaagggaggcattggttcaccattacccatcagggaactttttacagggatgggttcaaaggccttcgtgctgcttttgggaattcagggactgcagttttgccccaaaagccatccaagatgagcaagggctgacccatccttaactcatacctagatgaaacaacttgcgcagaaacgctggtcctccccagtaaccccttagcatcatattccaatacaggaaaggcatcaggtcagttttaatgaaatacatggaaaggcgctttttgttttgtcaaaggggaaggtttctagcggctctgcttttgagtcaaactcaacaagaatcacacgg

SEQ ID NO: 521055 - DNA, 1859 bp, Homo sapiens
  misc_feature (326)..(326): n is a, c, g, or t
tggcttcaaaaagtctttattcccattgggcccaaggtcttgtaaggatatgttaaaaaagtctgcctatggggtggagggagaagaaggctttaggcaagaacgccctatatttactttgtgacaaggggggccctttacaaaagctccgctgtgggcctcacaaaggctctctttagctcggtgcttgtagaaaggtgacgccttttcagaaagaaatatactctccgccacagacccagcagctctctctgggtgagccccacacccagcagtcactgtgtgtgagagagagtgtgtggccagaggtgtgtgtcgtcaccacncacactctcttctctgtgtgagtaaaagagactctcctcaaatatctctctctctctactctgtgagagagagagtagtgagagtactgcatctctcagagagagagagttcttcacaacagagagagagtagtaagggtggctccctgcgtgacggtggacaaagaacaacccagagagggcgctatagtagtaaagatactctcacacagagaaggcgccagtaggattctcaacagactatatatatcttcttctccacagaggggcgcccagtagtgggagagaagactctctctcatagtaggcgagctctgggaggggggtgctatattataacccccgacgcatctctctatcatctatactcgaagacgtgttgggcgtatctcgtagagaagagatgtatctcctcgtgagaagaaaagagaagagagagcgcgaggggtgccccgcaccaagacgcgctgtgtgctgatattggtgtgaaatacatcttctctacgacgaggaggagaacagcagctctcttcgatgataagcccgcactactcgcgacgcgcatatcttctctctctcgggcccacaaaatatctgcggcgggaaaaacagagtgtggggcactcaaagcgccctacaatctcaacagagatgcgcccacatatactacaattgcgagcgagtgctccacagactatattagaaaaaggcgctccccaagatagacacagaagcgtatacgagggttgtcaacgcaacaagagcacacatcatgtgagagccagacaccaccaacaaattgttgtagccaaccccaaggagactggtcgattcaagcaaccgagagaagagttgacgccccacccaccacaagaacagacagggggagaggagacacaaacaaaacttactccagagggcagagaaacaccacctgtgggagggagaagaccccacccaacggggtgagcgagaggagaatatgagcggacacacccaaacacacaggaggaaagacgtatatatcaccacacacaaaaaaacaacaaaacgggagggtgcaccagtgaggcgaagtagatcgttcccactacaagaaacaagcagcacggtaaacaaaattgtggcgcgcagacaacaaatacagtatgttgggctccccctcagcagacaagatggatcgtatgcaaacacccgtcgggcagagaactaagcaaaacagtgcgagaggaggtgaagagaaccaagaaaagtgagctcgtgagcaaaaaagatattccccccgcgggaaaatactgattacccggcacgcacaacagccgctgtcgtgagcgaacagctcaagacaccaactactccctcgtggatccagaatgatttgttgggtgcctcccacaccaacaaacagtgagcgcgcacgaagacatagaccacttaacgtagacaaccaccaccaatcatattactacgcccatcgatatagttatgcgtaggtgaaggtcctacacacacaacagcagtggagtgtattaa

SEQ ID NO: 521056 - DNA, 220 bp, Homo sapiens
ccgccggctgcccccccccccaccctgtttgctgtctcgtgcagcccctgcacgggagctccagcttgttgtcagcgggaagggctatttcaccataagcaacacatcacactcacacggggcttggttcccgtcccccgttcaccattctcaagagtcccccagcttggccgcctgccccctgcagagccttaggttgttccaagcgacaggggccccg

SEQ ID NO: 521057 - DNA, 1118 bp, Homo sapiens
ttttttttttttattaaataaaagttttgcttttatttaaaataaaatgcttttatacagtctttgaaccatggattatttgaacaattacttggttaattccaccttcttcccttcgcacccttttggggctattgtgagcttaggaatttttctgactagcaccaattacagatttgtaacagcgcaacagactagaacatgtggccagttccaggcatttagagtttaaggaccattgtggtggccaaattcatgtgattcattaagtgaagttcatttctttaattttagttagattttttaaaactgtgcacgtttaatttattttcttctttaaaggccattttaatttaacgcagaagaattgcttacattttaagccattcgtgcttagttgtggtgagttgagtttttaaaaacactgtgtgtacaatttttattaaacattctggtgtgttttttcactattcatgttcaccaccaaatatggctataactctcatagaacatctttcacttccattattggtgacatggcgaaagaatgttggccatttattttaaggcgcagcacccagcggcacttaagtgcggggggtgcacactcaccttcaaagacggtggtaatctcaccaattacgtgcggtgctcacacactttttaaaaagaccccggaagaccacactttttccccttttactcgtgcgtttattttcagagcgggcccaaaaatacccattttcaaagccacgaccggaacttataataagccattttttcccctctccaaggcggtcaaaaaccccacatctggacccttttctctaaagttattcagggcctctcctgcaattgcgctgaattaaatcgcggggggaggagaagagggagaagaagaaactttacaagggggggactacccccgagaaggctttcgcgcaaatcctctctagaaccccgtgttgtatatctccactttataaccacaattatctgtagtaaacatcccacagtgtcgctctagacccgtggctatactacacacagggtcatatattagggggtgagcaccccctgattagtacagcctttataaatcaaaaagggggcgagta

SEQ ID NO: 521058 - DNA, 800 bp, Homo sapiens
ctccaaaacaaaacgaaaaagcacacacacatacagaaataaagagaaataatcaactagaaaaaaaacaaaactgggatcacccagaaagagcgtcacacgaggcgagggagaatgaagcctcttgttatcctgatcgcctatgacaacgaacattatctatcctcttctttgaagcgcaggttcttactcttaaatctggtcgatacaagctgtaggcttggaagtcctgctcgtgtctattgaaatcagctgaagttagtgttttcctgtgttacccagtgttacatagtctcatctttgaacttgtctgcgtcaggccttctctctgttgggaagtgctgcgctgtttcgtgtctaacttattctccctggtgtcggtgtggctggtgagagtctgtgctgaagcccgatctgcttggttcctccaagtgcacattcatgcaagtgtatatgggatagactagggtagatgcccggaacgtggttttcctcctccctccctatgggagccatagctcctaaatatattgtctgggtcccaaatgttggagccctcttcctctgactctcagtgggctgctcttggcatgtccctgtgcttggaacagggatctgtcaggtctgaacaggcctctgagactgctagggtcagcaaacgtacatgttattgggaaactccctttcccctttaggtgagcttctaacaactcagtctaatcgtattgacctgaagagcgtattgtcctgactgaaaagctaagatcttttaatagtgtgagctgttagatacttagggg

SEQ ID NO: 521059 - DNA, 123 bp, Homo sapiens
agaatgctgggaaataaggcctgccatcgctcccacctgctcttcatgaggagtcctttattcctgcatgtttccgtgttctattgggacctttacggagctaacctcgccacaaatgcatgg

SEQ ID NO: 521060 - DNA, 1137 bp, Homo sapiens
  misc_feature (122)..(122): n is a, c, g, or t
  misc_feature (348)..(348): n is a, c, g, or t
gaccgaggtctcagatgaatgggggtgtgaaaaactgcaagaatccagaaatgtgctactcgtgaatcgtatgttgatgatagcgtcagaatgtggagataccaggctacccgatgattggntggcctaagagtatgtggctgaatgactggaggatctgtgtactcgttcgagaattctaagacgtcctctagtatgcggcagatactcaatagttgtcgaatcaccaccggtctttggaccagaagagcgtgtcggatgaccccaaccagctcgttaaccctaataagactatctagtagagaggtgtatcgcggcaagcatggtgcatgtgagagactaacatgnatgagaagatctggtagacgtagccatacgggcataccccgtcagaagcaaagaaagagcccaaaagacttttgctgacctaataaagcattgacgttgaagaagactagtttagaggcagataaaaagctctagtatcctggccatccagatcgatcgtgtgtatcctacgaaaatcaagaataagcttcttttacccctgttcattatatctgctgcagaactttgtagaacgagtttgttagacgcttggcgcgtaggataggagctactctatgtaatcctgccggccaagctccttaaccagacgtatgaagggttgaggaaaggtggtccctgcttgcaactggaagttcgcctttcgaaaacagcaagtggacggagggtaaggtaaaagctttcgaaagataggagggacttggtgttttcccaagagcgttgtgtggggctcgctccgcccctttttcaaccgcttgagtggaagaaagaattagggcacccgtaaattcggctacgcagtggggggaaattccgagagatacctggtgtgggagggtgtacttcccgttgtccaatggcaattgacctcggttcgagcgcgcttggggaagtgtctgaaagtttgaacgctagcctgggtttgggttggtggagaattagaattattgttgagaagttgtcgtgtaaagttgactatccagaaggttaggagggtagtagttatggaattgtaatttaagaaggtatttcttgttaagtgagggacatatgggataactagggacgtgg

SEQ ID NO: 521061 - DNA, 403 bp, Homo sapiens
ttgccgttctcacgatccaacgtcgaccaggttgttacaggacaggataccttatgacattcaggtatccctgcaattagtacaagatgcgagtgctcattgagcgcgcacatgctatcactgtacagtattgctgtggattacgggaggtgacggccaagagtatttctgtatgtggccagattcctggcaaaggcctacatgttccacagcatcttcgactggccagtgctcagggctcttcacttttgcctcacagcaaggtggagtccctgagaagagtttaagcacagtgcttaatgtgactgatagaaaccttgtggtatctctctggcttcagtgtgtagaatgatgggcataattaagctggcatttgttccattgcatgattccgtgtatatta

SEQ ID NO: 521062 - DNA, 442 bp, Homo sapiens
gctgggcaatggcatcatgctgttgagagtgatggccaaagttgagttctgtcggagagtctcggtcacaccagggattgctgaatggccactcccatggcggacattgatctgttcgacttcatgagcgtcagagtctcggtcagtgcacgcgtggtcagaatcagtggctcagcggatgggctgggccctctgcaaatgtgtgtacccgtgacgaggacatcacgttccggctctagccgatccaccatggtcctaatgagctcccagaggagtgccgagagcgtggagcaggtcttgcgcatacacaggctgaggtctgtgaccacctggtcattccggctccgtccccgtgtgcagcttcccttgcgtttgcacaatgagctccttcaggcggcgcccattgggtttgtggatgtcttcatcattggagttcagtttg

SEQ ID NO: 521063 - DNA, 88 bp, Homo sapiens
gccgcctactactactaaatttgcggccgcgtcgacctgggactttaagtgtacaccactgtgcctgctttgaatcctttacgaagag

SEQ ID NO: 521064 - DNA, 112 bp, Homo sapiens
ctgtaatctcagcactttgggtggccaaacaggaaggatcaacttccggccaaggaattcgggaccagcctggtcaacatagcgagatcccatctctacaaagagttaaaaa

SEQ ID NO: 521065 - DNA, 111 bp, Homo sapiens
gttgactctagaggacccctgcggatacttgatacctagctactggaaagtctagaggcagaaggattgcttgagcccggggaagtcaaggctgcagtgaactatgatcgt

SEQ ID NO: 521066 - DNA, 1250 bp, Homo sapiens
gctaaaaatacaaaaattagccaggtgtggtggcgcgtgcctgtaatcccagcgtacccaggaggctgaagcaggagaatcactggaacccgggaggtggatgttagcagtgagtctgcagtgagccaagatctcgccactgcactccagccggtggtgacacagtgacgactctgctgggaacagggctggggctggcgaagagtgccaatacattagacaatagctagggcaaggccagggcatgctgcgtcaagggcgcgggatgtcgggagcagggcggggagtggcagagtagatggccaagtgacagtacagaataaaaaggatgttacgcaatattgaaacaaactagtgtctcgttatcactcgtgagcaataccggttggaaacatggaaatccgataacatgtaaaaaactgcaaaagtcacgtcagatagtagacaaaagaggtaagaagtccaaggaaagctgtatcgcatataaggcgattgaagagagtgagaccagtggaaagtggcgcatgggatcgaaaaagtgaagcacagaggaaaacatgaatatgagtcaataaacgcaatgtaagtgcaaaacgtgggatagtgaggcggttaacaagtcgaggaaaatcataagaatagagaggaaagtaacaatacgtagtacgttagatagtaatacgaggcatgataattaatcggaagggaaaaggaaagacaatgaggaccttggatttcgattgatggattgcatgtagccgtgaaaaaaatgggaaaggggaagactgggtagacttcgttgacgcgaggtagaacagtcgaaccttaaaccagcaaaacccaaagacaatatgagggattacagacacgaaggactacgccagagcaagacatacatcatacgatggtgtcaatacgatgaaacgccataatcattatcaagccgaaaaccatacaaaccccaagaaagtggatggctgcaacagcccagggacaccacagaggacatccccagacgagaatcgaccaatcagaacgggcagaaacagacaaagcagagacaacaaacagcccaggcaaggggacagcaagaaccaaaagcgcgtggacacgacagaggaccagctaaaaaggaggacgagaacagcgccatagcgcaagggtgacagaaacgaaagccaagagcgggaagacgaaaggagaaaagtagcgacacaggagacagcggagcaacagagggcgaagccagg

SEQ ID NO: 521067 - DNA, 817 bp, Homo sapiens
  misc_feature (173)..(173): n is a, c, g, or t
  misc_feature (183)..(184): n is a, c, g, or t
  misc_feature (188)..(189): n is a, c, g, or t
  misc_feature (192)..(192): n is a, c, g, or t
  misc_feature (201)..(201): n is a, c, g, or t
  misc_feature (206)..(207): n is a, c, g, or t
  misc_feature (223)..(223): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (242)..(242): n is a, c, g, or t
  misc_feature (335)..(336): n is a, c, g, or t
  misc_feature (342)..(342): n is a, c, g, or t
  misc_feature (350)..(350): n is a, c, g, or t
  misc_feature (353)..(353): n is a, c, g, or t
  misc_feature (362)..(363): n is a, c, g, or t
  misc_feature (367)..(367): n is a, c, g, or t
  misc_feature (375)..(375): n is a, c, g, or t
  misc_feature (378)..(378): n is a, c, g, or t
  misc_feature (380)..(380): n is a, c, g, or t
  misc_feature (382)..(382): n is a, c, g, or t
  misc_feature (384)..(385): n is a, c, g, or t
  misc_feature (389)..(390): n is a, c, g, or t
  misc_feature (413)..(413): n is a, c, g, or t
  misc_feature (420)..(421): n is a, c, g, or t
  misc_feature (434)..(434): n is a, c, g, or t
  misc_feature (448)..(448): n is a, c, g, or t
  misc_feature (451)..(451): n is a, c, g, or t
  misc_feature (459)..(459): n is a, c, g, or t
  misc_feature (471)..(471): n is a, c, g, or t
  misc_feature (478)..(478): n is a, c, g, or t
  misc_feature (483)..(483): n is a, c, g, or t
  misc_feature (485)..(485): n is a, c, g, or t
  misc_feature (498)..(498): n is a, c, g, or t
  misc_feature (500)..(500): n is a, c, g, or t
  misc_feature (502)..(502): n is a, c, g, or t
  misc_feature (510)..(510): n is a, c, g, or t
  misc_feature (513)..(513): n is a, c, g, or t
  misc_feature (518)..(518): n is a, c, g, or t
  misc_feature (549)..(549): n is a, c, g, or t
  misc_feature (552)..(552): n is a, c, g, or t
  misc_feature (575)..(575): n is a, c, g, or t
  misc_feature (578)..(579): n is a, c, g, or t
ggtggttagtttctgcgacttgtgtgggactggtgagtgtgggcagtgcggcccctgcggagtgaggcgcggcgcgccttcttgctgttgcctcttcctcctcctgtccggggcccgcccggctcggtgggggtgctgtgatgcgtgaggcagccgggggaggccggaggtcngaggacttgnntganncgntgcgcaacnccctnntcgtgggccccccacngtaggtncnggnaacctgnttgaaccccaagctgataggaagatgtctcaggaaatgctaaaattgggcacccttgcccccaatttcaaaagccacagctgttatgccagannggtcangttaaagnatntcacgctgnnttgnctaccaanggnanantnntgtnngtgtccttctttaaccctcttgnattcacnntttgtgttgcccnacggagatcattgnttncagtgatngggcagaagacnttaaganactcnanttgcaagtgatgngngnttctgggnatnctcanttctgtcatctagcattgggtcaatacaccntangaaacagggggctgggaccatgnacnnttccttggtatcagacccgaaagcgcaccatgtgtcaggattatggggtctaaaagggccggatgaaggcatctcgtcagggccttttatcatgcggataaggtatctcggagattatgaatgactcctgtggccgtctggggatgagacttgaactagtcagggctcacggtcctggcaactgggtgtccgtggtggactgggtgtcccatcaccttgtccagggagaattttccca

SEQ ID NO: 521068 - DNA, 859 bp, Homo sapiens
ggtcgtgattacgaatcaataccatatagacccaatagacccactgaccagagaggcactctctgcagtgcgctcgctaatgtacttgcgctggtgcattggcgcttagggttgagtgtggactctctcatgtcaacattaattgagtcgggtctatcatcttaatcgtccatctttgaagctagcatggtcaaaccagcatggccattgtagtggcagcgccatccgtccacactgaggaacaatgtgtgccgccaccgagctgaaacagtttccacgcatgtctggagtgcggcccttggggtactggggacttgtggtcatctgttttttagtgtccatcgattgggcatctcatgtttgcattccactctagccatcgtggctgtgtgccactcgttctactcagctggcaattgtacgggtggatggagttcttttcagcatgttccttctgtatgatacccagaacagtaatcaaggcgtgcatgaagtatcaccaatgtatggagttcaaaacatatgatcccattcaactcgatgctgagtatctacgtggatacattaaatatataatgcgaagttcgcaactatgcgtggtcaactaggtaggcacaccagcaaaagaaaatgacagtgctctcagcgttgctggcttctctgctacatcaaatatctttgtggactggggcacgatatgcctcacaagcacgtcggtacaagcagacttcgttggaggttaccaaagatacagacaattgtctcatttgaattgtcctgtatgtgagcccagatcgcgtggttctggacgacaactggagaagtctttccaaaaagacacagcttaacctcacggaaa

SEQ ID NO: 521069 - DNA, 213 bp, Homo sapiens
ccaaagaataagacgcggtccttgacaagccctcttttatacagaggaggggaaaagggagaagacaaaatttctgtattcataacatttactacaatctagccagggaaacaaaatttaattcactttaattcctcaaatattaaatatgttttgtgtaaaagggtagttttcaaatcttgatgagtagaatcaactatgatgctttctgga

SEQ ID NO: 521070 - DNA, 345 bp, Homo sapiens
  misc_feature (1)..(1): n is a, c, g, or t
  misc_feature (44)..(44): n is a, c, g, or t
  misc_feature (134)..(134): n is a, c, g, or t
  misc_feature (254)..(254): n is a, c, g, or t
nactggccatgtgccacccacacttggataaatttttgtatttnttagttagagacagggttttcgcccatgttggcccaggctgaatcgcggaactcctggcctccaagtgatccacccaccttggcctcccnaaagtgctgtgattacatgtgtgagccatcacacccagccctatttatccatttcttctgggttttccaatttattggcatatattgttcacagtagcctctaatggtcctttgaatttntgtggtattggttgtaatgtctcctttttcacttctgattttatttatttggttattctctttttttcctcactagtctggctaaaggttt

SEQ ID NO: 521071 - DNA, 168 bp, Homo sapiens
gggggggaccccccccgggcccccccccggggtggtttttttttggccccccttttttttctgggtcccccggccccctggggggggggtggggggggccccctggccccccctttgggtttttgggcgggcttttccaatttaaaaaaaccggggtttttttcccca

SEQ ID NO: 521072 - DNA, 153 bp, Homo sapiens
cccttggcaactacaattctactttctgcttctatcatttgactactttagatacctcatgctcacagaagggaggcaggcacagatggaaaacgttttctttcgtcctctctaccagtacgctcccgcctgccgcgctccgccttgtgcggc

SEQ ID NO: 521073 - DNA, 706 bp, Homo sapiens
ctttgggccagggtctccggagagcatgagcgtggtgcttcatcggcgctggccagctggcttttgccctgtgccaaggtgcttcacagcagcaggcgtcattggtagcccacaatgataagtggctagctccccagacatggacctgtgccacagtttctgctctcaggaatgcatggtgtggtgaagttgacaccccacaagaaggagactggtgcagcacagttgatgtgctcttcctggctgtgaaggcgcacacatcatccccttacatcctggatgaaataggcgccgacatttgaggacagacacattgtggtgtcctgcgctggcctggcgtcaccatcatgctccattgagaagaagctagtcagctgtttacggctcagacgccccatgggtcatccgctgcatgaccaacagctccagtcgtggtgcgggagggggccaccgtgtatgccacaggcacgcacgcaccaggtggcaggatcgggaggctcatggagcagctgatgagcagcgtggtcttctgcacggaaggtgtaagtaggactgataggatggcgtcacgggggctcagtggcagtggccgactacgcatacaaagcctagattcactggctgatgggggtgtaaatgggactccaaggcgctggaaatcagctcgggccatgcctcatggggtgcaagatgtgtggaccagaaa

SEQ ID NO: 521074 - DNA, 870 bp, Homo sapiens
tacaacccccgacggcctcgagaaaggcccctcctcggacggcagccagggccgaaagacacccgggctgcgagccacgtacaaaggggggcgagcacgacgcccgagcctctaccaggcgcgccgggtctctctcttcgacaagccgccacgggtcaccccgaagggggctccccacctattggtcgccccgggcgaccacgcccgctcagggcgcgcacacagaaaagcgcactcggccacgcccacgtccacagtggtcgatcacacacacgcggcgctcaaacgcgccacaacaaagccggtgggatagcacaacagagggcgcagcaaggcacgcgcctaggtgcgaaggataactcgcgcctcacgctgggccaaccgcaccagcgctgctctcccactctgtgggaaatctcgaccccacacggagctgtgtatggggcgccacccctccgacggagtttgcaaacacccaccgctctacccttgcgagcgaggggcccacggctggtaggtttcgaagcatcctccacctccccctgcgcgcccccgtcggtcatgcgtgggcgccgatatgtgtaggataccctctctccgagccttgtcgccgctctcttggcgacagaggatcacgcgcgggcttccccacgttctgcggtcctctcgcagcccttgggggtcatggcaaccgcaccaggctcctgcgccctctcagggttcagggatccccgttgtgattgcgctccgcccgactcgggacgccgtctgtccggtgccgacccggcgacaccgggccccctcgtcggttgttctcgctcatgtcagcccacagcggggaactttgcgcactgtcgggccaaaccacat

SEQ ID NO: 521075 - DNA, 194 bp, Homo sapiens
cccgcgctagcggtaagtgaacggaggcttgtaaaataataatggctgtgatctctaatttaaaaaacctatactgaacagatgtatatatcaagtaaaatgtcaaacaaatataaaaaacacaactactcattcctaatatcagacactggctaacactgtcctgacatgacgttcacttaatgccgctagcg

SEQ ID NO: 521076 - DNA, 311 bp, Homo sapiens
  misc_feature (38)..(38): n is a, c, g, or t
  misc_feature (44)..(44): n is a, c, g, or t
  misc_feature (159)..(159): n is a, c, g, or t
tcttattttaaatccctgtcagccagaatggatatatntctgtnacagggacaatgaaaaagacatagaataaagggaaatttaggtaaatatccatttcaattttcaaagatactctgcaccagagtttcagcttgctgaaatacacaaccttgactncattctttattgtttttagatctttattggaggaggtgtagcttttaattataaaagtgattcgtgttggttgtaaaaaatgtttttagctaactgttttaaaagcttgtcttggccgggtgttggtgtcacgcctgtgatcccagcacttt

SEQ ID NO: 521077 - DNA, 944 bp, Homo sapiens
gcagaaggcccggtgactccagtgcctgggaagtcaaccgagctcgcttccaggtcaatcgaaactggagctcaagtttgcatgaagagaaagacgccccagcaagcctctgttcggggagtcgctctcaggctcctcgatcctgccatgggccaagacaggtctggcagggggtcgtgcagctaggcatcccccacgccataggcgtctgtacccttgacctcttctgtcctcgagggctttggtaagagctgctgtcatgcaccctcgctcacctgaactggtggtgcctccatgcggtcgccgacggattggaaccgccaaagactgttcgagagaacatcgaggtcgaaggaatggagggttgtactttgagtcggtggcccgtggaccatgagcactgatgcggtgcccggggtataggaggggctaattcaagggggccttgcaactccctggtgagatctagctgtgcccctggagcagagggggacgcgatgctccgtgggtggtgcggttgggacgagtgggaacctctgccccccagtttggcacgacttgtagcacactactgctgtgccgcctgcttggagcgcggaacaagtcgtaggtcgttggaggtgtgcgtgacatcggggttcggggggaacgtcttgtttcattcagagttgggtggccgtaggccccccagtgtctacgttggggaatcgtcacggtgagtcgggcggggggtgccagagagactgctggtggttctggtaaatggaggagggactctgggctacgcaatcggggggggctggctggggccagattgcgggacgatcggtagacctctaccggggggagggctgctgggccaagcaggtgcggatcggccggggcaagagagggcccctctcgtggcttggcccttgtttggcagcgggaaccgggcggttggg

SEQ ID NO: 521078 - DNA, 151 bp, Homo sapiens
acacttgaccacctggcgcaatagatatatgtacctgcaaggggaaagatgaaaaattataaccaatgcataatatatgcaatggactaacccctataccttcatgcataatgagattaactcagaaataacatttgcaatggatgatgcc

SEQ ID NO: 521079 - DNA, 402 bp, Homo sapiens
  misc_feature (14)..(14): n is a, c, g, or t
  misc_feature (27)..(27): n is a, c, g, or t
  misc_feature (298)..(298): n is a, c, g, or t
cccacagaaaacgntttcacaatttgntaaagcctatttttcccccaaataaaatcaagtcttgataacttatgaaaactttgttattccaaggtatatagtcagggttgttgggaggaacagaagtgacagcatgcaaacatagttaaaggaggtttatgatgttagctcacattaggatctgggcacttcatcaatggctgtgtcacccttcacgaggctgactgtctcagcagtaccaagctgttgctgagagcctgggggattctttgaaaagcctactgaccttcaattcatntggccgcctgaagaagctggttctaatatggacgaaaagatgcagcaatggcaggaacaagatggatgtacttgtcagtcgagtgaaggcaagcaggtggaagg

SEQ ID NO: 521080 - DNA, 594 bp, Homo sapiens
aaaacaaaaacaaagaatctcctcgtctgtcttgtctgattgttcatgtcctcatgtgtttcttatccgttggggcgaacacttccttgaacaaagatagcattctatttcccatacacattcaagtcaactttattacagaatacatatgctaaactcatccattttaactctacacttgatgaattttgatgaatgtgtatgctgtatgatatcatttggctctatgtccccccccaaatctaatctcaaattgtaatccccatgtgtcaagggaggaccctgatgggaggtgattggctcatgggggcggtttccccgatgctgtgcttatgatagtaagtgagttctgatggtttaaaagtgtttggtgggccgggtgtgatggctcacgcctgtcatcccagcactttgggaggccaaggctgtcagatcacttgaggtcaggagttcgagaccagcctggccacatggtaaaacttcctctaaggaattaaaaaaaagagagagaaacagctcaaccagcctaagaataggctggtttttttttgtgcccggcccctttacctaaaggtttcttgtgggttttctcaa

SEQ ID NO: 521081 - DNA, 154 bp, Homo sapiens
aagtgtctagctctcatttactccagcacacacaatagtcaaagagcctactgaccagacactatgttcttcttcccctgtacccaggttcttgagtagggagtctgcagcctgcctccatttcttcaccttccagtcactattctttacagag

SEQ ID NO: 521082 - DNA, 145 bp, Homo sapiens
cacctttctcgttgcatctgaacaccttgccccttcctcccttgaaataactggcacctgatggagcatggacttttggtaacttgcaacagaatcacctaatgaggccacgttttccctatggcctacctccattggctcacag

SEQ ID NO: 521083 - DNA, 268 bp, Homo sapiens
  misc_feature (3)..(3): n is a, c, g, or t
  misc_feature (12)..(12): n is a, c, g, or t
  misc_feature (23)..(23): n is a, c, g, or t
  misc_feature (72)..(72): n is a, c, g, or t
  misc_feature (100)..(100): n is a, c, g, or t
  misc_feature (144)..(144): n is a, c, g, or t
  misc_feature (152)..(152): n is a, c, g, or t
  misc_feature (184)..(184): n is a, c, g, or t
  misc_feature (228)..(228): n is a, c, g, or t
  misc_feature (265)..(265): n is a, c, g, or t
ctnggtgccgcnttcggtgcccnccttgcaaggaataaccccttatacaatttaaatacatgggtatcttcngagggtgactctttcttgcacccaaggngtgggttaaagtgcacacatcagacactttttctaaagagaagnacagacangttcgcacagggcatgccttgtcactcagctngtgttacatgtgggtgggtctgtgggaaagaaaaagaaggactncatttggggaattgaaggttgtcccctttcccaaggnagt

SEQ ID NO: 521084 - DNA, 711 bp, Homo sapiens
tgccttggagtggctccccaggaaccgggtgctcgccgcttagtacccggagatgacccaggtagcataacttacgtccggttttcctgtcgagaagatggcctcatcgacagcaccctggtcatcctaaagctgccggacgtgcggatgccgcaggcactggctgagtgtgtgccctagcttatggtctgacttggtgagcgctggtgccccacatatggagtaatccacggggtgcaaatcactgaccagttatctctggagtcagacatttggcctgtgatagccagaggatttgccatgacgggctaggcatcttgtgggtaaaaaattcctggaaaacccagacttatctcagacagaggagaaacttcgtggagcagtgctacacgcactacgtaaaactacctaccattggcaccgaactgagctacactgagggactgagcctggtgtatatggcagcaagactggatggtggcttagcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagtggcatgttggttttggcagaaaaactactgaaggtggttccacaaaatctgggggaagcctttat

SEQ ID NO: 521085 - DNA, 148 bp, Homo sapiens
tagaggatcccagcacagaggaggggtcacagtggacacaagggtgggcgtctctccacctcctcacattatgctaacaggtacgcagacacattcagcgtctgtgagggactgagatgcaggatttcttcacgcctcctctgtgctg

SEQ ID NO: 521086 - DNA, 648 bp, Homo sapiens
catggtggctcacgcctgtaatcccaacactttgggaggccaaggcgggccgatcacttgaggtcaggagtttgagatcagcctggccagagatcagcctggccaacatggtgaaaccgcatctctactaaaaattcaaaaattatctgggtgtggtggtgcacacctgtaatcccagctgcttgggagactgaggcaggagaatcacttgaacccaggaggcagaggctgcagtgagctgagatcatgccactgcactccagcctaggcgacagagcgagattccatctcaattaaaaaaaaaaattatggatacttacgtatttatttttattttttaagagatgggatctcactgtgttgcccaggctggtctctaattcctggcctcaagcaatcctctcaccatagcctcccaaagtgctaggactacaggcacgacccaccacacccggccaatgggcatttaaaacagctactcagccaggcgtgcaatggcctacgcctacaatcccagcactttcggaggccaaggcaggcagatcacgaggtcaggagattgagaccatcctggccaaaatgatgaaacccggtctctactaacaatacaaaaattagctcggtgtggtggcacacgcctgtagtcac

SEQ ID NO: 521087 - DNA, 304 bp, Homo sapiens
  misc_feature (92)..(92): n is a, c, g, or t
ctcgcccagtgcctgcattggaacgtccggaagaagcaagcccacttcgaggaggaggaggaggatgtcgttctgttgtttttgtcgttttncctggcccattccttgccctttatctgtttccacgtgcacttggaattttgctactccattggcatgtgaccgttcatattcatgctggaatggttaccacttacaccgttctactgatgactccaaatctgtctgaatgaaatatattgttgataagtggaagaatgacctataccacttattcatatctgtatgtggtgttacgcttttt

SEQ ID NO: 521088 - DNA, 282 bp, Homo sapiens
ggcttgactccgggtttaaaaactgggccggtgaaggtgccccccgtcggttggggcgggcctccccccaagttcccaatgtggccgggggctttgattgccccttgttgtttttttaatagtccttcccaatatgggatggggtgttccaggaagtcccctgccctccttaaagcccccccccttctctttaagggggatggccccgtcctttccccagtcccccccgggggggggatagccttgctttcgggtaaattatgtaatgccaaatttttttta

SEQ ID NO: 521089 - DNA, 385 bp, Homo sapiens
  misc_feature (12)..(12): n is a, c, g, or t
  misc_feature (95)..(95): n is a, c, g, or t
  misc_feature (101)..(101): n is a, c, g, or t
  misc_feature (200)..(200): n is a, c, g, or t
  misc_feature (312)..(312): n is a, c, g, or t
  misc_feature (338)..(338): n is a, c, g, or t
  misc_feature (361)..(361): n is a, c, g, or t
  misc_feature (375)..(375): n is a, c, g, or t
gggacggagctncactctgtcgcccgggctggagtccagcgacgcgatctcggttcggttcactgcaacctccgcctcccggattcaagccattntcccgnctcagcctcccgagtagctgggaacacaggcgcccgccattacgcccggctaatatttgtatctttagtagacacggggtttcactatgttggccaggntggtctggaactcctgacctcgtgattcgcccccttcggcctcccaaagtgctgggattacaggcgtgagcacccgtgccgggccctctctcttctatttaaaaggataggnacagcctttggaactgaatgtctttnctcagggctcataatagaaaatnaggaaagtccattntgacaactgg

SEQ ID NO: 521090 - DNA, 235 bp, Homo sapiens
  misc_feature (24)..(24): n is a, c, g, or t
tttttccggggggggggtttttgnagggggggggcctttcccccccccttttcttttaaaagggggattttgggccccggcgggatgccgccccctccctttgggggggttttttttccgggctttttggccgtccccccgggggccctgggggggggggccggaagggaacccccttgttttttgggggggtttttttttggggggccttttttttttttgccccccctttgga

SEQ ID NO: 521091 - DNA, 178 bp, Homo sapiens
gtcgggccccgagtttatgcattagcactatagaaccagagacatctaggaaaagcacatgatagattattttgcaagcagaatgcctgaaacattacattttacctcatgggacaatgagacagtcaccaaatccaatgtcgtgcattatgaacgatacaggctactagttacaggt

SEQ ID NO: 521092 - DNA, 1031 bp, Homo sapiens
ggacgcgtgggtcagaataggaattggtgttgggggggggtttgcaagaatattttattttaaatttttgggatgaaattaaaactaatatagaaaaaaaatagctaaacaagcaatcatgacagttaaggcaaaaacatgagataaaagatcgccatggaagaacctaaataataggactgcgcagaggatatgatgataatcaaaaggaaatagaaaaaaaaccctaacctaaaagactgaaataaaaggatatagggaagatccataagccaccaactcatataaccctatccttgtcgtctcgctattagagtcctactaggcttagaaagttagtatgataggatcgcgagctgtaagcgtgtaatttctacttgtggtgacggggccttgaggctggcgaggggtacctgacatatgtcatggttgtgagctatttgtgtttgtgggtttttgggaggtttgttgaggggtagttgttttatagtgtgcatgtcgtccgaagtgctttcctgtgtgtcgcggtatgtgctttgtttttttctgaacgtttttcttgggcggtttcctggatgggtggggctgttggtgtgacttttcttcctgtgtgcatgggccgtgtgcgtccttggtgatacttgagagttgttctttgatgcggtcttttggtgctgggttctcggtggtttcgtatttcctttgtttttgtatgttgtggtgtctcttctggtaatattgtgtgtaggcatagaaaagcccctgcattcctgtaacaaatcggctagaatggtagctagagaatatctggtgtagagtggttgggtttgcttgcggtggtcgttgttttcggcgtaagatttctagaaatgcctgttgggtttggtgttgtgttttgggttgtttgtgggctgttggttcgggtcgttggctttttggctctggtcttgttttgggtggtctggggtggtgtttgttttgtgttgtttgttttgtttgttttggtccgcacaaaacaaaaaacaaaaaaa

SEQ ID NO: 521093 - DNA, 137 bp, Homo sapiens
caacaagctagctaacatggactaactgtcctattaaaccgcttcccctatggctgtggacctctgatgtatgcctggagatccttccaagacactcatacgcaccaggtaggtaccatacgcccgaggtatgcaga

SEQ ID NO: 521094 - DNA, 519 bp, Homo sapiens
  misc_feature (122)..(122): n is a, c, g, or t
  misc_feature (141)..(141): n is a, c, g, or t
  misc_feature (272)..(272): n is a, c, g, or t
  misc_feature (301)..(301): n is a, c, g, or t
  misc_feature (352)..(352): n is a, c, g, or t
ggctgtaggaatatggcacgcgagactacgcacatatcactcatacctacatccactgcgtctaaactctatagcgcccaacacattatatatacatacacacatgtgcactagtagctttnctcacaacacactatatanttgagatacacacaccacacacacactcacacgagctatatatatatatgacgactatatactcccctcacatcattatttttatacacacaatacacacacacacacactcatattatgcgtgtgtctcnccacacacctctttctctctcgcacaccnccctatacacactaccccctctctatatatatatacatatcactcgagctntctatcaccctctacacatactatgtgcgacagcgcacacagcgcacatctatatcacgatgagacacacatatactacagcagctatattatatacactatcacacgagcacacgagactctatacatatatttatatactctctctcgagcacacacctctattc

SEQ ID NO: 521095 - DNA, 81 bp, Homo sapiens
ggttccgaattactatggttcggggagtcttcgtgggacttcgatctctggggccgtggcaccctggtcactgtctcctca

SEQ ID NO: 521096 - DNA, 123 bp, Homo sapiens
tctaggtccggtggtcttgcgatgagtctgagtcgtgtgtcacatgcgcctgtccgtatcacacactgatctctcgactggttttcctcattatgaggaaggcgtccgagtgagagtgctgtt

SEQ ID NO: 521097 - DNA, 871 bp, Homo sapiens
accaaatcatgcacattccaattgatagtttatatatcattgaaatataccacagccaatatgcaaaaggagcacaagaagcacatattgcattattgaaatcaatatttcaatgatatatattcataaccaaatcatgcacattccaattgatagtttatatagtttttaatactcagtatgaggcttatggaccacatattgacatactggtcaaaatgctagttttcatatagtaatagtatagtaattgcagaaatattcattgggttacagagcagagtatcaaatgtcaagtacaaatgacaatgattgtgggggttggggggcatattaaatctaacttacccggctttccatactctgatgtaccacaggcttaaactaaaaagattacttgtagttacctagtgagctaatgccaaccaaccaaaatctgtatgacagcaggtgctgaatatcaaattattaggtagtgtggaaacagtgattaaaacctgaagctggcctcattacatccataattagatttattcagtgaattttgaacagaaatcctattttggcctgactttctcatgagcatacacagcacttactctctgttttccctttctctctctctcctctctctcccttttaagatattgaagtattgcggtatttcctctacttattaatactgtggaaactcaggaagacaagctgaacttcaaacatttattttgccaattggcggtgtacgctgatgctgaggtgctcttcccaatccagagcatgactaactctctaagcatcggagccttttaaaaccctaactcgggaactaactacagtcggataagcgcaaggtcacgacagacaaacgcac

SEQ ID NO: 521098 - DNA, 134 bp, Homo sapiens
  misc_feature (49)..(49): n is a, c, g, or t
  misc_feature (123)..(123): n is a, c, g, or t
ggggcgaggtcctaggcctctggtttcctggtagagggcggcatgcaanggttctgctgggtgtggattggaaggcaggagcccttggtggaccctgggagggataccaatcccaggtgagtnaggcactttcc

SEQ ID NO: 521099 - DNA, 632 bp, Homo sapiens
ggctctttccattttccctgcgtcccctctgcagaagccttcatagggcccggctgcggggtgctcacagcgctgtcattcccagccgctttgggcggattgggtaggcggattacttgaaggcccggagttcaagaaaccaggcaagggcaacagtaggggaggaccgcgacctaccaagaccaatttcttaattggaaacaaaatacaaagaatgcttcactatgacaagtaggactggtcgatatactatgtccatacaggagacgagataaaacttagagacaatcccttgttaatccaggggcacctatagggattgtgtaggtctgcccacatggggccgacgctagacaagtctgtgagcaacctccgagagcgtgttgtccgcctgaagatcgtatgaggtgtaactcactggcggtgttctgggttgacaggtttgaacgaatcagccgtgttagcttgataagcattgtgtgccactcatatttgtttccagaaggggttaacctggtggtcaatggatggcggaattttcgggggcggacaacggttagcgccgggcctggttcacacattcacccggggatcagagggcgcctgagagactagggtgtggatctacaccg

SEQ ID NO: 521100 - DNA, 530 bp, Homo sapiens
gacattagcctggccaaagtgcagacagaaatgtggacagactttttggaagcgtgcggaacattaggagtactagaggaaaagctatgtctcccccatgacatccgtgaagaaaagggcctggtcaaagtgggcattagcgattcaagcattactagacatcaccgtaacgaaggctctgttcagatgaaactaccccttctccatggggggctcagaatctgctctcatccgaggatcctgaactcggctccaggcacctgtgcaaacctcgtctcccacccactgcgtgtcagttcagtgagtccagtgacattgaaacaattttgagtctaagggaggatttgctacctttcagagctgtactccgagtttaagacttgacaggtatttatcttgaaaccagagagggagctggaggaaaaaaaactgagcagcacatcaatgccttttccaccctccttcatcctttccacactcaccgactgccattaccaaaaggccaagcacaaccgcagttgaaagacgca

SEQ ID NO: 521101 - DNA, 549 bp, Homo sapiens
tctacaatgccgtcttctgtctcgtgtggcatcctcctgtctggcaggcttgtgctgccgtggtccctgtctccctggttgatgagtccccagggagatgctgcccagaatgactgatacagtcccaccatgatcaggatcacccactcttcatcaagatcacccccaagctggatgagttcggcttcagatctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaa

SEQ ID NO: 521102 - DNA, 373 bp, Homo sapiens
tctttgtaagacagggatctcatcatgttgcccaggttggatactcaaactcctgggacacaagacactcctctcacctcaggctccaaattgctgggattatagatgggagccacagcacctggcctcacagttctttctaatcaagcacactctaaatcctaaatccactgtgaactctggcctttggcagtttgctcagcaatagatcagcagcaatagatgagcttaggtaagttgaattcagcagcagtgcctttctttccgaaagcatcggttgtaagcacatttatggcagctaaaggtggttttaatctcagtttctaagtgagggggtcttacccttatgagccctttctagcaactatgtaag

SEQ ID NO: 521103 - DNA, 129 bp, Homo sapiens
ggtaccccagcggcatggtgaagtagccgtgcacccgcttgtgcttcggcacgtaggcctcgaggctgtgctcgaagccgaacatctgccgggtccgcttgcggtcccagatcagcgagtcgaacggcg

SEQ ID NO: 521104 - DNA, 737 bp, Homo sapiens
  misc_feature (7)..(7): n is a, c, g, or t
  misc_feature (66)..(66): n is a, c, g, or t
  misc_feature (101)..(101): n is a, c, g, or t
  misc_feature (148)..(148): n is a, c, g, or t
  misc_feature (157)..(157): n is a, c, g, or t
  misc_feature (169)..(169): n is a, c, g, or t
  misc_feature (171)..(171): n is a, c, g, or t
  misc_feature (194)..(194): n is a, c, g, or t
  misc_feature (203)..(203): n is a, c, g, or t
  misc_feature (225)..(225): n is a, c, g, or t
  misc_feature (238)..(238): n is a, c, g, or t
  misc_feature (244)..(244): n is a, c, g, or t
  misc_feature (260)..(260): n is a, c, g, or t
  misc_feature (287)..(287): n is a, c, g, or t
  misc_feature (296)..(296): n is a, c, g, or t
  misc_feature (303)..(303): n is a, c, g, or t
  misc_feature (324)..(324): n is a, c, g, or t
  misc_feature (330)..(330): n is a, c, g, or t
  misc_feature (352)..(352): n is a, c, g, or t
  misc_feature (355)..(355): n is a, c, g, or t
  misc_feature (362)..(362): n is a, c, g, or t
  misc_feature (371)..(371): n is a, c, g, or t
  misc_feature (374)..(374): n is a, c, g, or t
  misc_feature (404)..(404): n is a, c, g, or t
  misc_feature (411)..(411): n is a, c, g, or t
  misc_feature (414)..(414): n is a, c, g, or t
  misc_feature (423)..(423): n is a, c, g, or t
  misc_feature (434)..(434): n is a, c, g, or t
  misc_feature (451)..(451): n is a, c, g, or t
  misc_feature (489)..(489): n is a, c, g, or t
  misc_feature (516)..(516): n is a, c, g, or t
  misc_feature (540)..(540): n is a, c, g, or t
  misc_feature (551)..(551): n is a, c, g, or t
  misc_feature (555)..(555): n is a, c, g, or t
  misc_feature (736)..(736): n is a, c, g, or t
gcctctnacccctttggctcattttgaatataatttttaaaaatatacacaaggctggctttccantgtttaaaatcattgtagaaaccaacaggttgaanagaaatataaaagtacagaaaatggttttcctgctttggggttggtngggggggcngaggtacgtgantnctgctgtttacacaagtccagangctgccagngcctgttgggatcagctcagtntgcgactaaaacngctggntcatcgactctcttgnctcgccaacaccaacccatttgactgngattcccangtgattntccaaaaagcggatgtagttntgggcntgtgggggcaggtcctcccacntcntggcgcntgtggtgtntgntttccacccaggcagggtttcatattcaanttcgacnttntgaagcatntcctggttagntgggaaatagggaatcnttttcccattcagcttgtatgagacaccgattttaacntcacccagtacgtccaggatgtccagnttcgtcagggccagggcagtgaanacgttgaaaanaaanacatattttagaatcatcaggtcgagccagccgcagcgcctcttcctgcctgtggtcactcccacactcgtggccgcgggtctgcagcaggcctccaatctcgttgatctgctcggtggggaaggccccgatgcccacacgtgtggtataggctttcaccacgccatacacgtcacctatnt

SEQ ID NO: 521105 - DNA, 380 bp, Homo sapiens
tttgcactagctctctgtttggctgggaatatctcatcccctggggtatcctcatggccttatccttcactttcttcacggtcttcagctcacatggcccctttcccttaggagagggctttttctgacttgctgtactataaagggaacaacaccccaccttcctttcacttacacaattctttgtcccctttaccctgttggtgttttttttccatagcactttaccctcgacaagatactttgtctttctcattctatgagagtataagctctgtgagggcagggattttttgtctctcttgttaactgctgcatcccaatgcctgaaacagtgcttggcatgaagtgggcattcaggccttccttggtggaatgaa

SEQ ID NO: 521106 - DNA, 407 bp, Homo sapiens
gtgatctagaggatcccggggattgtgctggagaggagctgagcccggtggtgggcccattaaagaacaggttcctcaggcccggcccgcttccggtccacggccccctccccatccccagcccagccgagggaatcccgggggtggcttacctacctataaggtggtttataagctgctgtccgggccactgcattcaaattccaaggtgtacttcatagtgtaacaactttatattatggtgaggtttttttttttttttttttttttttttttttttttttttttttttttttttttttttttttttttttctatacgcgaggacggggggggggggggggggccggggggggagggggggggccccccccccccgaccacgggggggggacgacagcccccgc

SEQ ID NO: 521107 - DNA, 785 bp, Homo sapiens
aaatgctagcctctatggagttgctcggtcagagtaaataaaccctgattaatacttattctgtaggcatctcatgtgggaggcacctctattggaaacaatcaatacttttatttcaaggacatgttagacgtattacgatattctgatattgcattattatacttgcaaaccattctttcatatctcggtccgtgatgttctgactgctgcgtacaaatttacttcttctaacagctgtcatggaatccctgtctagtagccttacctatgtagccggttcctctagatgatagagtgacaaggttgtcgtccggtggtggtggagtaagaaaggtaggaagataaaccaaaactcacagattgtcaccagtgtgtcattccccgtcccctaaccaatcacctctttaacgcttcctcttcctttgacatgttggatacttctataaccatgtctctttacacaacaggtactcaattcatgtctatcctaggctgagagtgtccagtggtgacacacctgcggcacattacacttgcggtcccagctggactcaccgagtgttcagagcaattatcgtcccttgtcacttgcagcgattgcttccgaccttaagcgctgggtggaattacccgagttggcacctgagcaaactaaacgcgcaggtacaaaatggtccatcgtgatatgtcgtctaacgatacgacgaaagggcaattattgcaacccatggttataaccataggaatagggtcgtcaagactccttgaacatgtcacgtgga

SEQ ID NO: 521108 - DNA, 423 bp, Homo sapiens
atttaaagagttattttaaacaggattttaattagccataagaactttggagtcatgatgggaaaaattcatttaatttgttaaatatgacatgggcaagtgaacttttcaccccagacctaggaactttttcaggtccttaaatgtttcaaaaactaaacccctaatttttgtttcatgattaggttatttcccttttgccaattaaattattttaaaaaaacttcataatttggaccatttggggttagagcaggttattccagaaagtaaatagaaaagactgctgctttttgacccagggagttttgaaaagcaaaagaaaaaaatgtagaaagtaaccccccccatttccctgtttgagtgggatttgttttaaaaattttgcatttccaaagaaaaaggtaatcaatcaatccctga

SEQ ID NO: 521109 - DNA, 192 bp, Homo sapiens
  misc_feature (3)..(3): n is a, c, g, or t
tangcgactcaggagacagaactccgtgagcagaaggcaaagtcgcttgatctgatttcagtacatacgacgtgaagcgggctcacgatctctgacttttggtttagcagagtgtcagaaagtacacaggatactgctgtgcggcagcgtcatagcgacgtcgcttttgatctcgatgtcggctcttctatc

SEQ ID NO: 521110 - DNA, 117 bp, Homo sapiens
gtgagcccgtagccggggaggcaccagctgccgcgcggggaggaggccgagcccagcttgagggaggccccggccccttctagcttggtgttagacgagacaatcctgcccccccac

SEQ ID NO: 521111 - DNA, 1241 bp, Homo sapiens
  misc_feature (152)..(152): n is a, c, g, or t
  misc_feature (160)..(160): n is a, c, g, or t
  misc_feature (166)..(166): n is a, c, g, or t
ttgctgctcgtgttgaatctagaaccgtagccagacatgggactggaggacgagcaacacgatgcttaccgaatccggagatcctgaggaggaggaagagggagaggaggaattagtggatcccctacaacagtgagagagcatgcgagcanttgggaantgtgtnaggcccgggagcggctagagctctgtgatgagcgtgtatcctctcgatcacatacagaagaggattgcacggaggagctctttgacttcttgcatgcgagggaccattgcgtggcccacaaactctttaacaacttgacatacaactgtgtggacttaattcaccccagtcttcatcatctgggcatcagaatatttccttcatggtttcggatgtaccattcgtcatcttattagtgtaacctgtaagttcaccatgaacctcatggcgttaggccttcaggctggtagcttctatgctaattcgccaatgattccactcgtaaaattaaccaggttcttatggattctgcccacaaccacaaccgatacaaaccacgcacaaacccgcaagcgcaccatacaacgcgccgcggcactgccggcaaaacacacaggcacacggatacacgcgcgccccacaggcgcccacgaccagcgtaactccccctgaacaccccagacctctccacgggctcacaccaaacgcacggcccaacaaatcacaagaacggagaccacaccgcacactgaccacgacacaccccaccgatcaccatccgcgacaataaagacccaacagggctcacaccacgggcgataaaaaaggaaagacgcgcggagcaacacgaccacccgagccactcacagccaacccacgcgcagcagacgcgcagccctctccccacacagacagcaggggcctccacaacaccccacgcatccacacaccgacacccacaatggcgacactggaggaaaaacaaagagccggacaacagcggcgcaagagcgggaagggcccacacgcacggcccgaggagcatgagcaccagggaaggcttgcagcgagagggcggcacaagagccgacgagcgcagcgccgtaacggccacccggagagagaagaatgcgaggaaagcgagggcaagaacgaacagggagagaccgccaaccagagcacaacgctcagggagaagcaggaagaagagcaaggcaacacagcatgcggtccggcgcaggaacagaaggcagga

SEQ ID NO: 521112 - DNA, 202 bp, Homo sapiens
agcggactcactcgcactcacacccgggcgcaggaggcgggcggccgggccccaccggcccccatggacgcccccagacggggcgctgagacccccggtcgtgccagccggtccgggcgccagccgaggatctctggacaggacaaatccgaatatcccctaacggacaaacatgaaccagccccccccccggcccctcccc

SEQ ID NO: 521113 - DNA, 1047 bp, Homo sapiens
ggctgtatgctgtagctgtgggcgtgttggacggcgtggagaggcctgcaggctctatcaaggggttggtgtctccaggcaagcttccagtaacgttgaacgcacgctgtacgcgctggtgtgctgaaacgcatgcgctactccgctcgtgttggatgctgtgactcgccagcgccgtgcctcctccgtgcggagaataagctgcggcgcacctggcccaaggctgctacgttgtatgaggttgttggtctgggaagagggcttgacgcagggtgagtgtgcggggccgaatgcgcatacggctgctgtgtggggctcgggactccaaggcgagcactcaacggcgtgagttggtctctggcgtcaaggtttcagtcgaggtggtgagccggaatgacgacctgttcggacgtgggatccacgcctgggtcctgcctctcagtctggtgctcgaatgtagtgacgtggtgagacccgtctggaagaaggctgctcacgcattgagtgctagtgtgactgtgatttcccgagggatgcacgggagggtctgtctccctaactcagggtccgtgtgcctggcgatactcgtgcgattgtaagttgacgatgcccctcagaggcgagaatggcatttttcctctctgtggaacccccgttggaatgggcgggatctcggctgggtgtcttgccagggcccagaacggtgtttggttggaacggccacctgtatggggtgccggacattcgtccgttcctgcatggacaaggccatctgtcgtccctaggcgattcctggtcgggagacccgacggcagagcttccggatgtccctgagtgggctgttccgcgcgagggaataaagagccccgtactggggtggttttttgactaacccggcgggtgactttggctttggcttgcaagcaacggggccgcccactggcccgcgatgtccgagaggcgcgtaatggaaaagtgcggggagacctgggagacaccgcctgcggaaaagagagaactctgagagtaacaggcgatttgtagcag

SEQ ID NO: 521114 - DNA, 300 bp, Homo sapiens
ctggtccccccaccccacttcgactgccgcgtttgggtccgcggcctgttcaaaagcggtctccgccgttccctggaagtagcaacttccctaccccaccccaggcctgggccccgtccagccgctgacgcgaagatgagcagctcagaggaggtgccctggatctcctggatactgagaggcatccgtgagcaaaagcaattgctatcgtgtgagacgcaggatcgaaagaactacatgacagcgacaaatatgaatccttacgagcactcaatgagcaggaccctcactatcgacaag

SEQ ID NO: 521115 - DNA, 1252 bp, Homo sapiens
  misc_feature (163)..(163): n is a, c, g, or t
  misc_feature (171)..(171): n is a, c, g, or t
  misc_feature (177)..(177): n is a, c, g, or t
gcaatgattccatctaaataaaagttctatgaggttcatgtgaacttacagttacacaaataagaaacaaatggtacatccgaatccggagatcctgaggaggaggaagagggagaggaggaattagtggatcccctacaacagtgagagagcatgcgagcanttgggaantgtgtnaggcccgggagcggctagagctctgtgatgagcgtgtatcctctcgatcacatacagaagaggattgcacggaggagctctttgacttcttgcatgcgagggaccattgcgtggcccacaaactctttaacaacttgacatacaactgtgtggacttaattcaccccagtcttcatcatctgggcatcagaatatttccttcatggtttcggatgtaccattcgtcatcttattagtgtaacctgtaagttcaccatgaacctcatggcgttaggccttcaggctggtagcttctatgctaattcgccaatgattccactcgtaaaattaaccaggttcttatggattctgcccacaaccacaaccgatacaaaccacgcacaaacccgcaagcgcaccatacaacgcgccgcggcactgccggcaaaacacacaggcacacggatacacgcgcgccccacaggcgcccacgaccagcgtaactccccctgaacaccccagacctctccacgggctcacaccaaacgcacggcccaacaaatcacaagaacggagaccacaccgcacactgaccacgacacaccccaccgatcaccatccgcgacaataaagacccaacagggctcacaccacgggcgataaaaaaggaaagacgcgcggagcaacacgaccacccgagccactcacagccaacccacgcgcagcagacgcgcagccctctccccacacagacagcaggggcctccacaacaccccacgcatccacacaccgacacccacaatggcgacactggaggaaaaacaaagagccggacaacagcggcgcaagagcgggaagggcccacacgcacggcccgaggagcatgagcaccagggaaggcttgcagcgagagggcggcacaagagccgacgagcgcagcgccgtaacggccacccggagagagaagaatgcgaggaaagcgagggcaagaacgaacagggagagaccgccaaccagagcacaacgctcagggagaagcaggaagaagagcaaggcaacacagcatgcggtccggcgcaggaacagaaggcagga

SEQ ID NO: 521116 - DNA, 252 bp, Homo sapiens
taattgatttctagcttaatgtcactgaagttggaaaatatactctatgatttccatcctatactctatgacccccatcaatatggtaagagtcgctttatgactcaccaaatagagaacactggcaaatgttctatgtgtgctcgacaggaacacctactctggattggttgagagcaatgttatataatcccataatgcacagataatgacttggttctaattaaatatacccttattgattttgtctat

SEQ ID NO: 521117 - DNA, 299 bp, Homo sapiens
ttactcctttccagtcggaataacctcggctgttattctcagccatcaaaggataattgcttgtacccgggaaggcgcctgctgcagtgaaccaggatcgtgccattgcactccagcctggtcaacaagagtgaaactccgtctcagaaagaacaacgattgcatatgacatgtgtaaaaatattgactcttgatatagttcattcttcagagtcctgaaggagccggatagggtgctctcagtgtattaaggcctggtgggaacagacttctatttctgccatgtagtacctcgcagt

SEQ ID NO: 521118 - DNA, 295 bp, Homo sapiens
  misc_feature (292)..(292): n is a, c, g, or t
ggcgaaactctgctgatgaggaaggataacagttgacatcattgaataaatgggcctcaaggtatcaataattgaagccatctctctgtgtttatatattcagcttttgaaacccgcaattacttttgcaccaacctaatagatttgcgtcactctttttaagggctgcatagtgttccatggatgcttagaccacaaatttaccttagccaacccctactgaggaacactgaagttgtttcctgtttttcaaaagtataaataaagtgtgagtacctgttttcaaatttgnatt

SEQ ID NO: 521119 - DNA, 996 bp, Homo sapiens
ataaattcccctgagacatagctcgatgatcgactgtagcatgctttggtggataagctcgatcccctagctatcgctcgaaatgatgggttacttgagtagaagtgagagatagacatgctgtctagaatacctgttctaggcactgtacctagatcctcgttcagcaagacaacggcttaattgccgtactagtgcttccaccggggacatcacacgggttcatgtttcgcttcgaattagcatatgcttcgttcttagaactcactttcgcatccgtgacgaaggagcctatatacctaagacttgccaaatgaatacttccatctcattagtatctctatagattgtgagtagtgaggtcattcatggctacgaatgacccctgttctattttctgagctgcccaagaggtttccgcaaggtacttactatggttatccaggtctgtggcattcttcctgactgagggaaaaagctatgcgcgctcactactcaatttgggtattaccaaagtcatctcgctcattgaccctgtaagctgtcattccctctgtcctctcagaggttttgccacttcacttggtagggacttagagaagcgcaggcaattcaaagcaagctgccgggtacgtgggaggccgtagaactcaagtctcaggttaggctgcctagggttgcttaatctgcccgtgtcccgacaaatctagatagcaccactcagggagtagtcaggatatctggctacgacgattccaagacgcgggtcgctccggagagatctcaagattggggcgggagcgcaaatggttagacgaagcaacagccgggccagaggcgccgcagggtgtgcccgggcatcaggggcaaaaaggcctaccaaggcagaggcggaggtatgagacaccgcacagagcctaaagagaaggggacaccccgcgcgctgccacttgataaaaaaggcccgtaagatacgcagtcgacgggcgatacgag

SEQ ID NO: 521120 - DNA, 253 bp, Homo sapiens
tcatgggtacccaatgaagttttcatacatggcctcacatacgacagcgtcatggaggtcctgtccagatagctaagttaacgtggtcctggaggatggtgctccctcataggtgcttggcatgttgtacttcgtttcctctgttattctattgtaatatcctttattataacccaataaaggtgttccctgagttctgtgagccgctccagcacattaatcaacccaaagaggggatcatgggaacccaaac

SEQ ID NO: 521121 - DNA, 174 bp, Homo sapiens
gctcctctagggggtgattgctgtatatcggaacagattggtctgatcatatgatgtgttgagatgatgcaactgaagcactaagagctggaaatgtgttagattaaggaagaaggagaagagatgagaagaacagctcttcaatccccaatagaaacatatgaatgataacac

SEQ ID NO: 521122 - DNA, 183 bp, Homo sapiens
ctgcaacgccgaggctcatacggtctgctcagaagtcatgtgacgaagttgtgcgcaacaacttcgtccattacgacctccaacatcgaggtcgtaaaccctattgtggtatggatgctcggcggcaacaacttcgtccattctgacatgtgtcaccaagggtctgggccctcggcgtgtgca

SEQ ID NO: 521123 - DNA, 981 bp, Homo sapiens
ggatggatacgaaatatcagtgtgtgaagactgaatgatggtcactgcatgcctgtcctgggattggcacctatgcgcctgcagaggttcctaaaagtaaagctttagaggccaccaaatggcaattgaagctggcttccgccatattgattctgctcattatatacaataatgaggagcaggtaggactggacatccgaagcaagatatgagatggcagtagttgaagagagaagacatattctacacttcaacgctatggtgcaataacccatcgaccagagttggtccgacagcacttggtaccaggtcactgcacaaatctatccattggcattatgtagacctctacctatattccatttccccaggtgtctgtccaagacaggtgaggaaggtgatcccaaccgatgacaacatggaaaaactactataagaaacaaacggaatccacaaggtgccacccaaatgagaaagcccggcgagcccacacgacaaagcatgccgggaacggaacaactacccccaagagacggaaccagcaaacaatccacgaacaggcaaagcgagccctcaaatactcaaccaagcgcatcgcaacaacatagacaccgagacaagacacacagcagcaaaatcgccatccaacaacacaacccaaaacaaatagaacaatacgacaaacactccaaagaatagtgcgaaagaaacaccgagtaaggggacaccaggagacaaaccgaggacagacctgacaacctgagatcatgggacgaccaacttgtgaaatgaagacaaaaagcgagtctacagaaacgcaatcaaacatcagagatagacggagaaggcagagaggagaacagaagagcaaaaataaaaacgacaagaccaaagcaaatagttacacacagagacaaaaaaaagacgcgaacaaccccagaggcagagagacacgacacacacgcacactcaacaaatata

SEQ ID NO: 521124 - DNA, 937 bp, Homo sapiens
  misc_feature (877)..(877): n is a, c, g, or t
  misc_feature (882)..(883): n is a, c, g, or t
  misc_feature (887)..(887): n is a, c, g, or t
  misc_feature (894)..(894): n is a, c, g, or t
  misc_feature (898)..(899): n is a, c, g, or t
  misc_feature (901)..(901): n is a, c, g, or t
  misc_feature (904)..(905): n is a, c, g, or t
  misc_feature (907)..(908): n is a, c, g, or t
gggaacaatggccacagtgtcccaccatcgaagagatcagagaccaggctcctgtggctcctgctggagccttcagtgggctgtggaagccatctctgaccggatctgcatccacaccaatgcgcacgtcagcgtggaggtgtcagcggaggacctgctcacatgctgatggcagcatgctgtggtggacggctgtaatggtggcttatcctgctgaagcttggaacttctggacaagaagaggcctggtattctggtggccatctatgaatcgccatgtacggcgtgcatgactcgtatcgtccatctcgctccctgatgagacaccactgtcaatcgtgatctccagggcccgcatgcatcggggtgatgggacgatacctcctcaacgtgtagtcaaccgatctgtggagcctgtgctgactagtgccgtacctgacgaaacagggacgaaggcagctacgcgtatacagattccttacagacgtactccaagtagcgtagaagcgacatcattggcctgagatcttacagaaaacgggcccccgtggcagggacgctttctcatgtgtcattcaggacgttccatgctcatacagagtcaggaagtgtacgcaacacgtcacccggagagatgatgggtggccaatgccatccgcatcctgggctggggagtggcagaatggcacaccctactggctggttgccaactcctggaaacacgactggggtgacaatggcttctttaaaatactcagaggacaggatcactgtggaatcgaatcagaagtggtggctggaattccacgcaccgatcagtactggggaaaagatctaatctgccgtgggcctgtcgtgccagtcctgggggcgagantcggnntagnaaagcantatnntncannannttcatcaattatagtgtagacaattgaac

SEQ ID NO: 521125 - DNA, 315 bp, Homo sapiens
tgattggaaccgcgagggatgacagaccagctacagtttattcctgttggtaagaacgccctatgctgcgtaagtgaaacctgctgccacaccaccagatttagctccactatatctgcagccccaaattctgattctgggttttgagattcgagacatatcgctccactttattctgacaaacgcgcgtccttttttcaaactcagagacattaaaatgagaacacaattatttctttctcctccctttgaactatgtatttatctcttgaaactatttgctattgccacacgtagctataaactaaactaata

SEQ ID NO: 521126 - DNA, 108 bp, Homo sapiens
cgagattgcgctggttgtccaaatcaacaaccaggtcgtccagctcctgctgaagcctgttcttggtctcttccaaatacgcggatgagaggtactactgaggtgtag

SEQ ID NO: 521127 - DNA, 291 bp, Homo sapiens
cacagtgtactccacgaactatgagtgctagcgtccacgagtcaggagtgctacctccacaaacagagtggtatctccacaaacagagtgctatctccacaaacagagtgctagctccacaaacagtatgtggctacctccacactgatagtgctacctccacacccagagtgcgtacctccacaaacagagggctacctccacaaacagagtgctacctctacaaacagagtgctacctccacaaacagagtgctaccatccacaaacagtagtgcgtagctccacaaac

SEQ ID NO: 521128 - DNA, 487 bp, Homo sapiens
  misc_feature (370)..(370): n is a, c, g, or t
ctcctctccatggctatcctcccagtctcaagactcctcctcacttgatacccttccctatatacaatcattttaatactctaactagcatcctaaatttccctggcagcagtttaccggtcttcggcctctgtccctaactgcagaatacccataggtctagacgaagtattatatggacattggacccattcccagtagaatttgtacagcatagctgggtttgaacacttagaatcttgatatatctctaacctaggggtcggcaagctactgtggtctcggtatgacttctgagctaaagactagctggcaaagcgtacggtatacacctggcccttaacagaaggaaaaaatgctgatccctgtnctatccttttctgaatcccatttatctctccccttatcagctcctgaccacaggtaatcaaccacctcggccttccagtgtgctgaaattacgggcataagccaccgtaccggccag

SEQ ID NO: 521129 - DNA, 367 bp, Homo sapiens
  misc_feature (17)..(17): n is a, c, g, or t
  misc_feature (324)..(324): n is a, c, g, or t
ctcgaaaactttttaangggatgcctgactccctcaagaagtctgtacccatttgaatgagctcctagttgaaagaaaggtttttaataatatattcaaagtggaaatctttccttactttgtttttttgtttgttttttgagacgaggtcttgctctgtcaccctggatgaaaggcagtggcacagtcttggctcactgcagccttaaactcccaggctcaagtgattcccctgcctcagcctcctaaatagctgagactataggtgtgcaccactgtgttgcccaggctggtcttgaactcctggattcaagcacccacctnccttgtcctcccaaagtgctgagactacagacgtgcccaccag

SEQ ID NO: 521130 - DNA, 379 bp, Homo sapiens
actccatgatcaccagtgatgggccctcagctcctcagcttctggcagcagagagggcctggccgggacgctggacctctctcgtccctggccgtcaaagtacacgggattcgctcttcagagaactccacggtgcacctccagagtcctcgccgcccgtccacgaacatcatgtgcctgacagtgtcggcaccctgtcagcagcgatctggtgcggggcacttttcttttctctagagcaccaccctgtgatgcttgtcccgcacaactacaggctttcgtgctcccgggctggaccgtcatctgctcacagtcttgtgtcttcccagggctccatcacgccctccacgggcgcctcgcataacgcgcctaatgcgtc

SEQ ID NO: 521131 - DNA, 560 bp, Homo sapiens
  misc_feature (546)..(546): n is a, c, g, or t
tccatcttctgaatcctgccactgctttactaattgagtttatgttatattctaaatcttttcctgtcatttcaaatgttcacagcatcttcaccaggagtagattccatctcaagaaagtatgtcagctatagctttactaaataactaaatatatttcttaaataataagactcataagttgaaatgacttcttgatccacaggctgcagaacagacgctgtgttggcaggtatgaaaacattaatctccttgtacatttccatcagagctctcaggtgtctaggttcattgtcaatggacagtgatattttaaaagaaatctttttttgtgagcaagaggtctcaacagtggcctcaaaatattcaataaatcatgccataaacagatgtgctgtcatctaagctttgttgttccacttataaagcacaggcaaagtatattttgcataattcttaaggtccctagggtttttggaatggtaaatgagcacgggcttcaacttaaagtcaccagctgccttagcccctaacaagagtgtcagnctgtcctttgaagc

SEQ ID NO: 521132 - DNA, 696 bp, Homo sapiens
ctgttttagcttggcaagaaacccaaatgaggaatgctatctatcagaatagactggccttagactacttgttagtagctgaaggaggagtttgtggaaaattaattacatgctgctacaatatgatcaagaatagtggttaaatgatcagaagtcaggacatgacaagtggcacattcctttacagattggcacgagttaatcctgagtcttatttggaaaatggttccagctataggagattaacctcatgagtgtatgctatgataggagcttgttgctgtcccccgtgtatacccttgtttcaatgacaaaggttctgtgctacttgattcatcaaaaacttcagcacaggtgtatatataatcactatcgtctatctcacagagagactcaaaagtaagatgagagcgagaactcccactaaaagtgaaaatgctcaaaggagggaaatatggtgtgagaccaccagtctcctgtgcttcccagttcctccaatccctttttcctagtttatagaagaaaaagggaaagcaaaagtgaaaaacagaagtaaataatagctgacgcctcgggcacactggcccggggtaaattcataatataacccctgacaaactatggtgttatctgtaatccagacattgtatgagaaagactgtaaaaacttctgtctgtaagctgatgttgtaaccc

SEQ ID NO: 521133 - DNA, 338 bp, Homo sapiens
gattaaacataaactagccgttgggacagactgattccaccggcctgatgctgaccctcccgatttgcgggatcaatagaacaaccgactcgcattccttgctgataagagatcacccaccatccagggagtggttctggccagtctacagaggacgtgcagagagggttttcacataccctgcttcaccttttgaagacacgcggtagaaaactctaccctaggatcatgctaaggccaccattttttaaacatgggatccacagagaggcatgaagctcaactgcacatgcacaaattgctcctttcataaatattcgcgacccctcttacagttt

SEQ ID NO: 521134 - DNA, 1161 bp, Homo sapiens
ggccggggcgctcactcatgaggagcaggaagcttacaggtggagtgcggtcctcagcacgccttcgggcccggagttactcttcagccagcttggcctctgccagggacgttaccagctccacatctgctaaaacaacatgtctggcttcctcatcacacaaagctacggacagacgaacttccaaaaagttcaagtatgacaaaggtcaccttgtgaaggcagaattacaaaaacttgaccctaagagtgacatttcttctttgccaaaagtggcccccgtggctccttgtgaaaataagtttgcggaggacagtgctgaggctgctgtctctgtaccagagagcagagagccgcctcagggctgctccacgcctgagagtgaggagccctcagtaaaggctgagaatggcctgtccacagaacccagcagtgccgctgcagcccaggagcccgatgacagctctgccggacaggcagagcctgtgcccaggacagaggaggtgcgggcatccgtgcttcagatggacagcagcatctttctagatgatgacagcaaccagcccatgcctgtgagtcgcttcttcgggaatgtcgagcttatgcaggatctgccacagcctcttcatcttatccttccatgagcagacagagaattcagaaaaatgcacttcagaggcaagatgacgaggatgacgctgaggggtaaagctgcgggcgcctgcagccggtgtccaaggatcggatggcatcttcagaaaacacgccggaaaccaggggacatcaaggtactgcgtggcaaaacgcccagggcaccatgctggcaaggcggcgtggaggggaacaacggaaaacccggaagagccctggggccggcgagaaaacggatattttccagcgcacaatagatcccacggagagaaatcatcgggagaagaacccctgatgaaggaggagcacaccaggcgcggtcgaatctgcaagtaactcgtatagacagatagaaccatgaggacagaccttactcaacacacacaagcgaggcgagtatcagaagtagagcaaagacaacaatcaatgtagagagagcgaatagaatatcaagcaacaggaacataggtacgaactacgaattctcttgattccctctcgtcataatat

SEQ ID NO: 521135 - DNA, 193 bp, Homo sapiens
cagggcagcgtttctgctgaaggcgtttgctttcccaccatcataaagtcagaaaatcacaactcagaccatggtaagtggggaccacccacaacccaagtgggccttggaaattaagaataggaggccgggcgcgggggctcacgcctgtcatcccaggaggctgggcacggtggctcacgcctgtcatccc

SEQ ID NO: 521136 - DNA, 942 bp, Homo sapiens
cctgagttgtctacctacgcgtgtttctgtcgccagtattatgacgggggttgtataacgccaaggagcctgttgacgcggaagcacagcgtgttttccccccttacgggggcttttaataactgggcacggggacatttttcacaaaatgggaatgggggcctacccgttcaattagggccaggaactgtgtaagaccagtgtggggcttttccgccaaagggcaagtcatgttcggagtttcataacacgcagggtgcacagtacagaaccgggtagaacgcgccgtgttatgcggagattattgtggcacgaataaatctcggggccaccagtaactaagttggttgcacgcccggtttgtgctccagcaaccatgtgtttcataaagggggaaattttaacccgagcgcgccatatggatgaagaaagttggccccttaggtattttttataaacgggagcatcttccccggcccccaacatgtgaggagagttctttcgacccgctgcccacacgtggagaggcgcattttctaacaagacctgtgtattaatcaagcgctggtccaaacatatgtgttgttagagcttcttctacggggtagggcaaccaccatagggtattgataaacgcccccctttaaaatggtgttgacaaacaagaatgacactcattctttcacctcgcgataattcgtgttttgaaaatttttacttggaggaacccctgttcagatgtactaccttattggcaaatagccccctaggcatcattctctctaccacgaaatattttctattactaccacccacccccttcactcttttatgttaaaaaggatagattatcattcatttttttaataatcccactgtgctgtattgaaacacccaacattaaaagtattttttattaagtaaaaatcgccccacaaaaca

SEQ ID NO: 521137 - DNA, 202 bp, Homo sapiens
ctggccaaggatccagcaaacagggtcatcttcagcatttccgggaggcgggcactcacggctattaccggtgcagtaggacacgccttggcaagtagcattaatcgccggcaggtggggccctttccttcccgccagaggggggctgagggggcgcggagccaggccgggggcctagggcagtgatgctgtgtgggtttcc

SEQ ID NO: 521138 - DNA, 182 bp, Homo sapiens
gatcttattaaaataatgtctttttactgcctctagtcttctgtttccttactaatatctctctgtattattacagaaagtggagtattgaaatatcctactataattgtattgctccctttgtgttatatatcagtttagtatagtatttagctttatatacgctgacaaccccatatatg

SEQ ID NO: 521139 - DNA, 252 bp, Homo sapiens
  misc_feature (236)..(236): n is a, c, g, or t
  misc_feature (238)..(240): n is a, c, g, or t
  misc_feature (247)..(247): n is a, c, g, or t
cgatccgaggattcgccccaattaacctcactaaagactctcaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaattctacnannnttatganggtta

SEQ ID NO: 521140 - DNA, 421 bp, Homo sapiens
  misc_feature (399)..(399): n is a, c, g, or t
ggtgttggaaggttcctctctccaatctgtcaaagaaacatgatgaatgagggccctggaaagtttaggggtgacttgaaaatccctgggccttttgcccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtganacagcaagaccctgtctcaaaa

SEQ ID NO: 521141 - DNA, 240 bp, Homo sapiens
  misc_feature (195)..(195): n is a, c, g, or t
  misc_feature (236)..(236): n is a, c, g, or t
cagcgattcgttcgtgatgctctctttcacccagtccgactggctcgtgctcaggtagcactcggggctgctcgcgaactccggcttgcactcgagcacgagccccgtgcacaccacactggaatacgacgccaggaacgcggcgagctcgtcgcgaacgttcacgagcctggcgcgcgtctgcgatggatccantttggggttcggcggcagattattccgctggtagagccggntgag

SEQ ID NO: 521142 - DNA, 432 bp, Homo sapiens
acgaggagagagagagagagagtgtctgcctgaatgtgggctgtgtcttcaactacgaggacctaactgcgatcacggacatgttgctgtcctatattgtgccaactgctggccttactggtgccgttaggacatgctacatctctgtacctgccgataacactggtttgggctcccataatacttcgatttcccacgcttgccgcctcaccacgtacgattttcgctgactccattgggatcctgagtgttgacaatgtgatgcagagtggtgactatgtgtgagccgtcgaatccacgctgttgttcatgctaatcatctcatggttctgctttgagctgtttatacatcatgtgttccacaatcgcatcgtcacttatgattatgagcttgatttcgtgactagactattcattgttccttctttggcg

SEQ ID NO: 521143 - DNA, 768 bp, Homo sapiens
  misc_feature (25)..(25): n is a, c, g, or t
  misc_feature (48)..(48): n is a, c, g, or t
  misc_feature (61)..(61): n is a, c, g, or t
  misc_feature (90)..(90): n is a, c, g, or t
  misc_feature (108)..(108): n is a, c, g, or t
  misc_feature (123)..(123): n is a, c, g, or t
  misc_feature (126)..(126): n is a, c, g, or t
  misc_feature (135)..(135): n is a, c, g, or t
  misc_feature (157)..(157): n is a, c, g, or t
  misc_feature (163)..(163): n is a, c, g, or t
  misc_feature (188)..(188): n is a, c, g, or t
  misc_feature (192)..(192): n is a, c, g, or t
  misc_feature (206)..(206): n is a, c, g, or t
  misc_feature (230)..(230): n is a, c, g, or t
  misc_feature (232)..(232): n is a, c, g, or t
  misc_feature (246)..(246): n is a, c, g, or t
  misc_feature (250)..(250): n is a, c, g, or t
  misc_feature (259)..(259): n is a, c, g, or t
  misc_feature (264)..(264): n is a, c, g, or t
  misc_feature (271)..(271): n is a, c, g, or t
  misc_feature (293)..(293): n is a, c, g, or t
  misc_feature (306)..(306): n is a, c, g, or t
  misc_feature (310)..(310): n is a, c, g, or t
  misc_feature (354)..(354): n is a, c, g, or t
  misc_feature (370)..(370): n is a, c, g, or t
  misc_feature (384)..(384): n is a, c, g, or t
  misc_feature (404)..(404): n is a, c, g, or t
  misc_feature (434)..(434): n is a, c, g, or t
  misc_feature (586)..(586): n is a, c, g, or t
  misc_feature (625)..(625): n is a, c, g, or t
  misc_feature (647)..(647): n is a, c, g, or t
  misc_feature (664)..(664): n is a, c, g, or t
  misc_feature (676)..(676): n is a, c, g, or t
  misc_feature (679)..(679): n is a, c, g, or t
  misc_feature (691)..(691): n is a, c, g, or t
  misc_feature (741)..(741): n is a, c, g, or t
tgggcaaaatacaatttcatttaanaaattgaatttgctgcgcctgcnaatcacgtctggngtcggctctgatcagagacagaaagaggnggctgcagccccgggggnccttgtggtagcggnggngggagcggnggcgttgtacacattgaggganaaaaancactgtttggcccaggggaaccccncccncagtaatggaaacncagggcaggttagcattttattananaaaaacaggaaggngggngcctacccnccccngcctgcnactggctctgaagggcactccncaacttccccaanaaanaggacgcgtctcttacactgtgatcatgacaggggttcaaacanaaagtgcctgggcccnccttctaagttttnttaccaaaaaaaggaaaaanaaaagatcttctcagttacaaattctgggnagggagactatacctggctcttgccctaagtgagaggtcttccctcccgcaccaaaaaatagaaaggctttctatttcactggcccaggtagggggaaggagagttactttgagtctgtgggcctcatttcccaggtgccttcaatgctcancaaaaccaggcatggggaaggccctggcaaactgctccncccgttgcctgaggttggccanacgctgacttttttttnagttcttaagcnggnaggatttgaaancctggagcttggcagttttgctcttcacctctaagccaatgttgaccccntcatctataaagtccacaactctccgg

SEQ ID NO: 521144 - DNA, 259 bp, Homo sapiens
gtcacaagtggctctccatccccccgtatgaccactgtagtatcaccttgtggggggtgggaaggagcttggggtctgcaccgagtagacctgaggcactaatggccctcctgggcaggaggctcacgagaatgatagggttaaagcctaaaaccgtgcagtgcttggggttacctgttttatcaactaaaatcagcttttctccaagaagctgcactgcctattctttttgtgtgtgtgtgttctgatacggttttga

SEQ ID NO: 521145 - DNA, 152 bp, Homo sapiens
ctagaggaccccattgataattgttgtgatgaaatatgatggcccctcaagatatgagtgagacaccttgctaggtgtaaggagaatgatggttagtgtctacggatggctccatggttggtgagtatgttcccttgctaaggtggagggta

SEQ ID NO: 521146 - DNA, 460 bp, Homo sapiens
  misc_feature (102)..(102): n is a, c, g, or t
aagtcattggaaactcagtgtttttaatcagacataaacatgaacctgacatgggtggtgaaattaaaggtatttttagaaactatggtaattacatattanatatattttacgaagatagtttttacaatcagctggtaattacttcatcggacatctgaagtgaggaaatttggatttagtttgaatggattgactgtgtgtgtgtttatgcatatttgggcttatgtgccactttaatttcaacactgggcagctcaagattcactctgctcaacaagtgcttactgtccacatgttttagatgtgttacaatgtgtttcgactgtctggtgtcacagccgctgactcccagaaaggctacatatctcacacttaatgtacggacattgaagttggattgtgaggtcaggtgacaaatagctttgtcgacgcggccgcgaatttagtagtagtaggc

SEQ ID NO: 521147 - DNA, 483 bp, Homo sapiens
  misc_feature (319)..(319): n is a, c, g, or t
  misc_feature (325)..(325): n is a, c, g, or t
  misc_feature (327)..(327): n is a, c, g, or t
gcctttatcagtgcacaggacactcctgctctgcctccgaagaagcctgatcctccacggcataaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaagccttataaggcctctgcctcgggctttgcagtcttcacctctgtaagttgagtcctccgcctcccggtgtcctcaaacnctctcnanctttcaccctttaccaggcttatacagcttccctgggatttttgtctccttttaaaggcaaacctcccagcttctttagcctcttggtacctcacactctctgtccctcgcgttatttattctaccctgccacttctgtaagaaaaacagtttctc

SEQ ID NO: 521148 - DNA, 1072 bp, Homo sapiens
gccgagccggggctatttctggcgctggtcgccggctccaagaatggcatccgcatttgctaccagcggtggccgcgtgcggagccaggcctggtcctctagcgcccagacaccgccgctcccgggcaacccgtgtagctgcgcaccgcaggccggcggccgagctcgcgcatcccagccatcacgtcttccaccgtgtctccttagagaagggaagatgagtgagtcggagctcgaagtccagactcagcccttggcctccaagcatggaacaccaggacgtgcactgagaagctggggccggcgagcatggccgcgcaagcaggcctccggtcgagtcccgcgagacagcagctaggtcacgggagtcaagacaggacgcccagccgaagtgccaactagctagagagacctcggggaccgaccaaggggaagcaaaaacaaggtgtgctgccaagtacccgtgaagaccaggcagaagctccaggaaggaaaccaaggggcagacccatacaaggctggacgaagcgaggacagaggagcggcatcctcgccaaggactccgtcggcagcgagggagccagtgcacaccagtgacgatgccagatctggcactttcattgagtagcggaggcagttagcgtgtctggcgtactgacacagaatctggactgcacggatcagcagtggggacgccggcgaacatacaagccgaagacaactacccgcacaagacacaccgaagcacggcgagggaatcagaactaaagcaaaagctgagcccaagaaaccatgggaacgcaaacacgccagagcacgagaactaaatagccagggccatcccaagggcacaaagaaagggagtggcgaaaaagacaccaggagcaccaaaaagacccacggcagacggaccacgggaaaacagggaggccggatgcaaggaagcgccacaccagaaacgaaaaaaaagcagagccaagaataggaggagagaacgcaccaaagaacacacaaaccaataaggaccgagagccagcacagcggaaagacacaacgcggccccaccaaaagg

SEQ ID NO: 521149 - DNA, 1838 bp, Homo sapiens
  misc_feature (1)..(1): n is a, c, g, or t
  misc_feature (308)..(308): n is a, c, g, or t
nttactctctcgattgcaggttgggggtatttttttttactgaggctctttttctccgctcagtggcattggtttttccttcagcaggtcgtttttacacatacattgggtgcttccctactaacttgggccgcactgttgggtgttcgcacagtgatacctacgcacaatacactacggggttgtgccgccctagtaatatgtcgctgttctattagttcgccgcccgagggggggcacaattacacccagccacggaagtgttgtactctctcccttcttccattaaagataatatctggcgcgtngtgaataaattcgctgtgtgcacacacgacgttgtcgcgaatgtcggccgcacatgtaccatgtttgttgtgagtgccgccccccctgtttgtcaccatggagtcttcgtgaccacaacgagtggggccccgccctcgcgcctcatgaaatatttcttctggggggcagacgttgctcaacgccagaaaaaatttgggcggcccaacaatttccagaaacaccccctgttgtaatgtttgtgctgcccacacgaagtattcttttttaattggggagcaccaaaataaacctggtttcgcccactaaggcggtacctcacacgtgtgccccacacgcaccctgtgtggtacgcccaacgccccgacgctttttctctttacaaggcggagatatattttcgtttctgtttcagaaggcagttatacaccgtgttgttgtgaggatttgtgtccgctttgcctgttgtgataccttccccgctctgtgttccgcgtcctcgtctgggagagagttctcttggtgttcccccgcgaagaaagaaagggtgtcccacgtgttggcgtggtggtgtgagtttggtttgcgccgacgtgtccccccacaggtgtaagttcgccccacacgagtgttctctcggcccacgggagggcccacccccccacaccgcgtagtactacctcgtgtggcttcttatcaccatgggggcttctcctccttttataagagctggagacaattataggagagaggttttccaccgcgcgtgttccgtcccacactctctatagttgtcacccctatataaggagacgcggagtgttggtaaaactcttctctctctcacggcgccccacaggagacaagcgttagaaatgttctctgtttctctgtagaccacactctttctctgcgggaacactcctttaggttctctggaactatatagagtgcacctcgtgtatgtcacacacagagtgaaatatggctttaagagtgtacactcttctctctcgtgcgaacaccaatatctggcgcactagttgcttaaatatgcgccgctctgtaaaaggagagacacccatctttctctgtagacttgcgtggagacataccacatggctgctcttgccacattcttctccagaagaaacccacgggggatggtgcacactcaccccgcgccaggtgtaggtttcagaatagtgggtgttggtcgccatagtttaatattccccttctaggaggatttccccagaccctgttctctctgccgtacaagagtggtgataggtcccagctctcccagaagaatagtgcttataaatcggaccctcggcccttgttttaagaatccgggaggccccacttcgggattttattagtataagccccttccctcccacatccccacccagaaccttgctccatcttttcgcagtttttaacatagactcaccactcttattgagacttaatatttgtcctcttaggatttatttctcttgccccaacaaaaagagaaaaatata

SEQ ID NO: 521150 - DNA, 179 bp, Homo sapiens
tctgagacggagtttcgctcttgtcacccagggctagagtgcaatggtacgatttcggctcactgcaacctccacttgctgggttcaagcgattcccctgcctcagcctcccgtgcatctgtattcaccctgtatggacaaacacattacattattaaatgtttctcaaagagggagtt

SEQ ID NO: 521151 - DNA, 104 bp, Homo sapiens
ggatttgctggtgcagtacaactaggcttaatagggacatgcaaagaaaaataaggttacactctcaacatttagaactcctttataaatatattgtagcaaaa

SEQ ID NO: 521152 - DNA, 208 bp, Homo sapiens
tgagtgcaggagtcgaatggatgagggacatggagagcctggggccctgcgcgtgaggtatgtgaggggcgtctaggggataggtcaaggtaggttttggtggctgctgcggtggtggtggtggtttttgttgttggtttgtggtttttggttggttggtgtgaggggggaagagggtggaggatgaggaccccttagcacatgggag

SEQ ID NO: 521153 - DNA, 367 bp, Homo sapiens
gtcaccatggctgttactggctcccttgctgtccccaactgttcctcaggtcacctccccaccttgctgcctatgtcccgagggagtgcacaggttccagtggatcagaaacctggtcccagaatttggagtctccagctctcacgtcagggtgctctcctctcctgcagagttcttcgagctcttgaaggggcagataaaatggccaagaggcgagtcgtgatggcatccctttacctggggacaggacctttggagcaggaactggtggattgtctggaaagttctctggagaagtcactacagtcgaagtttccttccgacctcaaggtctctatcctcctggacttcacccggggctcaagag

SEQ ID NO: 521154 - DNA, 765 bp, Homo sapiens
agctcagagcagcttggcggttcgacgaacggctctgcttgttagattgtagactgcggatcttcctcggccttcttgatgcgtccagctggtctccgatgtgtgctaaaactgtctaattaggccgagagaatgtgtccctatccaatcagactgctagttagtccacccagggttaatacagccgcttacagctggacacgaacgcccgcaagatacgcgctacctctacctgcggggacattaagcctcatcgctacaggctcggtaccgtggcactcacagagattctggcttgtcaaaagtctaccgagctgctcatcctgaagctgcccgttcagaggtttgtgagggacatcgctctggattctaaaaccgacctgtagtgtctgagcgcatccatcctggctctggacgaggctatctaatcgtacctggtgggtctgctcatactctccaacctgtgtggcatcacgctgagagagcgaccatcatgtcctaagacttcccactgtgcttggcgatacggtgagagagagttaacttaaagcacactttatggcgttttgaataaattctgtaaatactttggtttaactgtggcttcgtctggagttggctttatatggtgcatttgtacttaagcattcatcttttactcagtatgacgcgtactgttacagactcaatgtgtggccctgtttgtcagatgacactggtaattccgaagggagggtgcttctggtttcataccctggtccgtgg

SEQ ID NO: 521155 - DNA, 345 bp, Homo sapiens
tcgaagatggcggttggctgactcatgggaggaggcttgctggaagactgggaggggcaccgcttccgtggcctcaccgccggagctcctgtctagcactgagtgtcgcttgtggttgcgctcctcacccatggggggatctactcgtaagtcttcaagacgtcggaatttgccgaggtattcttgcagtatggggtcaatgtccaaatttttggcttgggactatttcaggaaggcgcagaagttgtccagcccatacagttggtcagcttcatagtccttcacggtttgctcctgaaaatgcttgaatatggtcaaccagagcatgttcgagggtaccgagct

SEQ ID NO: 521156 - DNA, 304 bp, Homo sapiens
tcgtagcggagattcctttgtctttaaaaaaaaacaaaaaaaccccccagccgggcttatcaccttgaaaatcacgagttcaagaccagcctcgtcaacattggtgaagcctcatttctactaagaaatacaaaaactagccaggattattagagcgcactggtaatcccagctactcaggaggctgaggcaggatactcgctggaacctgggaggcggaggtaacagggagtcatagagtgcacccacgtgcacctccagccggggggtacagagataaaccacgtgatctcaaacaagtaac

SEQ ID NO: 521157 - DNA, 182 bp, Homo sapiens
accaactcagccatttcttcatgtccattcatcccaggccttttctcaactcacacaccatttgcgttgttccactccattcacacttgcaggccatttcatttttctgtgcataagcacccaggccaacagtccagcctcttgcagtcagctgggcactcacaggcgtcccaccaccacac

SEQ ID NO: 521158 - DNA, 481 bp, Homo sapiens
ctgactctgaggacccctctgctgacatttgtagagcatgtcgcttgaagtctactttatctacggtggtgccctaggaccacaaatacgtatttggagagaggtgtagaaatctgtattgcaccacctggaacactgattgactttttagagtgtggaaaaaccaatctgagcagaacaacctaccttgtccttgatgaagccgatagaatgctttatatgggctttgaaccccaaatcaggtagattgtggatcaaataagacctgataggcaaactctaatgtggagtgcgacttggacaaacagaagttagacagcttcgtaacgatttcctgacatactattttcatatgaacattggtgcacttgaactgagtgctaaccacaacattcttcagattgtggatttctctcatgacgtagaacaggctgcaaaacttattcgtctaatggaagagatcatgagtaagacggcgcat

SEQ ID NO: 521159 - DNA, 460 bp, Homo sapiens
  misc_feature (413)..(413): n is a, c, g, or t
gaggaccccgcagcttaagggctacccatcatttgtggaggcatgttttgctggtttttggtgccagggggagcagagacacggtctgggccaatctggaatggaaattggttctcgccgccgcctgctggtcggcgctcagtagcagctgtggcagtggcaggataggcattgccatactggttgtatacatcttgctgaggggaaggctgtacagcttgttgctggctggcaggctggggctgggctgggggcaactgctgctgctgaggctgcccctgcccagtgctgtatggcacgctgtacatctccccttcgtgccgcttggcaggagggccatatgtgccatccattggccgcttgtaattctgctgttgctgttgatacattgtagtctgctggctggagaaggngctgccagaaggggtgccttgggtggagaactgattgccataggaat

SEQ ID NO: 521160 - DNA, 129 bp, Homo sapiens
  misc_feature (78)..(78): n is a, c, g, or t
tgttaaatgttgcagggaaaatggttatttctcgcttgtggctagatgtctgcggctgtgatagggagaagagcagcnaaagagatgaggagaatgcaattcgtacttctctcctcgcttactacgcct

SEQ ID NO: 521161 - DNA, 317 bp, Homo sapiens
gactcctctcctagtgtacagtgcccaaatgatgggtttggtgttcactccaattcctatgggccagagtttgctcactgcagtgaaatacagaggagttcgctggccaatggttgggcttatgatgactttagttacaccaccttacttcttgagatgaaaatgacaccaaagtcatcaagcagtgctatcaagatcacaacctgtgtcagaatggttcagtatcaaccttctcactatgtgtcatgaagctctttacacacatggatgctgtcatcagaactggcacctgcatgcggggagctccatcccaacgg

SEQ ID NO: 521162 - DNA, 156 bp, Homo sapiens
  misc_feature (85)..(85): n is a, c, g, or t
gtgacctagaggttccctggttgtccaagatagcatcttagttcaactctaaatttacaaggggatttagagggtactgtgggcnaatttaaagttgaactaagatctatcttggacaaccagctatcaccaggctcggtaggcctgtggtatcga

SEQ ID NO: 521163 - DNA, 563 bp, Homo sapiens
cggaagccaatccaaggttcccaaatcgcccgcacatccacttaggctcctagcctcatagtccgcctacctcaacttcccgggatactaaagttgtgaacgtagaacgccatacctaacctggtgcaggttcttggtggacgcggtggcaatgtgtccctcccctttcctctcgatccctgtcctctttcttcgaaagcttttatcgtctcttgctctactgcctgctcttctataggtagtttcttgaatttcgctttccttctttgtgaggtgtttcgtcgttctttatgctaggagcctcgttagaaggctgaccgaggtgtttcttgctcctgaacgtctgaaggtccgactttgaagggaatagggtttatgctcgagggctgtgttagaacttgggagtgatgtgtctgcttacctgtctgattttcgtatcttctacttccttatttttattttagagcgaaatcccgctctataacccgagctaagatgcgattataccgtcgcgactcgctgcgacctcggcctaaactcggaaagttctcctgtatcgaccc

SEQ ID NO: 521164 - DNA, 454 bp, Homo sapiens
  misc_feature (444)..(444): n is a, c, g, or t
acacatctggaaacatctgggggtgcttctcatggtggggcttattcattagagcccatccagaagtgccacatcagtctccacgaattaaaatcaggagagctttggccatttctcatttgaagaccttggctaactgaaagaaatccacattttaataacattttgaatgggttgataaaacaggaacagatggttaaagtttgtcattttagggaaaataatgaaatattgtactgcttaatctgtcttcctgtcacactcttccctatcccctccctactgaaaatatattcagatgcaacaaaacttaaagcaaaatactaatatcttcttagacactttaggtctcttcacctgaaagtgctctaattgtgtcagccatctctgtgttaactttatctttttttttttccagcctaggtgacagagtgagactccatntcaaaaaaaa

SEQ ID NO: 521165 - DNA, 358 bp, Homo sapiens
tgacctcgcagcttgggcttggtacgtgctatgaagacgcttggacccgttccagcttgcgtaagcaaacctaccccggatctctgtgcttcagctcgccagggtgcagtgggagacctggtcctctttcccttctgtatgaagcacaagcctcagggaaggggaagcaggatgcggagggccaaagcccgggacctctacttgaacagttctactggggaggctggagaactaaggaaacacctgtacatagtgtccgctgcccttgactcccgcttagcacacccttaggcaggcgccccttccacctttccccgagaccgtcgtcgctggagggggcagggtccagcccgcctgg

SEQ ID NO: 521166 - DNA, 322 bp, Homo sapiens
agcaagatcaccattggacagatcaactgcagaaaaccaacaaagacacattggacttaatccgcactacagaccacatggacctaatagatatttatagaaaatgtcatccaatggctgtagattaaacattcttctcctcagcaaatgaatgattctcaaggacagaccatatgttaggccacaaaacaagtcttaaaacattccaaaaaactgaaaccatatcaaatatcttttctgaccacaatgggataaaaccagaaatcaataacaagaggaattttggaaactatgtaatacacgaaaattaaccaatacactc

SEQ ID NO: 521167 - DNA, 234 bp, Homo sapiens
catcatgatcgctcgacatcgatacgagggatttttagtattttaatataatacagatccaaagagagggtggggttcaactcagtacccagactggtaaacaagtcggcacggcaggtgacagacccgctgcggcctctcagagagtgaggatcacaggggaaagccatccgtggcataccgctttaaactaaatgtagtcgcaaccacaagtcatcatataatacaggcaat

SEQ ID NO: 521168 - DNA, 883 bp, Homo sapiens
cactctcaggtcgcttgcccggtgtcactcactgtatcaggtgtaatgaagtcattcaggcgtaacagtaattacgcggagagatgtaaagtgaaatatttctttatgggcatttcttttatggtcatcgttgggccggtactttgccctgatgatctaaaagcaaactgtgcaatgaaaaacaggagccatcaggctcctgttgcatttctgacgacggtgtttattccgcgttttcgtgaatatgtttgctgctggcgggtagtaaaccgtcggcacggaacatcgctttaatccctctgatggcctgaggaatacggtcgcggtttttcaatcagtgcaaagcgaacatgcgtatcaccatagtcgccaagagccaatccccggcgagacacaaagcttcgcttcgttaaggagcttcttggcaaattccaggcgatcccatgggccgcatatggttccgggatttatcgcccagacatacatcgagagccttcggcatttcaaccatccagcccgacttcatgcaggcctttaaccaatacatcacggcggcgttagtactgttcggcaatgtcgcgcacgcactgttgatcgccctccagcgccgaatcgccggtactgcaacggcgtataggtgccgtaatcgtgatagcttttatacgatgccaggtcgctggcatgcgtttgtgtgccaatcattaagggcgatacgccacgtcctgcatgttggtgctcttcgacagcggtgaagagctcgatgtgtccatcgcgtggccccggtgtcttgctattgcgggctttccgctcggtggagaattcggttggccggtttgacccagcgccttgtggcgtttgcaggcctattttgggaccgtcttcc

SEQ ID NO: 521169 - DNA, 232 bp, Homo sapiens
  misc_feature (125)..(125): n is a, c, g, or t
  misc_feature (154)..(154): n is a, c, g, or t
ctgggtatgggtatgcccccaaccaggctcgctattatgaacgctactatgcaggaaggccaggctattgcgtcagaaatgactctgatcctacctatggccaacctggtcacccaactacctgnaaacggtaaccagggtacactcctcttgnagcagggaacctaaaccctcctggcatgtattcagtccctggtcccaagaagacctatatacagatcctgggtcagcc

SEQ ID NO: 521170 - DNA, 151 bp, Homo sapiens
agctggagtggatgtgtggagggtgagtgctggaaatgatgtgtggggataagacgggaagtgtgagtatgtgagtatgtgtgccagacaagtggtgtttccagtgtcaatgggagtgtttctcatgagagatggtgatcttggatggaga

SEQ ID NO: 521171 - DNA, 924 bp, Homo sapiens
  misc_feature (508)..(508): n is a, c, g, or t
ctcagagactcgccattagcgcgattcgccgcccgtgcacacccgccgcatagtgtcaccatggatgatgatatcgcccgcgctcgtcgtcgacgatacgagctcgcggcatgtgcaagaggcggcttcagcgggctgatagatggccctccgggccgtctgccgctccatcgtggggcgccccaagcaacagggcgatgatggtgggcagtggggtcagaaggattccatatggtgggccgacgaggcccgcagagcaagagaggcatccgtcatgcgcatggaagttacaccgcgatcagaggcacggtgactcggtcgacgcaacgtgggaacgacatggagaaaatcgtggcaccgacaccttctacaatgagctgacgtgtggctcccgaggagcatccccgtgactgtctgaccgaggtcgcccctgaagcccaagggccaagccgcgagcaagatgattccagatcaatgttcgaggacttcaaacagccgcagtccatgntacgttgctatccaggcctgtgctatcccgtggtatcggcctctggacgtactcactgggcatcgctgatgggactccggttgacggtggtcaccaccacatgtgagccatctaccgaggggtatgcctctcccccaatgccatcctgcgctcatgggacctggcgtgggcgggaacctgactgactacctcaatgaagatccctcaccgaagcgcggtgtaacagtctttcacccacacgggcgagcgggacaatcgtgcgtgaacattagggcgaaagctgggctacgtcgcgcctgggtttcgagcacaagatggcacgcgtgcttccacctcctccctggagaaagccccagcgtggctgaggccagcatcaccctgggcaacgcggtcccgtcccgaggcctcccctccta

SEQ ID NO: 521172 - DNA, 194 bp, Homo sapiens
caggttactagacttactgagtgatacaccggcagtgatgtctgtggacctaggcagtgagtctataaggtggccattgtcaacctggagtgcccatagaaattgtcttgaataagcgaatctcggaggaaaacaccggtgatcgtgaccctaaaagaaaatgaaagattctttggagacctgagcaagccagg

SEQ ID NO: 521173 - DNA, 970 bp, Homo sapiens
gcgggggaggctggaggtcgctcgctcgctcgctcggtcgctgactcgccggagcgctctgtggcggtcggtggcaggtcggtcgcgagagcgggctctgtggaagggggcgaggctatgtcgcggtggcaagcccggatgggccggcagtgccgggagtaacgggacgtcgccgcggagcttcttcccccgggatacagtgcggccgagcgggaggcctgtgggtgcctgcctccggatcttgaagagccctgctgcttgctgctggagccctgcccctgctgcggcacctgtgcacctgactgcgggagcggaacagcccagccagacctggccgggctgctggcctgatctaacccagccaggcagggcaatatagcccctctggaggatggagctccttcccccaaagacatgaagctattggagaatcgagctttgaaggccatcaatcacaaagctgactgtggagaccggagatgccccacatcattggcaggattgagagctactcatgtaaagatggcaggagacgaaaaacacatgttcaagcagttctgcaggagggccaagccccaccgtgctggaggcactttctccaacccagacttcaggactgagcccaggcagatcagaaaagccagcggtgaggaggaggggccctcaggtgacaagtgcagcgaaagaccctcttctactgattgcaaggccaatgggtcttaggctgaatatgacttcagcaaaagcccgagcatgagtcagcggagccagcttagtgggtggtgatgagcactgagctgtccaaatgcgggaggcatcaggttgaccagtgtgagcgtggcagaaatgcgctgagtactcaacgtaacaagtgtcgactgggaaggacgctaatttaaacgcagaacttaggccagccacaccaaggaggagtatgaccacatcccagatagaaaaaccccaccgagtg

SEQ ID NO: 521174 - DNA, 644 bp, Homo sapiens
tggaattctgctcaagtgatgagcaatatgttcaaaagattataaggaggggagtaacagttgggattaatgtgtattctggagaatctcaacaaagtacaattcatatgttcgaattaacatacagacttctgcacaggccagagaggaataagatcgcatctacagctgtgtggtgattttctttcacaaatcactactaagttattaaatgtgatttcaaatggtgtgtatctgtatcacattggacataagtcagattgcaaggctcaatggaaagtcgaaaagttaactcatgcaacataaaagagacatcgatatgcaaaacaaaaccatatattcatttacttctgctgcacgttttcttgactgctgaatttcgtaagcagggattggtcagggtgggtcttggggctgaagacctggcgaggagctggtgctatcgctgtacaaatctgaaggtgatggaaatggagccttggggaggagccggtgctgccttttaagtctatgagagtcgtagagctggaggtccagggaagagctggtgctgccactgatgtcttaggtagtggagctaaagacagtgaaggacatggttggttgtctgtgcagggtcgtgagctggagatccaggtggaaac

SEQ ID NO: 521175 - DNA, 139 bp, Homo sapiens
  misc_feature (84)..(84): n is a, c, g, or t
  misc_feature (127)..(127): n is a, c, g, or t
ggaggaacagaagctgaagccgggagagtgggagccccctcctcttcctccccctctccctctccgtcggcccggccagggggncccccgtctgaggaagccatggatttccgggagggtggtcctnagtgtgagattt

SEQ ID NO: 521176 - DNA, 371 bp, Homo sapiens
cccgcccactggagatttagtcttcagggtttctaagctgcttttgaccatgcagctatggccaaaaacagaattacaacctagggaaaaatttggtgaggacctaagtgataacactggggaatacatatctgccattgatctgctctgctgccatcagaaatggatctggtcgcatgataacatcatagggctagttattttactaatctacataaagatatgttattgtaaggttgaattgttgatcactgaatcgaggcttgaatcatttttgtcgtttaagtgtgtaaggcagatgaaacatttacaaattacaccgtttttattttataagagttaataaaactacccttaagataccttcatca

SEQ ID NO: 521177 - DNA, 303 bp, Homo sapiens
gggcgggaccacagagaccacagaataacaacaccaagcagagacagagaaaggggaggggaaaaaggggagagaggagaccaggagacccacaaagtacgagagacggggaccggggaaaacccggagaactggattaggagaagaacagcacacgtaaggtccccacccaatccctgtgcccaacaacctcaaccaaagacctcgcaacactccaaggaaaaccctgcggctcctggattcttacaccaagcccagctaatattagtcttttcaccatgttggcccagctggtctcgaact

SEQ ID NO: 521178 - DNA, 314 bp, Homo sapiens
tggtatgcacaactagggtcagtttgcaggtggtagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 521179 - DNA, 111 bp, Homo sapiens
tactggtttgcagcgttactggtttgcagcgatactggtttgcaggctcttggtgaggaggtacaggagttactccttgcaggatcttggtgagggagggtcttggtgagg

SEQ ID NO: 521180 - DNA, 197 bp, Homo sapiens
  misc_feature (82)..(82): n is a, c, g, or t
tgtcctcggtgtgatattgcttgattattttaacaaacagaagtcagtaacggttttggcatgaaatagtcataggccaagngctctcttctttgatttaaggctcttgggggtcactgaagtgtcatttggaaaatgacttcccaatgcataatgatcccctaaagcctgtcgtaagtgctcttccgggagagcag

SEQ ID NO: 521181 - DNA, 432 bp, Homo sapiens
ttctcacagtggcttttggtgtttcgggaccaacagactgtaaagaccaaagaaaacttctccttctccctttgaagatttgctgaaaagaggaagattaataggagaaaaggcatacaaatgtatttgatgatagtttcacgtgacacaggagccttcagaatgaagacccaaagatacagaagaaatggtccatttttacactgaggtttaacgaaatatggacagccgtgtcgaaatatgactggacaaaaagggtgtgatctaatgctaagaacccgagaaggaaacctagcaaggcctgtctgtctagattcttcttggcctctctgagcatgtgggttttgttttgttttgttttgttttgttttgttttgttttgttccaatctgggtatggggcaggaccttctagaatggaggtcttatggcc

SEQ ID NO: 521182 - DNA, 367 bp, Homo sapiens
  misc_feature (17)..(17): n is a, c, g, or t
gcgcctggctaattttntatttttggtggaggcggggtttctccatgttggtcaggctggtctcgaactcctgacctcaggtgatcctcccctctcggcctcccaaagtgttgggattatagacgtgagccaccgtgcccggccagctatgggcgtctttatggtttatcagtaccagtctcccaaatgaggaaagatggaattatataaccttatcttgattgagtacctgggccttaattttatactttaccatacattgatggaataaagcttccagatttcactgtgtattaggagatttcttttcatgctttggtaacttgaaatggatttgtggaattgtttccaattagaattagagaaa

SEQ ID NO: 521183 - DNA, 1180 bp, Homo sapiens
ggtatatgcagcaatgagccaggcatcgggccgctgatgagggatataaagaacaggagatttagccgaggactgtgactctacctggcccgtcctgtgagagatgacgagtggcatgtgatgcttctacgtgatacaagtaagagagtcacttcagtcttcggagccttccgtgtggctgaacgtttacacaggaaagctctgagtgtaccagcgaagtgcacggatgagccctagtgagcgattgcttatatcgttactgtcggtggcgactgactggcgccgatgccagcagtagggagtttcagttgcacgttccctgggactctagctagcagtagtgaatgaatgaacgatgagggaagcaagtgttggtgaaaaatagggcttggggtgccttacagtggctgacatagccggatggaagggatctctgggcgatgtgcgcctggcgtcagaggagagaaccttctgcatggcgtagtttgagatccagatggccggcgccctccgtggggtaacggcacaacggtgtcataacacataggagggatcggaatcgtgaaccttggaggacatcttcattgtaacattggccgaatggcaagaacgtggatggcaaaggcactcagagggacccagtcgagttaagcagattggggtggccaatccggcgaagtggggccggaaccgaacttggtacatcctccttccattgagaggccccgttcgtagatgcgcctgcaggccgaagacttaggtgacaaatgttcggtgagtgagtccgtcggaacgttccaaaggggtacgggaaaaaccgggagggggtgacaaggccacaaaggggactggtggttgggcccctggagtttcgccaccaaggaatggggagacgtcaggcaggaacacaagttaggcgccggcactaattagaggccaaattccccacttttgcgcggggtaccttggagtatgccctccggggagttggggatctcggcttgaggaatgcttggcaattgggcgggcccttgtggaacgtaccgagtgggaacagtgaattgcgtgcggtccacaggcgttgtacatagcgcggaaccgctgggggtccaatcgggaggttgtcacccgtaaggaggcacttcaagacaagcgtggactggatggcccttggaggtaa

SEQ ID NO: 521184 - DNA, 202 bp, Homo sapiens
  misc_feature (174)..(174): n is a, c, g, or t
gcgtatcgtacagttgagagagtgtctcccctcatcatttcctgaggacagacttagtatgcctgacaggagatgaagtaagaagatttgcatgcagcgggttcattaaaatcgatggcaaggtccgacactgatataacctaccctgctggattcatggatgtcatcagcatntgacaacgacgggacgagaatttcgcgt

SEQ ID NO: 521185 - DNA, 141 bp, Homo sapiens
ttaatggcatctccaacaccttcagcttatgtgcctggtctgtattggcatctccatttatctgcagggtaattcccctccttgccagcatcagcttatccctctatttccctatgggataccttctctcccttcttagcg

SEQ ID NO: 521186 - DNA, 937 bp, Homo sapiens
taaggcccattggagtatttggtttacaataagggaaatagtgggtattaggattaggatggtggtgaagtttagtagggatgctactggtccaaggatggtaaaggggtagcttacgggtggtcctcgcgattcaggttaaaaggaggaggtcggcggctaggagtcaataaaggtgatgggcttagtgggcgaaatattatgcttggtggttgggatatatggaggagggggataatggctaggatgaggatgccatagtaatagggcaaggaagcctcctagatgtgtgtgagggacggctcggaaaagtgtgtaggcgaataaggaaatactcatcgggctgaggtgagggaaaggggtcgtaacaaagggggtggcgcctacgggaacacatcggtccggggtccgccaagagaaggtccgggtcgacgcaaactcggctgtcaccggtccaatcaacggcgaagacgactcgaacgaagaatgtaacgcccgagcggcgccatcgactgctcgtacgcaccgcggtgggacacggggggctataacccgaaacggggagggagaaaccccaaagggggagtagacagaacccccgttcgtgcgggcacaaactcgcaaggcgggggtgccgctgacaagcgggcgcgcaaaacgtgaagcggccaaatgcaatgggcagcggcaagaaccgtcgtgagggagcacacggtatacaggagagcccccacaggattacatgaacaagcgccccaggatgggagggggcaacaaggatcggcacaggtgggcccccaaaagtaatgggcccacgggagaaaaaccaaagagggggtgaaagtgaccggaagaaagcacgaagacggtcggcaagacaacacaaaagacaccagtgtaaaacgaacaattgggcgaacaacgatacacgaaacag

SEQ ID NO: 521187 - DNA, 1120 bp, Homo sapiens
  misc_feature (155)..(155): n is a, c, g, or t
  misc_feature (283)..(283): n is a, c, g, or t
tatagttaaacaactttattaacatagtcaagcagggattaacattcacttctattatgtcacttcattacaaatgtgttaaattacaaaatttactacagtacaatatatatttctcgtgcatgtgactccaaaattattgtgggtggccccanaaaaacctctcttttaaaatctcagcagcctttactcaaaaatttaaaaccgatattctctatttaaagagtggaagaactctgtggttagcacgagagagtttagaacttctcaagaaatatactcnaattatagttacgaggttgtggaaaagttgtgcgaggaaattagtgggtgtgaagaggaccactttcttaacattgagtgtgggtgggcgggtgttacgcggaaaaaacaactcgcgatttttaagaggctttttataaagccattatactctctattaacaaccctaaagtcgtggcctcagccgagaaagagaactcccagtgttcactctctatataacttaagagccagagttaccaatatctataaaggttatattggtggcgaccccccaaaggggtgtttaaacccatgttgaatctaccctaaaggggtgtttacaaacacccttttttcaatataatatatgtggaaagggtggatttttttcaccccatgtggtggtttaaaaggccatatctctcttatagagaaagggatattaactcaatagcggtggagtataaacacaattttaaattttaccaatgtaagtatattatcaatatataaaattttaaatttttaaacgccatttccccaaaaaaaaaaaaacaaaaaaaacaaaacaaaaacaacacacacaacaaaaaacacaaaaacaaaaaaaacaaacaacaacaaaaaaagggagaggagcccgcccacaaacaaaaaaaacacccccccgagaagagacacccaacacccaaaaaaaaacacaacaacaacgaccaaaacatagagagaaaaaaaaagagacgccccaaaaaagcgcgagaacccaatataaaacaacaccgagagaccagcgacacaaaaaaacaaacaaccgtgacacacggcagaaacaagcaacatgcaacggaaacaactc

SEQ ID NO: 521188 - DNA, 277 bp, Homo sapiens
cttggccggaactacgggaacggagcataagcttcactggatgattggcggcaactatcagcacgatcgcgtatccgatgttcagcatgtcgagaatcagggcagcaactcgggtgtcgggcccttccgatttcttaaatttgataacgatgcctcaaggcagcacatcgagacaaaagcgattttcggcagcgttgattttgagctgattgacacgctggctctgcaagcctcaacgcgctatacggaacaagatcggaatctgcatggctgcttg

SEQ ID NO: 521189 - DNA, 373 bp, Homo sapiens
  misc_feature (184)..(184): n is a, c, g, or t
  misc_feature (232)..(232): n is a, c, g, or t
  misc_feature (263)..(263): n is a, c, g, or t
  misc_feature (295)..(295): n is a, c, g, or t
  misc_feature (324)..(324): n is a, c, g, or t
gggagcaccgggttcagggcatgagagaatggactcatttctgacatgtgcctcagtgtcatccaagtggagatgtccattaggcaggagtggggctgaacttgaaaaaagaataggtaataatgggctgtaaatgaacattgaagccttgggaagtaggtaaaataacccaggagagtgtgtnaagtgaaagaaaatagaagttcagaactgaaaaagcatttaagggatntgcaaagaaagagaacctgccgaagacactnaggaagaggagctgggaaaataggacaacagnagagggttaggagggagggtttttttggngaaggcagaagtgattgacaagtgacacaattccacatagagggttttt

SEQ ID NO: 521190 - DNA, 514 bp, Homo sapiens
taaaacgacgccgggggggcagcaattcgtgaaatgacaggccgcgcccgcgaaacaggagcccaacatgacaccggcccccagggaggcgtgctgtgccacttcatccagcgcccatcagtcgccttggagcatcaggaatcctgagggctggggtcccggaggatcacagatgctggggcacctcaaccccagggagccgctcgagaagtttcttttctgaagtgtccacctccttctggtcaccggctggagctgggacaggtacatcgtctgtgtctgggtggaacttgagctgcccctcagggtgggcagccggggccttgtggccttgctgctgttgctgctgctgcttccgctgctccatgtgcagcacagcctgctgcagctctcttttctgggcctccaggcggccctgggaccgccctagagcctctgtctcctggctgaggcgcctggccttggcattcagctctgcctcccgggcaggcagctcctcttcaaagcgcctcag

SEQ ID NO: 521191 - DNA, 751 bp, Homo sapiens
  misc_feature (25)..(25): n is a, c, g, or t
  misc_feature (65)..(65): n is a, c, g, or t
  misc_feature (69)..(69): n is a, c, g, or t
  misc_feature (71)..(71): n is a, c, g, or t
  misc_feature (91)..(91): n is a, c, g, or t
  misc_feature (97)..(97): n is a, c, g, or t
  misc_feature (100)..(100): n is a, c, g, or t
  misc_feature (183)..(183): n is a, c, g, or t
  misc_feature (197)..(197): n is a, c, g, or t
  misc_feature (217)..(217): n is a, c, g, or t
  misc_feature (251)..(251): n is a, c, g, or t
  misc_feature (256)..(257): n is a, c, g, or t
  misc_feature (262)..(262): n is a, c, g, or t
  misc_feature (264)..(264): n is a, c, g, or t
  misc_feature (271)..(271): n is a, c, g, or t
  misc_feature (274)..(275): n is a, c, g, or t
  misc_feature (281)..(281): n is a, c, g, or t
  misc_feature (291)..(291): n is a, c, g, or t
  misc_feature (297)..(298): n is a, c, g, or t
  misc_feature (301)..(301): n is a, c, g, or t
  misc_feature (306)..(306): n is a, c, g, or t
  misc_feature (309)..(309): n is a, c, g, or t
  misc_feature (312)..(313): n is a, c, g, or t
  misc_feature (316)..(319): n is a, c, g, or t
  misc_feature (322)..(324): n is a, c, g, or t
  misc_feature (340)..(340): n is a, c, g, or t
  misc_feature (349)..(349): n is a, c, g, or t
  misc_feature (357)..(357): n is a, c, g, or t
  misc_feature (412)..(412): n is a, c, g, or t
  misc_feature (488)..(488): n is a, c, g, or t
  misc_feature (498)..(498): n is a, c, g, or t
  misc_feature (500)..(500): n is a, c, g, or t
  misc_feature (511)..(511): n is a, c, g, or t
  misc_feature (515)..(515): n is a, c, g, or t
  misc_feature (520)..(520): n is a, c, g, or t
  misc_feature (549)..(549): n is a, c, g, or t
  misc_feature (566)..(566): n is a, c, g, or t
  misc_feature (627)..(627): n is a, c, g, or t
  misc_feature (640)..(640): n is a, c, g, or t
  misc_feature (671)..(671): n is a, c, g, or t
  misc_feature (747)..(747): n is a, c, g, or t
ctccaattaaaaaaaaacagtaggngcttttgataacattaaggtcaagtgatttgtggagatgngggngntggggttttttgggcacttncgagtnatncattataaacaactgtgagttttaaaaacacagttccagtaaacgtgtagttacactgggtacagataagaaaatacaagggnagcatggtagctcntgtttgtactcccagaactntgggggggagggggaggtgaatgatatgggggcnggggnncaagngnagcgtgngcnncacagnaagactctgngtctgnnganaatanganaannaannnnggnnnggggggggggggattngtgcataancccggggngtgaggagggtggggggtggggatgggttgaacccaggaagcagtggttgcagtnagccaagatcgtgctactgcactctagcctgggtgacagagcaagcgaggctctgtctcaaaaaaaaaaaaaaaanaaagaaaggntnagaagcccacnggcngtgcnaaaccaaatgaatggaaagcgccaaaagngattttataccaagggnccatccatacaaataaacaaaatcctatcctcttctttctatattttttttcttacatttnttatacaaataanagaatgcttcattttattcacttcaataggncaaagtccttaaagaaagactgaaaagagctgataatcaaaatcccaaattttatgcttatttttgttttagtgcnataa

SEQ ID NO: 521192 - DNA, 495 bp, Homo sapiens
ccgatgaaccctcgaaagagcaaggtggtcttaggtaaatcactaccgtggtacagctgtgaggagacttcagcagccgtggatgcctcagatgggagatgggcgatgctggccagcccccgatagagtgcccatttggtgacttcacatgccgccatcagctggtactagatcaccatgtgacatggcttggtggcactcgtctctcaagtgcccgattgtgcttacaggagcaagaaccgacagaagatcacctggcacaggcgtatgcacactggggaaaacgcttaacagtgtcacctctgcccactatacctatgctgatccctctcgtctcaggtaccacatgcgtatccacaaggaggaagggatttccctgtgccctgagtgtggctactagtgccacgtgggtcaacccagctctaaataccaaatgacccagcattcaggactgaagccataccagtttccccgggtgtaaatacgtgtaccaat

SEQ ID NO: 521193 - DNA, 428 bp, Homo sapiens
aaaggtagctaaattcagctttgcctatcatgtgtctttagcttagttgtttcctgtgaactatgagctggacaccaggtgggggattactcaagcccaaattctctggtctggtataccaaagaatagttacaaactacagctggacagtagaacgtgctgggttgatcatctcagccagggcaaagaaacatattaagacgttaaacatctaccaggagtgagtcatttaaccctcgtaaggtttcatcttccttgattgcaaaatgagtttgtgtgaaagaccataaataaaaaatagaaacaacagaagtagcattagtaattcatgaaggaaggactggtatattcaacgcttagagttggaacaatgggctctccatatggaaaaaaaagtaaaagcgaatccctacttctcaccatggacc

SEQ ID NO: 521194 - DNA, 1275 bp, Homo sapiens
gtcgcagctcgcaggcgccggttagccgtcgacaccgccgcagacccgtgcgccctcgagcgcgtacccgacgggctcccatccccgtccgccggaccagggggcagcagctcgtgaccgaccccgtgacagatgctcccgcgtgacgcgcctccgcggacgagtggtcacccaatgatcgataaagaggcttgccgggcggcgtacaatcctggttgcgcgaccgtatggctcggcccgtcagtctgggtgacttttaatagtatgacggctccacccatcggtcccctggcgaacatggtaggcggagtaccaggcactttcattccagcaagtgcatcatgatgacgtccggttgttttgccttcgtgcgcttcaccaccggggatgccattgagcaagaggtccaagtttgcccatcatcacagtaggatcggtgagaacgtcggcgggctgcaagcggcgccgaaaaccgtggacggaccgagaccctggtgaaggaggtcgtacacgactttcgctaacggacgtttgtgatcagtgatcggaatggagctggacgggaacgatttcattccagagcgaggcttgaagcaacggcgtggggggaggccagattgacggaccgcgccaagacgggaaggtaagactccgcatgagctcgctgcacacaagagccccttagcgacagagatagagcttgccgggatccccggggggaagaggcacgcgccgggcctcaagctagctaaggcccaaccaagcccacccaggggaggaaaggacgacgccatgaaaagagagcggcgccagcaagcccatggagatacgacaggagcccacgcgacacatttccacagatttccccgttaagaaacccgtggctggtgtcccgtattcgtcaatggacggatcaatgtgaacaccatcgtttacctttggatgtctccttatatcagtattctcaccccaccattcattattgtctggattccataaaggcacacaacgatcacttgtggggacatggcacaaagggtcgcgggccatggtcccattacagaattccgaagagtgtcctccctgcaaagttggaaccgccattttaccatggacattttatactttaacacagcgaacacaggtcggagccatagatgtaaaatctgtggagtggaacctctaaagggtgtgcttatccagaaagacccgggcacactttttgaggcaatcttcagacattccatggcccagatgatcactggtgctacaccg

SEQ ID NO: 521195 - DNA, 837 bp, Homo sapiens
tgtgtagattctcatgatgtccttatctttgaagagaagggagagcaatcaccagaaatgcagcagagaactcttcttgctttcctcatttcccacctctgtggctctttaatggcttcttggtttgtacaaagggagagttaattactaacacctgcttctgcttctcctttcctgcatggccagctccctgactgatagccagctgctttcttgacaagagactttttccacctattccacacaatgtcagcatatgtaaagaaataaacatagttgaacactttagccataccatatggacctctgtggagaaacctgcatcttccttcttccttcataaagaatacacattctttgcaggaggtaaaatagccttagaggtgacatctgctatggtttactcttctttattagtaagaggtagtgcacaattatattttacatgggatgtgtggtttaggcatcatatgttcattttccgtatttttgatactctcggtttgtaccacctaacattttctctttttaggtcaccccaaaagttaggttgacattatttgaatttccttgaggaatataccttctgggactttctccctctgcgttatcctgtgtccgtatctaagaatgaagcattagaagacttccgtcatagccgattagagttgcataaaggcctccttgattcggtctcttgtggatcatgagtccaggctactggggcggccctgggccagacaaaaagcccctgttaggagggcctcgtttggtgcaccctttttttcactctttacattaggcgaacgactggaaaacggggctgggggggatccc

SEQ ID NO: 521196 - DNA, 808 bp, Homo sapiens
  misc_feature (346)..(346): n is a, c, g, or t
tattagctctcttaaaaatttatgggtcctgggaaaaaggaaggcaaactttgcctcccggtcaaattcccccaaaccctcattgttctcccgtgtgccattagaatgggagaggttcacggatactctcaagggagagatgcgccagagaaaagggcgctttagagctgtggcgccggggcgcatgaagcgcgcccacaacattattgctagaaagcaggggagaaccgcattccaggacaggccaaggggccttagggacacctcaagtgggactccaggcgaggaccaagtatctcaggacgaggttgtggatagtatcaaggcgaagaggagaactccgtgngactccttcccacaaaagatgtgaagagggtttctttgtgcccccttcacacgtggatctcgtggggaaaccgagccagaggggggtctcctcgagaaagagggagcgtttatcaagagagttgtctgcgcccccggtggcagacaagaggtaggtcggccggcctttttcttacacagaagagcacgagagttactttaagtgcgtgtacgttccacaaagtgacgtttcgcggcctctgctttgggttggacgaccccccccgcgcgtagcggggcacccagccttacttttactcaactataattaacagacggatcagattcagcatgggcaggggaggtctgtgtttttaacaagaaattactttggcaaagaggggggacgagaaacaacaccccggacgtataattgattagttggcgggacgacagacgatgatgagacagagtggctccctct

SEQ ID NO: 521197 - DNA, 131 bp, Homo sapiens
  misc_feature (34)..(34): n is a, c, g, or t
tcgcgggggcgaacgacccaaagagaaatcaggntgattttagctttcaacagcagtcagaaacccagcccaaattatccataagtttataaattaataaaacaatatatcataacaatcatatgaagtca

SEQ ID NO: 521198 - DNA, 407 bp, Homo sapiens
  misc_feature (113)..(113): n is a, c, g, or t
  misc_feature (407)..(407): n is a, c, g, or t
cgcacacctgtgtcacgctgtggaaggactaccttgatggcgtgggtgacaccctgtacctgtgggtgatcggcgcctacctgtgccgcgggaagcgggccgcgcgcgacggnggctctctggtggcctcctacgacgaggacagtgaggagctgtaggccatatgcaagcttggaactggcttcagtgaccaggagctggaggagcatcaccagagcctcaagggcctggtgctgtcctggccacgcccttacgtgcggatagatggcgctgtgatttccgagcactgtgtggaccccagagctgtgtgggaggtgaagtgcgctgacctctccctctctctcatctaccctgttgtgcgcggcctcggggatagtgacgggcatttccttcgcgttcctctggtn

SEQ ID NO: 521199 - DNA, 471 bp, Homo sapiens
  misc_feature (78)..(78): n is a, c, g, or t
  misc_feature (97)..(97): n is a, c, g, or t
  misc_feature (114)..(114): n is a, c, g, or t
  misc_feature (117)..(117): n is a, c, g, or t
  misc_feature (131)..(131): n is a, c, g, or t
  misc_feature (146)..(146): n is a, c, g, or t
  misc_feature (153)..(153): n is a, c, g, or t
  misc_feature (162)..(162): n is a, c, g, or t
  misc_feature (182)..(182): n is a, c, g, or t
  misc_feature (224)..(224): n is a, c, g, or t
  misc_feature (229)..(229): n is a, c, g, or t
  misc_feature (237)..(237): n is a, c, g, or t
  misc_feature (267)..(267): n is a, c, g, or t
  misc_feature (368)..(368): n is a, c, g, or t
  misc_feature (427)..(427): n is a, c, g, or t
atccagccgctggagctgcgagggaccctggacccctcccacgccgaggtttatgcagagcctgaggccagaaaaccnagggactttctgccccaanaagctgaggcacctccnacncccatctgaacaanagggggatctggaanaagccanacagcagcncatcaggacacaaaagaaanaagcagcacaaagcaattggctgacagccaattcccccttcnttcanaaggaaanaaggaagaagcaaaccccccccaaccaaanaagacacacaacaccgagcaggaagcaaagacccccccgcaccggcgagccagcaccccacagccccagaccccacggggccaccagccaggccgccagancacagtgcctaccacacaaacccagcaaccccggccgggccaaacagcctcccccaacncacccacccagaaacctacacctgccccagatgattggtcttca

SEQ ID NO: 521200 - DNA, 547 bp, Homo sapiens
accgggagacattatgagcttactgactctcaggggttgggagggttcctcaaatcatcttctaggacgccaggtatcttaagaaaactctggtatccataatcttccttgtgtaagtgacctctttacattctctaagaaagctaactatagttcttacccaaagatcccatagtcgataggtctagtatatagatatagcagacctaggacctgtttttgtcccgctgcgataagcccaacttacatttccatcacaggaggggagttcagaaaaagatctgaatcttacgactgtaacccattgttgacagagaattcattcccaagggtcaagtcgactacagggcattatcaatcgaagctgctttcagaaaaatggcgctccctaacttaaggagaatggattaatcgtaataaatcgccatgaacattaatgcttttataaactctattgaacgatcgaggtagtggctcaggttgccactccagagataaagcaactccttagtagctgagaggactgacagtgaatgcatactctaga

SEQ ID NO: 521201 - DNA, 137 bp, Homo sapiens
agagcatgtagattagctgcactggcttgagtttaatcttctgagaggctcttatcttcttgtccaattgcaatgcactatacaggtcgtgtctgggatgtccgtcgctttgcccccaaagagagatgtgtaaagat

SEQ ID NO: 521202 - DNA, 387 bp, Homo sapiens
cagaatacgcaaaatttccaatgagacaaatataagacaccaaagtcaatacgattgacagatcttccgaatgttgtatattccatgacatgacaaggtagaggtacacactcaatggaagaattaggggacagaagtaaagccttgtatatatacagtcaaagaaatcacccgtgcatagatatacatgtacatgcatcaagactgatttcacataaataaacaaaaaacaaaaaaagattaaacaaatacaatctctcacactctctctctctctctctctctctctctctctctctctctctctctctctctctctctctctctctctctctctctctctctctctctctctctctctctctctctctctctctctctctctct

SEQ ID NO: 521203 - DNA, 167 bp, Homo sapiens
gatcatcccagacatcaagaggccccaatgggttaatacttgtttctcgcagttctggaggggcagccatgaaaactccaagcgccccgttggcataagactggagatgccccagtactctccactgtccagaacactggtagagatctggactcatggtggagggg

SEQ ID NO: 521204 - DNA, 741 bp, Homo sapiens
  misc_feature (139)..(139): n is a, c, g, or t
gattgagaaatgcctgttactacaaggtctatgtgactgatgaacgagtatccaatgagcgatgctagtctgctatgtcgtagtcagatggcgcgtgctataagtatgcctcatagggctagtacatgataggggtagnctatgtgtttcgtcagtgggttagaactgagtgtgaggcgtatgatatcatagctgcctagctctaagagtactgcggcaagtactattgtcacagcgctggcggcttcgtcatgggctttagcgagtcataagtggagtccgtatagaggtatcttcactataacagctactgtgtaagctagtcatattcagatgctggctcaggagtttgatagttcctggtcagtgagagtgagtagtaggatgcttagtcagcctagggtgttgtgagtgtactgtagtgcgatgagtagaggtaggcagcctattagggtctagcatagccagtctgtgcctgcgttcaggcgttctggctggtagcctcatcgggtgatgatagccaaggtgcggataagtgtggtttccaagatgacatggcatatgattagttctgtgactgtcaatgttatacttatggagctctgtagggagtttagtatacataggtagagagctcttcgtgatagtggtccactggatcagtggcgttggcttgccatgactgtaagcggttggagtccggtagttagcatcaggagcctggatgttatagggttgaag

SEQ ID NO: 521205 - DNA, 152 bp, Homo sapiens
tacagcttggcaagatcctcaccaagacaggggagctgcccaggcagcaccacccaccctaaggagacagaggaggagctgacggagcagcaggaggacttactggggagggagccctgaccatgccccggaagcttccacagagagtaagt

SEQ ID NO: 521206 - DNA, 864 bp, Homo sapiens
ggtggctcgtgcgttggcagtatgggggttgtaatggcaccgactgtaatgactgatggggagcagcggatcccaacggcttgcgctgcctttgcgcagcagccggcgggcggcacgtcgtcggcctggctgtggtaggagagtgctgtccccagtgcatttggtgtgacgcggggcgttgcacattggcaagtttcttggtgtctttgcttgagaactgtacctagctcgtgtgcagggggcaactcggctcgcggtccctgaggccctgtctgattctaaaacatacttgagtagtaacacgttcatctgccggtgttatcctttgagtaaagaagcggggtttcgccaatgttgtccaggctggtctctagtcctgggctcaagcagtccatcctgcctcaggtctcccaaagtgctgtcacttacagggacactgaactctggaagcccagccaggactaatgcagccttcacagagattctgcactaatctgagtgaaggtctcaaggcctggaatctccgccctcatggagacgaagcttatgtatggctgtcatgcttaagacagcgattccatgccaattgaccttcaggctggagaggtggagaggccatgactagttctccttccttgcatatggaattgtgctgacacaatatcttccgcctggtgctgggcatatcctaagaacttacaatttcactgtattatcctgtgttgagcagcctgtcacctatattgggggaaacatgcctgacaatagggggcacttcaggtagatcagctctatttccgatatggtctaatatcaaggattggcaagatcaaatatccaataagcattcgacgacacaaagaa

SEQ ID NO: 521207 - DNA, 140 bp, Homo sapiens
ccagtcttcgtcccatcagcggattctatacttgacgcttgtgggtgatcaaaacagcagttctgatgggagcaagatgcgcccatcaggctggcaagaaagaattaagcggatttatacatagtaagagagggagaaga

SEQ ID NO: 521208 - DNA, 625 bp, Homo sapiens
acgagtttgtcaaaaatcatccggcccccccctgcaggtgagcccgggcaggcttttttccttttggtaaaccaacacagcatggtaagtgtgtccccgcccctcccggacatttacgagcaggagaaaaacgagggcggcttcctttatatggtttacgcctcccaggaaaccttcggctttttaaccaacagtaggggggctcggcctgggagttggggggccccggtcaggccctgcccaaaaagctcttggttccttaattaaactgcctctaccgtggtggggtgggcaggcatttgcccccctagtcaaagggcccccacccccctattttgcccctgggtggatcttgggccggtcgtgttagggttgtccctttgggtgctggctggtgggatgggggagggtggggaacagctcccagccccccttctgtgtggtttattttttttttagggccccggcccatttgcccctcccccccccgagggtttgccccccgcctgggcctgccccccccttaaaaaatggcccctggctcccccccccccggtttccccgtggtgtttggatttgtggtcattgtccctctccaaaataaaaattgttccggcctgcctta

SEQ ID NO: 521209 - DNA, 130 bp, Homo sapiens
gggacaaagattctccacttggccaaactttagccaagctcctcaaccttcttccaggcccaatctgggcacttccttgtaaaatctagttttgggcaaggaggtttattacgggtacgtttaggaagga

SEQ ID NO: 521210 - DNA, 489 bp, Homo sapiens
agcggattgacccggtgtcgccgcagaaccgaggtcgccgagtgatgatgtgtgaagtcgcccgcctgtcacctggtcacgcccgggcggttgctggcagtgggagcagcggcagcagcttcggctgctgcatttcaggctgccgctgcattaggggcttcctgaggaagcgcgggcggacgacgagaggatgaccgaactcacgtccagtcatgactagtccacaagtactgtataatcactatgagagtgctcgtatgctagcggatgtcatttgacgtcatcacgagaaaatctgtctaaaaagaacaatatccatgtgaccaaatccatttcattattggaatggcttgatggctttccgtttactctgattcataccaaagctgtccttctccaccaaagcaacgaaacggatcctgcatgagtcaatcccagaatgcaattttttacatcaccaagcaggtgacgacaaaccgtcatgaatag

SEQ ID NO: 521211 - DNA, 1042 bp, Homo sapiens
  misc_feature (977)..(977): n is a, c, g, or t
  misc_feature (1038)..(1038): n is a, c, g, or t
ctttccttcattataacgttatacaactgatgttgtgctcgagtcattgtatcttcagtaggaaccaaacaatcatgatctcatgaaaaactccccaaactgcaggcacaagtgcgcattggtgggaaaggaactgctccgagaaagaagaatgtggttcatataacacccacagcatattaccccccacccactctcctcttaaacacaattacggctcaaccaatcattttcggcctttgaaccgcgcaccatcgccgcacacctttgttctctgtccccctttctttttctctactctactccgtttccttcacatacacataccttccttctaactacccctctcccctccctctactaaacttcactccactcgcctccgcgttgacttctactcctagctattttctctctctgtctcccccctttccctcgaccctttcttctcccccttctcccccctctcactcctctcttctcttccacgccacacctgcatcacctcgataatctactcactattactcgatctcgccctgtcgctatgcgtctgtgttacatctctctatacgtcttctcgtctaactgacacacttattaatctactaactctcctcgcctctcattacttctatgtcctataatctttattttgtccctcacccttctctatctatatttgtactacgatcgatcttcgagtcgacgaggctcgtccaacgcatccgatagccaacacaacatacaccacatcgcgttcaacacgataactatttcaccaacacaacgccctgccctctcttccgtcacgtcaccctctctcgtaccctacgctctaccgatacctcccgcccccgactctctgctagtccctcgtcttctgcgcgtcgcctccctatcaccacaatctcgcgcgcgcactatcgtgaccctccttgtgtgttttcgcgctacgaccgctactatcgcgctantccgcatcgctactgtactctactccatccctcgacctgactatatcgtctacatgcttangcct

SEQ ID NO: 521212 - DNA, 1289 bp, Homo sapiens
tggttgttaaaaaccaaggcatgcttgtggataactctgtaacaaactattgggaatttgttaaagcttgcctcccgtgttcccactctctgtggaaagtataactcgtggaacatctctttagtgttttgcgtttgtgttttttccccctccttctattatattgggggggaaggtgtgtggtggggtaggatttaaagtctcttgtggttttttaaattctcattataacccagggtggtttacccctttaggggagaggagagacggattgtgattctccacattctcacattctccataaaatctggtttttaaaaacactatgtgtttccccattcgtggtggcccttatggagaaggggagttattggaaaaaggcgccttcattttaaataactaatactctccttttttgagaagagttgtgccttttttcttctctcaccccccttttaggttacaatctccaggttatttgtggtgtagaaccctccttggacactgtgggtgtggggacgccctatttttggcgcctctcctcttctttttctctaaagagcagcgcattaaatgtggtgagccctgtgtggtctttctacggggcgactttttgtgcgtgcgccatttgggcgagaatattttgggggagaaacgtaaactccctctaaactctatcttcacaacccgtgcgttcaattcggcagcgcacacgattgtgtttgggccgctctatttgaaaattgtggcgccccaacttgacgccgtcgcgttgctgtgtgcccttctcaaccgacattttttgtggtcccccttttttccacacacacaaacatccacacaaataccacagatcgaacaaacaggagggggggcgcgcccacaaaagaaatacaccccctgcgggggggggcccccacataaaaaggtacacccccagtctctttgcacaacggggggcccccaagagggcgctgctacaacaaacgcgaggacacgcgggcggtcgtaaaaacccgcctgagtcggggaaaccatgcgcacgtgggtcgcatctggaaagagcgccccacctgggtgggtgcggacacaagtcgggcgaccacccacgagaaataagccggcggaaacaacagaggcgatgtggtgacacacgcgcacttcttgcggaagtgagaataaacaagcgagccaagccagaacgacacgcgtgacggactaaggaagaagagcgcacacgaccgcggcgacgagcggagactacacaatcagaaagagagaggggagtg

SEQ ID NO: 521213 - DNA, 818 bp, Homo sapiens
  misc_feature (20)..(20): n is a, c, g, or t
  misc_feature (23)..(23): n is a, c, g, or t
  misc_feature (25)..(26): n is a, c, g, or t
  misc_feature (48)..(48): n is a, c, g, or t
ataattgctccgtttaaccnacncnntttttttttttgccaattcatnctggcagtttctatcattaatctttaaacccactgattctttccttggccatgtctgatttacttgtttgttcaatcgaggctcacctttattatcctggagctctgttagtgtagtggtgatagggaatgaagatcttcaccggaattggcctcttgatcttggactttccagcctccagaactgtaagccaaataaacatatcgcgtataaataatccaatctgtggaattctgttataacagcaaaaagtgaactgagacttttttattctttatgactctgcacaaagttcccacaacccaaaataatctttccagatgtggtctctcaacttcagagtcctcaccatatataactgattacagaatgagactttgaactttaaactttttacttcgttctgtaacgtgttcagacttgtgggcattgtgatacatgagtttgataagcaccgagttttaattggctaagggctgaagtgccctacttaaatatttgttccttcgatatggctggtgtttgtaatctgaaatttgcatattttgaatgcaatgtatttcatgtattcgttcttaaataacctctctacccgtccctctttttttatcacgcagtgtctgtagcgttcccggtaagtggtggcaattcaaaacatcataattattatcattaataatacactatttttcggtgatgcccaacatttatttatcggacgactcacaaagtttcagttgtatgaagatttatggaagttagtatattta

SEQ ID NO: 521214 - DNA, 476 bp, Homo sapiens
  misc_feature (19)..(19): n is a, c, g, or t
  misc_feature (43)..(43): n is a, c, g, or t
  misc_feature (190)..(190): n is a, c, g, or t
taatgtaatagaaaaaatncccttttccaccgtaaatccacanttataaaactgaatttccttggcctcccaaatatgaatgaataagttttttaaaaagagcaagaaagcaagtatgctcccctatatgtcatccatatacattttggaaacttccagagtcttaaaaatcattctgacccaggtgtgngtgtcacgccctgtaatccaatcacttctgaaggccaaagctggtagactgcttgagtcccaggagtttaagaccggcctggtcaacatggcaagaacccatctctacaaaaaaaatgtataaattagctgggcgtggtggcatgttatctgtagttccagctgcgtgggaggctgaggtgggaggaatacctgagcctggagaggtcgggacctcagtgagccgtgactgcaccactgcactccagcctgggtggcagagtgagaccctgtctcagaaaaaaaaa

SEQ ID NO: 521215 - DNA, 1061 bp, Homo sapiens
ttgcatatgctttggttcgtcggttactttccgccttttctgtctcgccttgttgtgtccctgtagttctgtgtgtaccttttgtatgtctctatttacttttctatttctctttttttatttttattggtttttctcttattatgtgattctcctttttgtgccatcttttggtgtttccatgtttaaaagaagtctctcagatacttctggtcttcgttacccctttcgttcttctatgtgcttgtcatccctttgtcgtttgactcctctgcctgcttcgtctggtctttgttctttctatttcgactctactttgtatctttgtccaggtttcacgttttctgttcaattgtttggcgggtctcttgctttcacgtgtcacaatgtagccggatgttacgtgcattgctctctctctttctactggctcacaggaacttagcattagctgcttaagcagatgcctgttctttgcatctcttcatatgttgagagttacactttcacgcttgtaatttgttggttaagaatacgttcgctacatgagaggagaatagttaatgttctacttgattttggttagtagtgtaatatggatacagttaaagctgtgttgttagaagtaataggtagatggtagatatccgttagattatagtcttgaggttgcatgttgatagccagtgtttgttaacttactcttgatgttccttgcttcaggttctagggccctggatacgcgctgtcgcggggtaggtgcactcaagttcaacgaatttatggtgtattgaaagtcatctgttgtcagccaagaatgagcgctcactcccgtgttatgcagaacacataagcctgtactgatgaggagggagagatagcagagaggccagcctgttcttactttgctcttctactgtgtacaagttcacttgttgtcttgaacactgtcctcaaatatcctgctttttgttttggatagtaccttgtctgtataagaagctggcctttcacatagagaggccctggagtctaaaattatgagcacaattaatttattt

SEQ ID NO: 521216 - DNA, 260 bp, Homo sapiens
gattgatggctcgtgtgtccctaaaatgtataaaaccaagctgtgcccctaccaccttgggcacaggtggtcaggactcgcctgagggttgtcacagacgtgcatccgcagccttggaaaaatttcactttcctaattacctgagacctttctctagatattcggggttcaaatagggatgaataagaggagcagagtggcacactgcagtcttggctaggaggctctggagctctctaagcgggtctgcctagctcagt

SEQ ID NO: 521217 - DNA, 704 bp, Homo sapiens
gtctctagaaggttctgcggtacccccagctctgggtacccggctctgcatcgcgtcgcatgatgggccatcgtccagtgctcgtgctcagccagaacacaaagcgtgaatccggaagaaaagttcaatctggaaacatcaatgctgacaagactattgcagatatcatccgaacatgtatgggacccaagtccatgatgaagatgctttggacccaatgggaggcatagtgatgaccaattgataggcaattgccattcttcgacgagattcaatgtccagcatccaagcggccaagatccatgatctgaaattacgccctgcgacccagagatgaagaggtaaggagatgggaccacatcaagtaataatctcttgcaggggaaatgctagtctgtagcggatgcactttcctgtagcagcaatgatgcagccaacagtggtgatcatggctataccgcacagggcgatgggatgatatgatcagcacgctaaagaaaataagtataccagtctgaaatcatgtgagagtgatatgatgcctgaacatcatcaaaatgctctattactaccaaaagccatctagacggtggataatctgtggcttgcaaagattggcgctggatgctgtccaatgatggtacaggttagaggagaatggtcggaaagagatcgtaataaacagatatggaagagtggaaaag

SEQ ID NO: 521218 - DNA, 178 bp, Homo sapiens
aaacttagaaaaaactattctaaaaatcatatggaaccaaagaacagcccaagtagccaaagcaatcctaagcaaaagaacaaagccagaggcgtcacactacccaaattcaactatactgtcaggctacaataaggaacagcatggcactcatacaaagcagacacgtgactaatgg

SEQ ID NO: 521219 - DNA, 198 bp, Homo sapiens
gtgatctagaggatccctgcgcacataaggtatgccagataaggcttgtttattttaatggctgatctatgtactcacagaggccagtatgtacagcacaaagtgggaggtattatttctatggtctcttcctaccttggatcaatgtcttgactgatctcctaccttcgttggcctgggatggcgctcattcacggg

SEQ ID NO: 521220 - DNA, 188 bp, Homo sapiens
ccctgggttcccttttctaaaaaccccccttccccccccccccgaggggaacccagggggcaaggggggcccttgggacccctacccccggggcttgggttttggcctttttttgggcccccctcccccccccaaggggccccggggatggggggggggggatggggaaataaccccttccgggccca

SEQ ID NO: 521221 - DNA, 524 bp, Homo sapiens
ctggaaccctctgggcagcctagctgaatgcaggatccccctcgccccagagaactccttttccaggagaccaaggtgggtcccagaatctgcaagttcagtaatagccccaggtgattctcatgcaggcaggtgagacctgcactttgagatccaggtgctactcgaagccctgcgggggctttgttcactgtacccaaagcatcgtgaaggttccttgaaggtacatccagggcatctgtcctggatgcccccgtgacccggcctggcactccaccttcacaggccagcacaggagccacagagctcccgggaggagaaaaaaagacctgccgctgggagaagaaaaaaaagacctttcccgggtctgcaggactcacaggtaaatccattgagagacttacccggccagccttgtacttgagaccgctgctgttctcctcctttcctgcccgcgtgacgctggaggccctgccagggggcgttccaaaacgctcagcctcccggatgcctgtggagctgaa

SEQ ID NO: 521222 - DNA, 373 bp, Homo sapiens
taggcagtttagaatatgtaaagcatttatgccactgaatgttttttagaattatagcatctttagtgaatgactgtacctacgctgagccattttatcatgctataaataccaaaaaacactagaaattaaagaacaagtttatttcatttttgtatataaattctattccttttatttttaacttggataaagagctttgtttgtttgtttcttaatcacttctcttttctttgtagtgagtaaagaggagatatcaatttgtgtgtagatattagcattcttatataacagactcagccctagacacataaaataccagcacctactagctggtgttgaaatgtgtggcaaagagaataatgattttgat

SEQ ID NO: 521223 - DNA, 408 bp, Homo sapiens
  misc_feature (21)..(21): n is a, c, g, or t
  misc_feature (27)..(27): n is a, c, g, or t
  misc_feature (110)..(110): n is a, c, g, or t
  misc_feature (137)..(137): n is a, c, g, or t
  misc_feature (385)..(385): n is a, c, g, or t
  misc_feature (392)..(394): n is a, c, g, or t
cctcctaaatatgactgtggnaaaagnaaaatgagttatatttaataacatcttttgacatctcctagtagtaacagtaggtcatccttattcataaacccaaaattttncccaaatttcagccccaggcgcagtgnctcatgccctgtaatccccagaactttgggaggccgaggcgggcggatcaccctgaggtcaggagttagagactagcctcgccaacatggcaaaatcccatctctagtaaaaatacaaaaattagccaggcgtgggggcccgtgcctgtaatcctagccacttgggaggctgagacaggagaatcgcttgaacccagcgggcagaggttgcagtgagccgagatcgcgccattgcactccagcctggntgacaannnaaagactttgtctc

SEQ ID NO: 521224 - DNA, 639 bp, Homo sapiens
  misc_feature (346)..(346): n is a, c, g, or t
  misc_feature (356)..(356): n is a, c, g, or t
  misc_feature (362)..(362): n is a, c, g, or t
  misc_feature (366)..(366): n is a, c, g, or t
  misc_feature (423)..(423): n is a, c, g, or t
gtagaccggatatgggctacttgtgactagacttttaaacttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgttgtttcttagactcatgaacactacccacacacttactgaaggcaactgacaacaatacaacttgacacacattaaagatcacgatgacgacactacggaataatacctattgccacattctgcacttactttacgacacacatacgcttattgtanatttgtaaancatttnctgnctgggcaatagtgactccgtttaataaaagcttccgtagtgcatggtatggattaantgcataaaatatcttagactcgatgctgtataaaatattatgggaaacaaaacgagaatatgttatttggcctctaaacttttatgggaagttttattgtggcaggaaaaaaaaatggaatctgtggtcaacatttaaacccaaagtaaaaggggaaaaaccaaagttatgtgttggcatgactaagccattctgttatctctgtaaatactgtga

SEQ ID NO: 521225 - DNA, 615 bp, Homo sapiens
  misc_feature (322)..(322): n is a, c, g, or t
  misc_feature (332)..(332): n is a, c, g, or t
  misc_feature (338)..(338): n is a, c, g, or t
  misc_feature (342)..(342): n is a, c, g, or t
  misc_feature (399)..(399): n is a, c, g, or t
gtagaccggatatgggctacttgtgactagacttttaaacttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgttgtttcttagactcatgaaataaaaaattatgaaggcaatgaaaaataaattggaaattaaagtccgatgggaattgggatatatatcatttggacattttgtgttttatagagacatatgtgttagttgtanatttgtaaancatttnctgnctgggcaatagtgactccgtttaataaaagcttccgtagtgcatggtatggattaantgcataaaatatcttagactcgatgctgtataaaatattatgggaaacaaaacgagaatatgttatttggcctctaaacttttatgggaagttttattgtggcaggaaaaaaaaatggaatctgtggtcaacatttaaacccaaagtaaaaggggaaaaaccaaagttatgtgttggcatgactaagccattctgttatctctgtaaatactgtga

SEQ ID NO: 521226 - DNA, 1455 bp, Homo sapiens
  misc_feature (373)..(373): n is a, c, g, or t
acggtgtggttgatattttggctctttggctcacgttctggtgccctggccgacgacttttgttgttctcgtggcgcgaacggttttttactgtgtatcagttgcgcccgggggtgttgtgattctgccggcgtcagcttgttgttttcttggggggtcttctactacaggcgggaagtgggttatttgtggtgatcgtctcacccttggtcgggggtcgctcccctctgtgtgctgcccccttctttcgtcttggttgtttcgtctccctagggggcatactgtcctctgtgtccccatgaatgtgtgtgttgtcctcctccccgaaggtggttgttcctcccctcatggcccttcgggtgggcccccgccnagtaagtgtactcgcggggggcctctttgttgtatcattttgtttggggccgctatgggagcctcccctcctgggggtttttcttctctggggagccccctttgttgtcgcgaggagctcagtgctgatattcgtttctccccggtggtcaccctccttggtggcgcacccacaggtgttttgcccccgcccccccctctgagggggcctttttcagctctccccccgcgggtggtggtgtaggcccacgccctgttgtcgccccacccccccgtgtgtcaaatgaactcgcgctctctcgtgggttctccacgaactacgacgctctcttggtgcactcacgggtgctcctctgggctcgttgtgaacgcgcgtgtctattgtcgcgccctctgagaacttcgtggtgtgacccgtgtgtagggtgtggttgtcgtcgagatatagaaaagtgggggtgttgttccctctctgggagggttccgcttgtctttatattatcccgcgcgttttcgtttacgacgcgcgcacacacttgcgcaccgctctctggtgtgtgcccccccgcagcacgcgctcttcgtgtggagaccgcctcgcctccccgacgtgggggaggggccctccctcattgtgtctctctcgctcacactcccggcccctcttgtaatattcacgaggccccacttagtcggcagctcaccccaacgggtgtcccctcgcgcgtctcgccgtcgtgtctgcccactcgagaggtgtttctcggtgtccctctgccctcttgtggtgtaacacctgcgagtgtgtggcccctcatgagttgttacaccgatccttctgtggtatagcatcttgttttatagacgccttcttttttcataatgggcgctgtgcactaagcgtgtcctcggcccgctgcacccctctcgcggggcctctttggtggggtcccccctctctgctttcttcggggtcccctgccgctttgtttttggtaaaagattttctgtggttttttttgaaaccccatctgtcctctgtagatattttttataaaaaatcccgggtgttccccatgaaaa

SEQ ID NO: 521227 - DNA, 1382 bp, Homo sapiens
ggtgcggtggctcaagcctgtaatcccagcactttgggaggccgaggcaggcagatcacgaggtcaggagatccagaccatcctggctaacacggtgaaaccccgtctctactaaaaatacaaaaaaattggtcgggcgtggtggcggacgcctgtgttcacagctactcgggaggttgaggcaggagaatggggtgaacccgggaggaggagcttgcagtgagccgaggtcgcgccactgcactccagcctgggtgacagagccagactccatctcaaagaaaaaaaaaaaatattaagaggttctgctgccagatgtgggttctgtgggtcgggtgtgggttctgtgggtcgggtgtgggttctgcagaccaggtgcggattctgtgtaggttctgcaggcccagtgtagaggctcacacctgtaatcccagtactttgagacgctgaggtgggaggatcacttgagcccaggagttcaaaaccagcctgggcaatatagtgagaccgtatcactacaaaaaagtttttttagttcaccgagcatggtggcacatgcctgtagtcccacctactcgagaagctgagatagggtcacctgagcctggtaggctgaggctgcagtgagccaagatcgcactactgcactccagcctgggtgacagagtaagaccctgtctcaacaaaaaaataacaggttctgttgctgctgagctttcgtcaggaagataagactttcccaacagtccgaagcctaggatatgagggctgaggaggactcaaaccgttgcagtcagagagacacctattttggtgaatattttttgaaatagttaagtggcctccagtacaaactcccagttcccagaaaagacttaaaactagtatctggagattccaagtcctttaaaaggattttagctgatctgcaggcatctggatgttagcctggggttttggctggattccacctcgctcagtgatgatagtctgtttccctggaacattcctgtggttttagtagtaatgagatgtgtgcaccactccagtgggaactgaagctcttagtagttacattgtaattaaaaaagaattataaaacaagaaatcagcaagcctgcttacctccagagacacaccgttccacttacagtatctagcttcctcgactcctttgttaaaatcgtggagtatgaaccgtgaccagagaagtaaatatggagccgttttattgagcagtttcctccagggatgacggctgtcagtgtgtttcctgccagttttccagtccttactctctgcccttcattctgtactcttggcagagtcagtaaccaaccactaataaaatcaaagttgtagtaaagactttataacacaaa

SEQ ID NO: 521228 - DNA, 473 bp, Homo sapiens
  misc_feature (376)..(376): n is a, c, g, or t
tgcggcccaggcccgatttcccgcttccattcgaaccgacaaacgccaactatcaaccggttttaacgttaagttggaggcaattccagcgtttttttgtcgatattgctgcaaaccaccgggctaatcatcgagcgggcgttaggttcaggtaatccagatccatttccagaatcggttgccctgcgcttacctgcgcaccctcttccaccagacgtttaaagcctttaccttccagcgctacggtgtcgatacccatatggacgacgatctccgagcctttttcggtttccaggcagaacggtattgaatacggcgatatgcagctggattgctgaaagcctatttctcttgcttaaaggtggccttaaacctnaccaacgaagaactggcgcagacctttaccgagtggaataaacggtgaaactgagcagttacctgattggacattaacaaaagatatttttaacaaa

SEQ ID NO: 521229 - DNA, 170 bp, Homo sapiens
aagagtttatacaagtagacccagctaccatgaaagtcgctgaacacatctgatgggtcagattgtgtcctgatagatcccaggtgatttacctgtgagccacggatgggtaatcagatgagctggtttcccttagcactgtgcatacacacatcctgagacagcattca

SEQ ID NO: 521230 - DNA, 523 bp, Homo sapiens
acttccttacaatgtatatgtatcagacaataacagtatgattggaagatgccagaagagcaagggctcctcagggtgttgcacagaactgtacaacgtgtcctcaccactataccccagcccttacaggataaactgaggccaagatggaggaagcaatgcctccctgaagtcttagatgtcacagaagggacaccgaggcttggggaaagcagtgtggcaggtggacgtggggctctgccagctaggaggagttctgcttgtgtggcccaacagccagcttccagtggagcaagcagagagaaaaactgtgctggtgggggctggcaccttgagaaccctgctccaagaggagccagatagcaaaggccaataccgcctgactcgcttgcggtgggaagcaagcaatcccagagccttgaaatatgcttggtgtatctgcctcaaatggggttttccttgctgggaagaggcttcagtatgaccatgctgatatgtgataaagaacaatgtgaatttcact

SEQ ID NO: 521231 - DNA, 146 bp, Homo sapiens
  misc_feature (45)..(45): n is a, c, g, or t
gatgagctattaaacgcttgaagccagctacacctcagaccgatnaacgcaaatctccttggggctgaaacccaagcatcgtagtttaaagctcctgaggtcgtccaatgtgcggcaaagtcgagaactactggcctagggatagc

SEQ ID NO: 521232 - DNA, 929 bp, Homo sapiens
ggccgcagacgcggggacgctggctcgctccctccctccctccctccgacgcgatcaaatgatgccatagggtgaaaatttcgctcacacagtttgtgtggccgtaaagaaactcctcagtggtcatgtgactccagatacttctggggctggttgattgcagctgtttaataaggtggattatgatcgcatcagggatgtagcgcccgtgagcagggtcggcatccagacgtaggtggctgcaacgtgtggggccatgagtgcagcatactccagtggtctcagggagaagcgtggcaatgcacaggtaattagctagatccagcgcgttcccagatcggatgggacccattcgtgtggagccacaattagcaatagcaactatcacgggcgaactacgagccgtcacagccgcatctcgtatggtaatcaattgatcgcacttgggactgtctcgcaatcactagtggcaatagcactgcgagagagtgagtgttggtgtggcgatctagacgctagagtgcatttgcctagggaagcatgagcggacgctagaaacacacgtattaaatactactatgggtctgcagtacggcctttgtgaaacggaaccaagctaccttgtcacttatacgtcctgggaacagcttagaagagttacctaatatgacaggtagagtgagtaacctggtggttcgtgtatttttccacgagttcatgaacagtgccattccaattagtgggagagaatctgtgttgcgagtttgccaaaaagggatttcgaccttaccattaattcattactgagatacaattccagagtaccagcttcactgaaggtcaatgccccatgatttcactggcagacccttgtttcagcacagatgcgcagcaggtgccgagttcacctcccttttgcggaacagcta

SEQ ID NO: 521233 - DNA, 322 bp, Homo sapiens
  misc_feature (215)..(215): n is a, c, g, or t
atgaatgaataaatcaccgagtaaatgaatgaatggagtggatgaatagaatggaatgagtgattggaatcatctgagtggaatgaacggaatgtaaagaatggaattgaagggactgaaatggaatggaagtgaatggaactgaatggaacggaatggaatggactggaataaacccgagtagaatgcaatggaagggaatggattcgaatgtnatggaatggcatagaatggaatcaacacgagtagaatggcatggaatggcatggattggagtggaatggaatccaccccagtgcaatgtactgtacaggactggaat

SEQ ID NO: 521234 - DNA, 676 bp, Homo sapiens
gacctttctgatggttgctatgactaggccattcctctgagtaactctcaacggccttatgtaggcccttcttttccctgaacgactggttggtacttacctctcatagcacattctgggataagatccccactgtttcccctgggaggcttcccactatgctcacaccaatcctgagaatgatggcgcctaatgatcggagcttctattgctgaccattctgtaaatgttcacttgtttacccaccgcatgcttgaaaggagctcattgaccaatgcttaccttggccccaaaggagtggtttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggaatgtggtgtggtctgaagagcaggttgggggtgtggaaattattattttgttatatattatttgtggtttattttgaatattttttttgtttatgtatatattatattgttatattatttattgatgtttatatttatatttgattaatgtattattttttt

SEQ ID NO: 521235 - DNA, 217 bp, Homo sapiens
cctggtgactgtttagctctgtttatccagtgctctgaacatatctagccaaggaactaattttcccaagggcgcaaggagccggctctttgcgtggcgcgtggtgtggctcctggcgtggctcgttgggtggctcgtcggggttagtgcagactctcctccacgtctgggctgcagcctccagtggctgcttgggcacctcctcatcctcaaagag

SEQ ID NO: 521236 - DNA, 396 bp, Homo sapiens
atgatacaattgagccggtacctgaacattcgtgtcactcatttctactctgcccgtctgtctacatctctgataacccggtttctaactctgctctaggtaactgtccctctctgaaattagacttctcaagtctctgagtgacgctcctctctctctgcctattgcatttgtctctatcagtctgtgtgtatttgtcttcaaacacctctcttggattctgcctttccgtctctcccccagttatccacctcatttttaatacatccttgctgtttacttttccttttaatatttataaacaagcagagttggttttattaaccctattttaaagacaagaaaacagaaacaggacgactggcatacaatttgagaaatcaggatgtaaatcca

SEQ ID NO: 521237 - DNA, 91 bp, Homo sapiens
gctcgtctttcctcgggggtgtgacagatctatcagtttggaggttctttcggcgcacctgcctccggcgttgcgccgggcgcgtcctccc

SEQ ID NO: 521238 - DNA, 301 bp, Homo sapiens
agacatcatcgagcagagctgtcgagcacgatgttctgtggcctgcagatgaccggcgaaggccatttctgacaacgctggtcaagctaaccaccgtcggaacggtcgtggtaagccaacaggtggccgtcggcgtacaggccctggatcaccggcgaagaaggctttgaggtcttcgagcgtcaatcgaacgtccggggcctgcttgcccagcttgccgatgggtatgcgccaggatcgaggcgcccatgcggttctggccacggcccaggtcgatcaggatcaggtgcgtccgtagcgg

SEQ ID NO: 521239 - DNA, 312 bp, Homo sapiens
tgagtcgtgatattatagtgaatgagattctctaaacaaaattgtggcacttatctttttctttcgggctgtgccctctccaaaatctcgagactcattatatggggaatccaatttccagggcatatagttattgaataacttcaataagaatctgttctccttgtaacaggacacaattgggaaacactggttctattaccaaggtttggactggaatgtcctgtttgaggatgatgcacatagaatcagctatgaccagatggctttcaggtttgattttgtggagccattgcttacaaagagctcttg

SEQ ID NO: 521240 - DNA, 100 bp, Homo sapiens
acactattatactatgccaaatggatcctgttgggaaagaataaaattagcttgagcaacctggctaagatagaggggctctgggagactttgaatgact

SEQ ID NO: 521241 - DNA, 705 bp, Homo sapiens
tggacaatctacaaacacttttataagcaaagggagtaagtgcgctggggaaaaagaggggctcctccttcccctcaagggcatcacggccccttcccagggggcaggccagcagggaacaagaggaccccggggttgcaagcaggcgggaactcagacaaaaggtgatccggggtcggggaagcatggaccggccagacatggagctcctcaatatcatccagagccgccgtggaacggggcggggtgtgaagccacgagatacacagcgcgtgctcgtgcctcagagacaccggacacttgggcccccgtgagaccagttcagggagcgggggcaaatactcacatcggggggtctcgtgagtcctagctgtctgccccttgggtctcctagaagagagtccttggacatctccatatagccggagggcttcatgtcacatcttcgtttctccaccatatccaccattctcagacgtgccagagcaggggaagggcgcaggataggccacgcgagggcccgggcagacgtatggggggcatcctaacaagcccaagactctcgcctaatctccacgtatgctgctgtgatgtagtcagccagagatctggcccaagggcgagtactcgccgaacatggctatgtaacgcctaaagagcttcatgtccagagtccaacgggaggggctgccgctcggcgggccc

SEQ ID NO: 521242 - DNA, 134 bp, Homo sapiens
ctcgatgacggtcctctctgtggccgcctctgtgctgtcccactccgtctgtcctcctctgtgcgtgtcccactcctctgtacgtgtcccagctcctctgtgcctcctctgtgctgtcccctcctctgtgctgt

SEQ ID NO: 521243 - DNA, 200 bp, Homo sapiens
tataattcgagctcttacccggtccccatcacagtttgctggtcacagcgaaaggtgtatgccctggtgggctcctgcttgatgcccaagtcaggtacttctcgcggggaagctcctgtgacccctgcagccatgctgaaccagcacgtactttgtgctgaagccgcgtgcgaggcacgtgagggtcaccagctcgttca

SEQ ID NO: 521244 - DNA, 198 bp, Homo sapiens
  misc_feature (164)..(164): n is a, c, g, or t
tcattgctcctacaacaaagccttggctgcacacgcatgtggatcagatgaatggacattttagtatttcccctgtctcttcagatttatatacatccatactgcaacatattgctgtcaaaacccgcatattccatacgggtacgacatggtgccttctttancattttcgaattgagattttgattccctgtatct

SEQ ID NO: 521245 - DNA, 428 bp, Homo sapiens
acagagcgagcacggtcgtgcaatcgtcgattcagaggcccaccaagggcacggtcattcggcggccgaccgctgttgcgtgactggctctgtccgtggcagccatggacggaacctggacatactgcaccggacctgtgcaagccatgtctgggtgccagtggttctttgactgactgactcagtgctctagctctacgagcttgacgcgaaggccatccacgcacgtaacacgtaataacgtacgctatgcgacgcgagcaccggcatgagctgttaggacgagacttactccagataggacacatgtatcgaactggcggagcatgatctggtacatgacagaatcatcaatctccagcatgatattcacagagagtgtctacacactacatctgatggtagagtcgactgatgacacgctcctg

SEQ ID NO: 521246 - DNA, 426 bp, Homo sapiens
ctggctcctggttccctcctggctcgtacatgccagcactttttagcctccgggatgaattgaatcaaatggaaacatctcagtggaagatgcataagaagctgcttccacatttttcattgttcccccttgaaattctcagagataaacaaactgtgtgcccttttccttctgtcatcagtgtagccgccacctctgtcacacctggacaaaggtagaggagcaagcagtaaggctaggaggacagcctggcatcgctcattcgccttcacattcatgagcaaagacataatgattcgcctgatatctgtagaataaggagcctgaccacagagtgcgatggtattgtgtgttggtagttcaccagcgtgtagagacagtccaccagaaactgccaccatcagaatggtaccagttaccattctg

SEQ ID NO: 521247 - DNA, 461 bp, Homo sapiens
  misc_feature (32)..(32): n is a, c, g, or t
  misc_feature (79)..(79): n is a, c, g, or t
  misc_feature (85)..(85): n is a, c, g, or t
  misc_feature (96)..(97): n is a, c, g, or t
  misc_feature (100)..(100): n is a, c, g, or t
  misc_feature (102)..(103): n is a, c, g, or t
  misc_feature (105)..(105): n is a, c, g, or t
  misc_feature (109)..(111): n is a, c, g, or t
  misc_feature (125)..(125): n is a, c, g, or t
  misc_feature (127)..(128): n is a, c, g, or t
  misc_feature (145)..(145): n is a, c, g, or t
  misc_feature (148)..(148): n is a, c, g, or t
  misc_feature (177)..(177): n is a, c, g, or t
  misc_feature (203)..(203): n is a, c, g, or t
  misc_feature (218)..(218): n is a, c, g, or t
  misc_feature (227)..(228): n is a, c, g, or t
  misc_feature (234)..(234): n is a, c, g, or t
  misc_feature (244)..(244): n is a, c, g, or t
  misc_feature (248)..(249): n is a, c, g, or t
  misc_feature (252)..(253): n is a, c, g, or t
  misc_feature (255)..(255): n is a, c, g, or t
  misc_feature (257)..(257): n is a, c, g, or t
  misc_feature (262)..(263): n is a, c, g, or t
  misc_feature (270)..(270): n is a, c, g, or t
  misc_feature (273)..(273): n is a, c, g, or t
  misc_feature (278)..(278): n is a, c, g, or t
  misc_feature (310)..(310): n is a, c, g, or t
  misc_feature (319)..(319): n is a, c, g, or t
  misc_feature (322)..(322): n is a, c, g, or t
  misc_feature (324)..(324): n is a, c, g, or t
  misc_feature (345)..(345): n is a, c, g, or t
  misc_feature (355)..(355): n is a, c, g, or t
  misc_feature (371)..(371): n is a, c, g, or t
  misc_feature (461)..(461): n is a, c, g, or t
taatctcgcctggcggagggacaccggggcgnggtgggggagatgggccttataggtggagtccgctggtgagaaatancttttncatggaaaatnnttnanncntctnnnactttaaaatatantnnagggatgactcttagtnatnattaacttggatagactaataaattaccncaatcatatttctaggggccatcacnttcttctaaataaantactttaannaaaatnatattttttnttanncanncncntttcnnaatcganganaattnaatttcttctcgtcctactctcgctcgtcttnttgtgctcnccngngtagcgggtccagaatgtgcnccggttagcngccttttgcttgtganctttttatcctggcccgaagcctgtacttgtacctttcctgagttccttcatggtagtcagcagcatctttggttcctttttatggagtn

SEQ ID NO: 521248 - DNA, 412 bp, Homo sapiens
tgcctcagacttgtctcaacatgtggaattctcagctaataaactaaacgtagtaaaatatccaagatggagtagtgagcactaacactgtgaagacaaactagaagggtaatcaccaaccactctattaaaggacagcctaaaggaagcactttgacagaaagcagacatctttgcagataagatgtaaaaaggcctgtcactcatgtctgtcttgtgtgtacgtgtgcacacataccaaacaaactatcccaaaaggtagggatgggagtggaattgaagtagggcctgcactgcttagaagctgaagctactgagtgactcagacatgtagtttctagggtaaccacttcaagacacttggggcctcatctctccgtagaaaacggccgcgaatttagtagtagtaggc

SEQ ID NO: 521249 - DNA, 158 bp, Homo sapiens
ggagagaactagtctcgagttttttttttaaattatctaatgaaatattttatttttgacccttgaataggacaaatttaaatagtaggattttaattttggtttcttttttctttcaaatttccattccttttttttttcaaatttaaaattacaca

SEQ ID NO: 521250 - DNA, 210 bp, Homo sapiens
gagaagctcctggttgtacacgtgaggcccaggtcttagaccaaggtaagcacgcaagcgccgtgaagtagcgcctccaggccaagaaggaggagatcatcaatgactttatccaaggaggaagatgaccaagaaactaaaacctcccattttgtctgtacatactggcctctgtgattacatagtagttagccattagacataaaacaa

SEQ ID NO: 521251 - DNA, 414 bp, Homo sapiens
tgtaagacatatacagttatgtgtaaagtagaaatgtcttatacggtgtagagtttgtgcaggaggaataattatctgtagtggactctacgatggcgttgtgtgttgatttagtgagtataactgatctgtggtagcacatcttccaatctagaatgtgcgactacagcacaataataaacatggggcagaatatatgtgagtgtactatttcttgctcactttcgccttcattcttataacaagtgtgtatcagatcattcagaccagagcaaattttctatctttcacagagtatttatcataggaacaaattactccctgaaaatggtggaaacttctttctccctccgaaaaataaacttgcaattaagtgttttctctctagccaatagtaaatagttcttacatagg

SEQ ID NO: 521252 - DNA, 624 bp, Homo sapiens
  misc_feature (83)..(83): n is a, c, g, or t
  misc_feature (93)..(93): n is a, c, g, or t
  misc_feature (96)..(96): n is a, c, g, or t
  misc_feature (103)..(103): n is a, c, g, or t
  misc_feature (122)..(122): n is a, c, g, or t
  misc_feature (129)..(130): n is a, c, g, or t
  misc_feature (166)..(166): n is a, c, g, or t
cgaagcttttttttttttcccgggaaacggcgccattgtttgggtcccgggaattgggccatatgggccgggctccacttttnatccaacgtncgnaataganctccttgactcgttttaanccttccnnaggttcctctggcaaaacctttctcatctgattcangctgattctcttgaagataaaattttaatgttgtaaaatgctaattaagtgtcacttaaattttgaaaagacttcaatgctttatttatacatacatctttgctattctaattattaattaagtagattaggtagtgaaagccacaaaatagtcttgggatctcataaaattagagttgaggccaagcgtggtggctcacgcctgtactcctagcactttgagaggctgaggtgggtggatcacctgaggtcaggagcttgagaccagcctggacaacatggggaaaccccgtttctactaaaaatacaaaaaaattagcctggtgtggtggtgcatgcctgtagtcccagctactagtgaggcaggagaatggcctgaacccaggaggcagaggttgcagtgagccgagatcgtgccactgcacttcagcctaggtgacagagtgagaccctgtctc

SEQ ID NO: 521253 - DNA, 1051 bp, Homo sapiens
  misc_feature (177)..(177): n is a, c, g, or t
  misc_feature (688)..(688): n is a, c, g, or t
agttgactctagggacagacgcatccttaacgacgtacaggatgcctcaccatctatgataatgttcaccaagttgatcagccatcttctacaatttgaatgtctataagatccaagtaccatacgtcacacgaaattaatcaataggtacgagtaggaccatgtactcgcgatggntatacatcccacagaacggcatgagactacttgacctggtgaattgcgataagctgatcacggtacatagagagattagatacctaaagaagaagtaataatattgttacccacacttcgaaagtgtctctgcgaaatcatgggcattatattcgctttacaggatttatagtattggcatgtgcagtagaaacctccaaagatctcggcccctgctgtgaactagggataatcggtttcatcccgtagttcgtttggtttgcgtgaagggcgaagatgaactaccatagaaaccgcaagttgtgtgcccataaaactgctgcaaaccaactatacctcaacgtgggaaacacataaatgcgtggacatcctctaccaagactcttaagtttcacgcaaccattagtctatgcacattttggtttagcaacatcgtacgcttgcgtgcaccaggaattagttgtttgactggggcttaacttaatcgacttgacatgggtgcaccctcgcntgatttggtagggctacgtctactatacttgtcgatgagactagtgtaatacaatcttgcccctcatgctcaagatcatcgcgaaacagccatggtcttgctgactcagagcatgctattgcaacactgggaaagtcataattttgatctactaacgacaaatgaaaatttgatttgggtttagactgacacaagtcgggagctacaaagacacggtaatgagcagcattcctgtggccttgtgtccctatacgggttccatgtcaagcaggagcgccagctccccattgatatcgcaatggtcaatctccgctggacaattcagattatccggccgacttggctgcccccagggtcccattc

SEQ ID NO: 521254 - DNA, 151 bp, Homo sapiens
  misc_feature (84)..(84): n is a, c, g, or t
gggggttgcagtcagccgagatcgcaccactgcacttcagccacctggggtgacagagcgagactctgtttcaaaaataaatanataaataaaatagaattctgaattttatttttaataattattttgtaaaaagaatgtcttgtttttt

SEQ ID NO: 521255 - DNA, 266 bp, Homo sapiens
cttactgcgcggcagtcctcctacctcccgagtctgcgggcgctgctgtcccagcatctgctgttcatttcgtccttggggtcccaaccagaaccccttgggacttgagtccagagacgttctccaggtaacccctcatacgaagctgtgaatcaagaggtttcgctctttaaacctgtctggtgggcccccagaatatcctcacctcagggagctcctttttttgcaaacatcctacccctcccccgagggcagacccagcgagg

SEQ ID NO: 521256 - DNA, 1240 bp, Homo sapiens
  misc_feature (1240)..(1240): n is a, c, g, or t
agcggggggtttactgcggcagaccgacagagcagccttggcgctatgttggacgccatggggcttaccccctcagcggctacttggcggcttgggtcctggcggagagccacgcagtggcttgttgagcatgcgcgtgaccctgatagagtatgagaactggattcggaagtccatcgatgcgttttcccatgagggaatactggtgataggtgtgcaagctgcttgcctgctactgttctcttgctgatgtcgtccttctctctgtctgctggcacggagagcttgttatgactcggcttcacggacagtgcggcttttaatgatgcggaacgacgggaaacaatgccttgtcatagtaagtgcgttgcttggcacgtaggttggaaggaaaaactgctcacacagctaccttgagaggaagtttagctcattggttcagaacaagcagctatcgcaaggacgtattgacacgatagctggtcgatccggttacgagggactgccacgcttctgagacacggacggcgaggcagaaggcacgacagtttggggaggcaaccgctgatgaacaaggtatgaaccaaggttccaacttgcgtgagactatgagcccttgaacacttcttctggtgctagaacaacagcagttaagaatgcaagagcacaatctagaatcatttcgacaaacaataattgaattgactggcgggatatttcaaacaaggatacaggctctagcagatgcagtcgagaagccctcaagattcgcaaagtagctgcagccacaaggatcttggccgagatttaacatgactgggaagaaggtgaagataggcaataaaaggatggcttggaatgaaattctcacttcagggaagacagaaacagatctggcagaagatgaagtatggaagaacagggatgaactaagaagagcaaataaatctgcagagccgaggacaggacagagagggccacatagggaggaaagcccaaaaagcaactgagcgtgcacaatgacagaagagaacgaaggggccgcagggccacagccgcccaggccgccgaggaacacagaaggcacgcacaccagaggagcaaggcacaagcacagaccgagcgaggcgaagcgccacaaaacagacaacgacggagacagaacggaacgcagagcgagaagagcaacacagaggaagcacgcacgcgaagaaaagccagcgacaaagaacacagagan

SEQ ID NO: 521257 - DNA, 374 bp, Homo sapiens
ggagctgtggcaggtgagactcccagtctcttgttaaacatgtttgtttgtttgagacggagcttgctttgttgcccaggctggagtgcagtggcgtgatcactgcaacctctgcctctcaggctcaagcgattcccgtgcctcagcgccccccccccggcccccgagaagctgggattacagagctgcgccactacgcctggcaaatttttgtatttctagtagagaagtggtttcaccatggtggaaggtggtctggaactcctggcctcaagtgatacgcccccatggcctcccaaagtgcctaagattacaagcattagccaccgggcccggcgttttttattaaatataagggggttaattttaaaacg

SEQ ID NO: 521258 - DNA, 131 bp, Homo sapiens
ctggagcttacatgctacctgctactctgaggaagacagatcccgcatcctcaccagggcatccttcaggcgggcattctgctcctcaagctgcttgagctgataactggatgcagcaccagcacgatcct

SEQ ID NO: 521259 - DNA, 897 bp, Homo sapiens
cgatgaaggggggtgtaatgtcaccatgataatacaagactgcagatcttgccccttcatccagtaagagaaccaagaagaaacgtgctggagttcagagacagaaaagtgatggaatatgagaataggattcgagcctactccacgccagagaaaatcttccgatataagtgcgcaccttgaaaagtcatccgagtgacgtcgctggctggaaagcagaatggtgtgttcatggaactacccagcaagacttttagtgctgagtcccaatagagcactcctataatgaagagataaaacaactcagtaaccacattgaggatcatggtatccagaatagtactagattacacaaatcggctctggaatggatacacgataaatagacccagggacaccggagacatgaacttttgcgtgatgaacggcaggtgaatattcttagcaccctctggagaagtgtgggactcagtagtacgctttatcagagcataacatttgttccgtcagcaactgtggcttgtcgcactgcactacagagtacaagtctgtggaagatgtggcacttcaacgcatgatttgagttcgtgaagtgggagtatgggaagaagatagcaatatgcgcagaggaagttatgaaccagggttcagagcactcattcaggctacccataactcaagtgttgtggcttatagcagcaccaacagaagattcgcgccatactaacgtgggtgagacaacccatcagagttctgggcttggtgttgcagtggcctcgggaaacttaatgttagggaggctggactgaagggaagaagcttgacaatcaaagaggctttctcggaattttagcgttaaactggaaggtgagggtctaaatgatttgaggggctaac

SEQ ID NO: 521260 - DNA, 177 bp, Homo sapiens
aaagacccgtacgccaacaacggtgctgtcgggcggcacaccatgtatccgggacattgctgacaggatgcagaaggagatcacggccctggacgcccagcgcacatgaagatcaagatcatcaacacccccagagacgcaagtactcggatgtgagatcggatggctccactcctg

SEQ ID NO: 521261 - DNA, 419 bp, Homo sapiens
ccacatcaattgcttcctgctccttgttgtcaccaaggtgggccacactcacctaaaaattagggcaggcagaagggggaaccactaagcatttgcattagtttccaggttcccttgtcagttttaacccctgcaatagtaatcttttggcgaaggaacacacaaccctgccattgtgggggagtaaggatcccaagggtttggggagaagtttttctgtcttatctgagaatggagtcatgttgcctttggatctcaagacctcagggagatagggagctccaagtcctgagaaggaggaatggtacctggtaccttgaatatgaggcacacactaaaaggtaagaaggagaaatagaaagaaagaatgaaagaaagaaaggaaggaaggaaagaaggaaggaagaaagaaaaaaaaa

SEQ ID NO: 521262 - DNA, 359 bp, Homo sapiens
ggcacatgttctgtgtttcagtaaagagagacctgatcacccatcaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagcagggaaagaaagaaacgagaaaaagaaaaaaagcagaagagcggggggggggggggcggggggcgagaggaggggcagcaacaagtgagagtgggaggagggacacgcggcgaagcaagactggtggggaagagagaaaggcgtggagaggggatagtaggagcaggagggaagagatggcaggggggaatagaggaagagccaggacagagagcgaaggg

SEQ ID NO: 521263 - DNA, 386 bp, Homo sapiens
agccatgccccgtccctaagtcacttggcatctaggcctcagtttcctcatctagtaaatgagagttaaataagattatctcatatatcaactaaatcccaaacaggatttttcaatatcttttgtccactgtcttcccccatcaattctttccaaaaaacatgcccttgttgagaagtttttctgtcttatctgagaatggagtcatgttgcctttggatctcaagacctcagggagatagggagctccaagtcctgagaaggaggaatggtacctggtaccttgaatatgaggcacacactaaaaggtaagaaggagaaatagaaagaaagaatgaaagaaagaaaggaaggaaggaaagaaggaaggaagaaagaaaaaaaaa

SEQ ID NO: 521264 - DNA, 244 bp, Homo sapiens
gtccactgaattctcagtgaggtgggcaccatctaaggaagagatgaggtcacaacagaaacacacttgcctgccgggttcaatggaaactcttgctaactctgtgtgtatcccatgacattcattcgccctctcttccttcggaaacagaatagcctcattccaacacagcagcccgggtctaagcccattccctgggctccctcacagctgcgctcactgagaatcagtggactagtatata

SEQ ID NO: 521265 - DNA, 1344 bp, Homo sapiens
  misc_feature (1324)..(1324): n is a, c, g, or t
  misc_feature (1341)..(1341): n is a, c, g, or t
  misc_feature (1344)..(1344): n is a, c, g, or t
ggcctattaccaacgtactagcaagaaatcggcagcgatagagcgataggcaagaagcagctggagaaggacttcagcagcatgaagaagtactgccaagtcatccgtgtacattgcccacacccagatgcgcctgctatcctctgcgccagcaagaaggcccacctagatggagcatccagcgctgacacggcaggcacatgtgcgccgagcacagctgccactggcgccctgcgcaccagcgcctatgacgcacgccacgcgctaccatgctgacacccacaagctgctccagcggcccgcgactgcagactgcactcgcacccctcacatccccggctgcaacccacacgcgcaccaaccggccctacccaaacgcgcgcgcctccaccccaccctcgcctccgcgcccacccactccacaccacaccctctagcctccgcccccaccaccctccacccgccaccccccctgcccccccccccgcctgccccccctgccacactatcgcccgccccaccagcgaccactcctcctgccctcccactccctcaccactccctctccactcctagcctgaccccacacgctcgccaatcccccccacccaacacacgcgccctcaccccaccttcccacaccgcccacccctgcccccacctacacccccacacaccaccacccaccttcaccactacaccccacactcatcgccccccaccccaccccctacccccatcctcatccccaccgccaccccgccacacaactccacctcacccccactacacccccgcctcctcctacccaccaccctcctcacccccccctcctcccctccaccaccccaccccccctccccctcctacacaccccctcccccctcccccccacctcctcccctcccccccccccctcatccctccccccctgcccacacaccccaccactcacgcacactccccccccccccccacccctacccctacccccactccatcccgcacgcccaccacccccacccacccccgccaccaaccctcaacctctcccccctcccccaccccacacccacctcaccacacgtccgcatccccacactccgcgctctcacacgccccgccacccctcacgcagctcgactcgccaccaccacccctccccacccctcactcccacacagctcctcccactcacacacgcgacacacacactcactcgcacaaccactcaccgcacacacgcacgcaccgaccaaccccgcaagacaccctctctcctcacacgactcccaccctcaccctcaccctcacatcccgctcncactaccacacctgcanatn

SEQ ID NO: 521266 - DNA, 2265 bp, Homo sapiens
gcattctgttcgcctgtgtctctcgtggtggtgcgcgcctgtgcggtcgtggccttccctgtcggttgcttgggcgcttctctatgctacttcttgttcgctggtcttctctgctccctctctcttcctctctcctttatttctgtcttcttctccctgcgtgttcttcgtcttgctgctctctgtcgtcttggttgtgttatttctttgttttcttctctctctccttcctcagtgttttctgatctctactctcttctctactgcgtatgttgggtatgtgttctatccctcaatctcttcgttgttactgtttctgttgttcttagtgtagttgtgggggctttcgtctatctctccgtcgcgagcgggtgggtaggtggtcgctcacttcgcttacatgatcgtacttacgctgactttgtaggcttattgctcgacccaagatgtatgtttgtcagggtctgtgatctctatacccgtctctaactatcatatctctgccttcctggtgtgttagggatgagttgtgaagtggtgagattcgcattcgcttgtcggttagttgttgtgttgttgtcctcgtgttgtgttttgtgggtgttttgtggttgtgggatagtttgctgggttgtgttttttgcttgtttctgttgtttgttgtgatattgttgtttcacctaccccttgcttatttcgttgtctcatacttgcttctggtgtgtggtgggtggtgggctgtgtttgtggggggtgggggtttagtactctcctcgactactctgtttttttgcctgctgttcttaactcgtcccgctactggcgggctgctgccttgctcttctcgtcttttggtgttgtggttgtgtgtgttgttctgggcggcgcgccgcaacatcacttcgcttctgcgtcctgtagctgtgccgtttgttggagtgtagggtgtttttttcttgtgtcgtctcttcccgtctgtgtttgttcttgttcctcctttcttgcgtcgtttgtttgtgtgtggtcagattgttgttgtggtgtctcttcctctgtcgtctctgtgtcgtttcgtcctcacaacaccccgccttctccctcctccaccacacccactgctctcccttcctctcttcctctctccactctggcgttctccgcgtcgttttcttgttcttcttcttcttctgtgtgaggtgactctcccatcttcgtttgtgcatttactctaccactatcctcctcccttctacgtcttctggcccttccgtcacgtcgtggtggtggtctcgtgttgctgtggcggcgctgtccctacccccccacgccgtgtgttgcgtcttcttgtcgtgtccgtcggtgtgtgcgtcccacaccacccgtcgtcgtcgtccttgttgtagtgccacgcgcggtgttgagtggatgtcatcatattatgtcgccgtccctctcctcttcgtcgtgtgtgtggtggtgtggtgtcgcgtccccacccctctcaccacccacactccacacaacaaagtagttagtgtccgtcgccacgtcgcggtagagggagaagaccatagtgtgtcacgataagtatgatagtagtgtaggtggggagaagaagaagagagcggcgctaatccacgcctctgtagtgcgaagattatataatataataaaagtagtagtagagatagaagaatattatattctacaccaccacgtcgtcttcgtcgtgtttctattttgtagtgtttgtgagtagaactaaactcctcgctctgtgtgtgtggcgtggcgcccacgcaccttgctgcgctgtctctgtgtgtcctctctcttctcctctgctctgctgttgtgaggagagagagtctcctttgttgtgagagagagagagtagagagaagaaatagtatattgtgtgttaagttacatcacacgcactcatctcacctctcagcgatattgagaaacaaaaccagaaagatgaaatatagtttgtgtgtgttctcatgtgtgtttgatgatatatcaaaaaaatatatagtgtttgtgtgtggtgagagcaagcacaaagagagagaggaatgtatagtgattgagtgtgatatatatatatataatatatatatatatataataatatataataaaaatatatatatatatatatatatattatataataaataatagaatatatatatttaccattcgtaggcaatttgtaaatcgtcagggggggccgggtagaatgagggttattag

SEQ ID NO: 521267 - DNA, 779 bp, Homo sapiens
atctagttgcaatcatatgcaggagtgctctactagatgctcggggcacaggctcttgtgctctatctctgtatgatagcagacttcgagagttatcactctgactcgcggtagcagttttaccgctgcctttggctatggaacgccctccaattgtgggggacaacttacgaagggcaagcttgcttgccaagtggtctacttgttcgacggagaacctcgcttgttggcgaaggttacacgcgtcttggacattgcggttggagtctacctttccataaccgagggccctcccaacggggttgccacctaatgcgggggtccgtgtgtacaatacagagccttagtaccgtaactggtgtgtgactcgcctggacgcagaggacatggccgttaaggagactcaatttagtaaatacggaggactcactccaagatgaacggcacagaggtgtgtttgcgcacgtagaagagttccacccaagtttgtcaaaaacgagtttggagaccaaaaccgggaggcgacatgggctacccagacacgaagggggagggattaatgcggcccgtatttcgacacgtaacccgagcacgacaaggcaccccaccaaagaacgcggaactgtttggacagtgcaggccagaacctggaagaggtacaacgccacatttgattgtggcccacgcctgggaagcccgggagaactctaaggggggccgtatgggaaagaacaattcgggactacaagcaaatgacgccctggcatgacgtcatacaa

SEQ ID NO: 521268 - DNA, 1014 bp, Homo sapiens
agcggggggggggcagggggtaccatgagcggcggaaacgcaggttcaccgttcgggggctacgggggggtgggacgacgtccttcacttctcggccggaggtgtgtggcacggagcgcagtgggccagaaccaggcatcttgagctctgaggcactgagcagcctgtcgacgagtgaacatttagctctcccgtccctagtactcccttctcctctagccgcgtagaggaaaccccaggactctatgtgagagtgagtggaggaagtatgctcgggaaaggcatggactgagtagttgagagcagaacggcatggctccatgtagccgacgcagacgcgctctacacataccaacgcagtgaagggatcataacaacttccgaatgacaccggagatggtgtcacgcaaggtcgtttgaggggacgatgagaggaacacactttgccccactcaatcctgtctgcccacagattctggggggctatggctcgcgctaagagagggcgcccccaaagctcgacggaatagatcaccgcaggcactcccccctgaagaacacaagaagcgggacatgccaagatcggcgcacaaaaataggacgaacaggaaagaaagcgtccagagagtagcaatgtccacaacaagcaccagcactctgaaaacggggaaaggccactttctacggtgcgggcagcacgtggatggccactttgttcaacagttaatcttagaggtccaagctgggcaaccgtcgttggcacttcttcgggactcgagaccttcggctgccgtttgcaatctaggtgcatcaagttaccaagaatggttgtatgttccggcgagggcaatcaccagaaggaagggcgatacttggcacgcggtcctggccctgacattgcacgtgtaaccctataattggtgtccctggaaccaatgtgcgcagttggactgggtgaaattcctcgggacaagttggttcctatgccccttacatgcgcgaagattttccaca

SEQ ID NO: 521269 - DNA, 250 bp, Homo sapiens
  misc_feature (180)..(180): n is a, c, g, or t
tcccagaggcacaggttaggtgaggagaagggaggaaggaaaacggaaggaatgagggctcatcagaaccccttcctagagatgagccgaagtcccttgactgggcctcccctgcctgtgggtggcagccccctgtgcctgtgctcccggccgcctgggtgtgttgtgggctcacagcgnctggtccccagtctttgggttgtgctgctagttttcctaccttgtgtgcctcttggggggtaccgaagct

SEQ ID NO: 521270 - DNA, 211 bp, Homo sapiens
gtggagccgtaggtggcaattcagcgaattcgaatcaccctaacaagccgcatcgtaaaatctttggaaaaggtggtgttcctgactttagtaagaggcggcaagatggaaagaatttcaaagttagagtaccagttcgaatgcctaccaaggcttttgagaatcactacaaggataactccttgtggtgaaggttctaagacgttgggat

SEQ ID NO: 521271 - DNA, 149 bp, Homo sapiens
cttgactcttgaggatcccccttgctgtctcatagattatggtgagaccccagaagcagctgctctccgtggagcttgaatgaagaaactggctatcaatggggacattgccgcaatgttctccagcggctctgtattagacccgcaag

SEQ ID NO: 521272 - DNA, 942 bp, Homo sapiens
tgagaatgacaagaacttataaaaagaagcaaagattatgaacaagcccagcttaaatttatttatatcttacgaaaacatttctactcatcacaacacatcatcattcattcaacatagtgcaccatcaacatcatcattcattcaacagtgtgcaccatcagctcattccagtgctttgcacacagtcagttccccatggcaaaccaatcattcaagcatttccccatatgaggctgggtgtggtagctcatgcccgcaatcccagcacttagggaggctgagacaggaggatcacttgagcctgggagtttgaggctgcagtgatctagtgatggcactggtgcactctaacctaagtgacagagcaagagcctgtcttaaaaaaaaaaaaaaggccaggcgcaggggataatgccggtaatacccagcaattagggaggccgaggtgggtggatccagaaggtcaggagatcgaaaccaaacgggccaccatggtgaaacccaatactcatactaaaactcacacaaaaataagcaggaagaagagagagagcatgccagaagaccacagctacacggacagagcagaggcaagggagaatcaattagaaaccaggggagagcgaaggtcgcagacagccgagacagaaccagactacatcacagcctgcatgacagagggagaatccatacaacacaacacacaaaaacacgaaaaaacaaaaaaaacaaaaaaaacaaaacaaaaaaaaaaaaaaagaaaaacacaacaaaaagagggcacaaacaaaaaaccacgaagaaaacaaacaaaagaaagaaaaaaaagagcaacaagaaaacaacaaaaagcaaaacaaaaaggagcaaaaagcagataagaaaaagaagagacagaaaaccaaaaaacacaaaaagaaagaaaaaaagggaagaagg

SEQ ID NO: 521273 - DNA, 164 bp, Homo sapiens
ggtgactcttcatttgatatggtgatatctttaggtgctttgtgcctgcacaatttcaagacagccttcagtctagaatatattcaaggactgcatgtcatcaagcacctgaacaggttcacgttcgttgcttcaaagtagtcatcagcaataacatggcatgg

SEQ ID NO: 521274 - DNA, 232 bp, Homo sapiens
agtggggggcggctgctctcagccttcacccgtggactgctgctatccgggctatgggatgtctcaacagagacctgtgttcccccttccctggttttcgaggaggtggggtgaccaacctgtctctggtccccggcacggcagcaaaatcctggctaccactccttcagctgtcttacgagctctggcgcaggcccagatgtgtcacttgtgtagaaagtgcgcctgggtg

SEQ ID NO: 521275 - DNA, 115 bp, Homo sapiens
ggatacctacggaattagcgactgctgtcgttagggatgggggtgacatactcaatccgcccgatcttcatacccgagcgatcaagggctctgaggggcgactgggccccaggtc

SEQ ID NO: 521276 - DNA, 330 bp, Homo sapiens
ccgcgtcgacatacagtggggttggttaacagttgctcaatgtctgctttgcgtgtatcctgtagggagcagttaagaggtgttctggagcattactaaataaagatggacaagtacttggtggtatcagttcctattgtaaggcctgagaaataattaattgcactcaagtgattattttcctgagaacaaataaaattcttttctgtgaagctatgagaattctcttggagaagctggcagcctgcgccttggacaggtacactctttgctggataaggaactggctggagagtcaggcccagagggtggtggtgaatgggtcgacgc

SEQ ID NO: 521277 - DNA, 130 bp, Homo sapiens
agatttccctaagaagcatagtcatcgatggagttacgctcaatgacaaagccatttaggcgcagaggaacatgcgagacggaagagctctatgggggcacatttcagctttacaagtcagcagatcgcc

SEQ ID NO: 521278 - DNA, 516 bp, Homo sapiens
  misc_feature (487)..(488): n is a, c, g, or t
  misc_feature (490)..(490): n is a, c, g, or t
  misc_feature (493)..(493): n is a, c, g, or t
  misc_feature (497)..(497): n is a, c, g, or t
  misc_feature (499)..(499): n is a, c, g, or t
cacacgccgatgggcaactccaaataaaagtaataaacccattcgcctcactcacattaaccacactgactattctaaccatcccaattataatatccaactcaaacatctaccaaactaacctttaccctaactacgtaaaaaccaccgtatcctacgccttcactctcagcctagtccccttactaatatttatacacacaggccaagaaataatcatttcaaactgacattgaataaccctacagaccgtagaactctctcttagctttaaaatagactatttctcagtaatattcattcccgtagcactattcgtcacatgatcaattatagaattctccatatgatacatacactcagaccccttcatcaaccgattctttaaatacctactactattcttaatcactataataatcctcgtaaccgccaacaacctcttccaactatttatcggatgagaaggcgtaggaatcatatcatnnanccntcgncntgaagggtaccgagctc

SEQ ID NO: 521279 - DNA, 892 bp, Homo sapiens
ctgtaaatattcgcgcaaaaccctggtgaaatattttgagaccagaaacaagtggggcaagtcaccacccccccgagaggtttctcccgcctttacgccaaacccctgtttttatacaccgacccccatgcaagtctcgtcatgataccccaacgcagaggtgctctacaccgcacaactgtcagaaaacaaacgcgctctcccacaaaattcttacgtccgaccccctccttggacacacattaagtggtgtggccccctcccgagtagtattcgcattttcctgctcagaaacagcgcagtattacgtggtaacgctctcccaccaaaagtctctcataattatgccacacgcctccccgccacaaattcaccacacatgatcaggcactatcgccaccttgaaaattttttcttgattttttatttgtgttgggtcatttagcatacaaaaacacttgtggcccgcccctcataaatttttgtcacacaccaccactagtatcgcccgctctccactactgtaacacccactgaacaacaagaagtgcttcattttgccaatatgcgctctctcgacccacttctcttaaaccctttgccgcccccttattagtttttatgcaagtaaaccactaccaccttttcggtccacgcgcaccacgacccccacccacatttcttctagacaatcacaccctcggctatataactcccccacgacacaagaaagggaacccaaaatgagatcttgttgtactacaactcagaatatttgattccacaagggctcccacttgagatagatacatacattagcccttgataactacccacgcactttgttaatattatcgaggacaccacccaatcaaaaacagacccacataac

SEQ ID NO: 521280 - DNA, 279 bp, Homo sapiens
agaacgcgtacagctttggctacctccgggaggagcccctgtataaatcctatgacattatcagccactgcgcagcccaaggcgtaccacataaaccccagcagcttatacctgttctgccgaaacgctgctggttccctctccctcttctataacaacggaacccgtccatgtggctgccacgaaataagtgctacaggccccacctgtgaacccttcgggggccagtggccctgccatgcccatgtcattggccgggactggtcccgctgggccacc

SEQ ID NO: 521281 - DNA, 1019 bp, Homo sapiens
  misc_feature (79)..(79): n is a, c, g, or t
ggcgtggagtgggctgctgatgctggtgcttggcctgagtgatgtgaggctgtgctgtgctgtgtgatgcttgcctccntgtccgtgctgtgtgcctgtggcctgtgtgcctgatgcccctggtgctgcttgctgtgctgactgctctgtagatccttgccatcctggccatgtgcctgtgctgcactgtgttgcccactgatgtgatgtgcattgcttgatgcacccatgtgtccatgtagttcccctcttctgcatgtgactgtgtgaaccttgtgtgatgccactgccactctgcattgctgtgtgtgcacttgttgtgagatgttgtgtgcctgtgtgcccctgtgatgccctgatgcctggtgtgattgtgctctgcccctgaccgccatgagcccatgccatgcctctgtgcctgtcctgcacctttcccagcacatccttgccctggggacgtgttcgacgaagcttggtgctgttggaacatagagtacctctcaggttcgtcgaccggagtctgatcccggacagcggacctcccagggttggccgcagaataggtcggcaagtcgcatctggacccaatgaccccttaacagcttccaatggttgcacctagacagccaccattaagctggttgggcacttgggcgcctggggaccaccttgggaaagggacaccaccctaacatgtgtgcgcatatcataaaccatagaaaaccccgttgacaaggaggattagcaacaaacaacaccattgcaaaaagtggacacgaaaatgagctacataacattaaacagactcacaatagtggtccacccaatgagggaaaaaggttggaagacacccactgaacaattagccggaaatcacatagagtaccaagagagacagtagaaaacccctagaatcatatggagcatggaacaatggacacaccctgcctgagaactcacataggacttagaatctgaagactggcgaaggaaaaaattgcacgcaagaaacattgaag

SEQ ID NO: 521282 - DNA, 104 bp, Homo sapiens
acatcatccgagtcccctctacagtgttcattgtgatcgttgcatccccctggtttggaaataaaatataaactgcccggcaagagataaaattgtatttttta

SEQ ID NO: 521283 - DNA, 107 bp, Homo sapiens
gggagaatgaagagccatattaacccaaatgatatctaaatttagatatctattttccctgctacataaaaactctgggtaataactagagacaaggtagagccgag

SEQ ID NO: 521284 - DNA, 155 bp, Homo sapiens
  misc_feature (80)..(80): n is a, c, g, or t
cgctgttactgcactgtagatcgctcgcgtgcggtaaggcgactcgggtaacgtggttcggccgaccacctacccactgnaactgctgccatcatggctgtgtcccactattttctttttttttttttttttttttaaggtgagcgaccaaaagg

SEQ ID NO: 521285 - DNA, 166 bp, Homo sapiens
gctcggtaccattggtcgagagaaattaggctacccgtccgcagtaactgatattctatttccccctcttttgatccccacctccaaatatctcatcatgcaaccgactaatcagccactccaatcaagtgtctatactctaaactaacctctaaaatcaaatgat

SEQ ID NO: 521286 - DNA, 109 bp, Homo sapiens
gggccgagttaagttacatgctttctgccataaccctgacactatggggggtgggaaaccaaacataacaaggtattttcactgaattgataagacagaggtgggagtt

SEQ ID NO: 521287 - DNA, 163 bp, Homo sapiens
tgtcttcactgggatagtcatgaattcccagttccggtgtactgcgattcagccagaacttggacttacaaaacaaagacactttgggaggccggggcgggcggatcacgaggtccggagatcgagaccatcccggctaaaacggcgaaaccccgtttctact

SEQ ID NO: 521288 - DNA, 147 bp, Homo sapiens
agagatctctatacacactccacaagaataggtaatacatcaatggcagttatagagcattctgaataaactgatcaaaaaacgaagaaagatgagcgcgtgcggggctgcgcttggttcacgcccgcctccggacagggtggtatc

SEQ ID NO: 521289 - DNA, 929 bp, Homo sapiens
tgtaacttagtactccggaaaaaaagaatccattaggatagcataggtatggtctgcgctatgatcatcaatgggcatatcctagggttgtgtcgtgtgagcagcacacatagtagttcatcagctaagggaatagacagtagtacagcacgaggcatagttaccaccctcacgtgacctataatcatcgtctagtccccaccggcgatcaaccgatacttctatgcgtgacatcgccacactccacggagagcaatagtgaaatgagtcatgctgcggtgttctgagacctaggattcatcgtttcttgttcaccgtagtgttggcctgacatggattgtattagcaaactcatcactagacatcgtaatagacggaccatcgcttcgtacggtgtgtcagctcaggttcgcacttagtgtccttaatcaattaaggaccgcatgtagtttggccattcatataagggcaggcggttcgatttcagcattgactttctctcccccttattttcgtcatggtcgtagcgtccctaggactcacagatgcggtaggcggccgaatagatcccagtcttcgactattcaatagtgcactcggtgcggtaatagtctacagcgttttcatctcctcaccaaaccacgtattgctcgtgagctgagtccgggaatgccacttcgaggattagatcgggagctaacgcccgaattgcataacagccagcagtgaaggacaatccgtcaatcaatcttgttagtgcctccactgtcgagtttccctctagaccaggcaaggtagctattgaaaataaatttctgcgaaaggattgttgggggaagggctccagacgtccagaaagacggagacacaggttctacaatagtaggaagaaaccctcacataaagctgggagcgaccatatttgatcc

SEQ ID NO: 521290 - DNA, 204 bp, Homo sapiens
  misc_feature (35)..(35): n is a, c, g, or t
  misc_feature (39)..(40): n is a, c, g, or t
  misc_feature (42)..(42): n is a, c, g, or t
  misc_feature (60)..(60): n is a, c, g, or t
  misc_feature (103)..(103): n is a, c, g, or t
gcagagccactgtgagaggcggtgggagccaacancctnncnccgaagggggcagtactnctcggcacatcccagcatcaggtcagatcactgaattaaaaantgtgaattagttcatatccaccttttggggaagcaggtcaaaccaccacccaaccaaggtgtgtgacttctccatatcccactgcagtttccattttttaa

SEQ ID NO: 521291 - DNA, 177 bp, Homo sapiens
gggggggggtggcgagggggggccgggggggggccggacctagtgaaccaggatgcggctgtatcagtgaccccagcgaaggccaaacggagcagaagaccaccggctgagacctgcggaaatggggtgacctccagaattgtgagaattaataaatcattattgttttaagctacc

SEQ ID NO: 521292 - DNA, 688 bp, Homo sapiens
taccgtaatgctttgtgcctttgggcacggccttccttcttaacctaacatgcaccttgctcccaaatggtgcttggagggggaagagatcccaggaggtgcagtggagggggcaagctttgctccttacagattactgctatgctcaccaagacccctgacccgatcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggcctgcatctttccactatgcccctgtgtacatttccccagtgggacattgaccttgtcgcacacacgcctcatgtgtacaatgtgtgccagagcagacaatggcctacaaagccagagatcgacagaccaagcaggtaagttggaacttatcttgtaccctatggagatggtttccctacacagggcctgctatatgcagaatgaacgccatattagagggtgacaggcagaaatacccaatgtactgtctcttgagtacaaacgtgggtctttccatctatcacctgcatcatcttgcttccattcttacagttctactactccctacttgtcagtgtagacacaggtcaccatttatgctggttgaatg

SEQ ID NO: 521293 - DNA, 116 bp, Homo sapiens
tattaacagatagggagcagagtgcttaggacttcaggaacttaactattctggaataaggaatgaatcaactgaccttgggccagcaggttttaactaacttgttacttgccttt

SEQ ID NO: 521294 - DNA, 185 bp, Homo sapiens
gcggggtcggaggggtggttcgagtgaggggcgaaggccgcgccgccttagtgacacagggagcggctgtatcagtgaccccagcgaaggccaaacggagcagaagaccaccggctgagacctgcggaaatggggtgacctccagaattgtgagaattaataaatcattattgttttaagctacc

SEQ ID NO: 521295 - DNA, 120 bp, Homo sapiens
  misc_feature (47)..(47): n is a, c, g, or t
  misc_feature (59)..(59): n is a, c, g, or t
gggcacgtattttctcctatttcccctgacctacacaaataagcttncctctcactctntcttaaatattatacaatagcccttttagtttacattatctcagtcagtcctctacaacag

SEQ ID NO: 521296 - DNA, 372 bp, Homo sapiens
gatagatcgagctcggtaccgaatccggcaggacaacacaagtatatttcattgtgtctttgatttcatgttatatgttggctgctgtgtgttatttattggtagtgaaagtgagagggaactttgtggccttttttcctttttctgtaggccgccttaagctttctaaatttggaacatctaagcaagctgaagggaaaagggggtttcgcaaaatcactcgggggaagggaaaggttgctttgttaatcatgccctatggtgggtgattaactgcttgtacaattacgtttcacttttaattaattgtgcttaaggctttaattaaatttgggggttcccttcttagagcagctcgtactgacgaaggtg

SEQ ID NO: 521297 - DNA, 180 bp, Homo sapiens
tgaatctatttttttctttaggattgtatttccggttatttttaggcgtcacccagagcggctgtatcagtgaccccagcgaaggccaaacggagcagaagaccaccggctgagacctgcggaaatggggtgacctccagaattgtgagaattaataaatcattattgttttaagctacc

SEQ ID NO: 521298 - DNA, 178 bp, Homo sapiens
  misc_feature (35)..(35): n is a, c, g, or t
caagtggagtggccgggcgagatgtggggaggganaccgccttagtgacacaggagcggctgtatcagtgaccccagcgaaggccaaacggagcagaagaccaccggctgagacctgcggaaatggggtgacctccagaattgtgagaattaataaatcattattgttttaagctacc

SEQ ID NO: 521299 - DNA, 376 bp, Homo sapiens
  misc_feature (5)..(5): n is a, c, g, or t
gactntgaggatcccctcccaacaagagacaaaggtaggaggaagacaagaaaggaagatacaaaaggagcaggaagatacttacttagggacagattagcatcatacatactaagagtggggggtgagggggaagaacaagatgagagagcatttcgatagcatttacccacacagcccctggtgatcatttggatttggaatcaaaaacaaaacacaggcatgagaatttattaaagaaggttttaaacaagggcaacaggtgtgtggtggacttggtttatttgcccaagtgtctaagaggagaaaattaaacttggggttttttagggcaccagaatattgggagcaccaccccatcttgtttgggaagctt

SEQ ID NO: 521300 - DNA, 563 bp, Homo sapiens
  misc_feature (456)..(456): n is a, c, g, or t
  misc_feature (539)..(539): n is a, c, g, or t
cacagattgaaatgaatacatggctgactcgtgtgtacactagtcagataatgcacttttacaaatattttcttatcagtacatttttgaaacaatagtatatacctccattggtccttaagtaatcactaggttattggctaaaagtcttgtactagagagcctgctgctacatttgaggtactgtcacctaaggaacgtgtttctaagtaatatttttctggaataaacaaaattatcaagcacaaggacggtaagacctcacatctttacaaaagtacgtaaatcgagccaacaatcttgaacgaatctgcatctcagtctaacgcaaatatattctttcacgaaagataactaggaaatatggtaaacaattgtgtttgcatgtgttcttaatagtatattatatattcttgttttgttatctctctactaatcacacaaacaaaaacaatnggttttattctctgtgttattctttttgtctactcaacacagtgtatttatatatgtggctatatagtctcattcatgtgccnaataaaatataaatatgtgaaata

SEQ ID NO: 521301 - DNA, 162 bp, Homo sapiens
cctcattgagtttaaacatacacactacacttgtattctacattgcttcctgcactcacatgttctctcctggtatacctatccacggggagcactcagtgggactatcagtgctttggggttagcatgattacaggaatttacccagggaccttggaaagg

SEQ ID NO: 521302 - DNA, 238 bp, Homo sapiens
tgtgacgagacgacctcatgcctgccagtaaatgaagccggccacacccgacaccagccctgctgcttcctaacttattgcctgggcagtgcccaccatgcaccccttatgttcgccgtctggcgaagccctatagccttgcttgtagagacttccggtcacccttggtaagagtatatttattgtgatggctaagatactgctgatgctgaaataaactagggttttggcctgcctt

SEQ ID NO: 521303 - DNA, 139 bp, Homo sapiens
tgccggagaggatcccgacatgatccagaactccgctcggttgggcttcccaaggatcccaccaactcattctaatcagtgatcacggaggaaatggcatggtattcctattcactatttcaaagatccggcggtctca

SEQ ID NO: 521304 - DNA, 391 bp, Homo sapiens
aaggcctgaaggaggaattcttagggattcaggttaaggaagagtctgaggaaaaggaggaccagggggttgaatttaagaggcaaaaggaggggctacggccctaattggatgagaaacgccttgaccatttccttagtaaaggggaaggacggttgccttccagagcacttaagggagcatggatgatatattttaccggggattaactgttgaccaatgggggatttaaccatgtgtccatggggcccagaaggctggccagcaaagttgccaccgggggttcctaaggttataactacctgcgaccaactgtgagtgttaggtccagggtattggtggattaattaaatctttcaccatacctgattcccggacactggttcccgag

SEQ ID NO: 521305 - DNA, 165 bp, Homo sapiens
aattgcctcaacaccatgcctcctttaccccagactgccagcctacgcgctcttggccagctttctgcgcaagcggtacggaactcattactgtcctacagcaataaagatgagcaatcgcaacaaaggtacgcgagaatgacgccgtttggacctcaataccgg

SEQ ID NO: 521306 - DNA, 162 bp, Homo sapiens
caggtggagcgtataaacatatgaatgagcttacatgaactaatacattatgagccaaactatatcagatgacctaatacagaaaagaagaagaatgagggatactccacatgctgccaaaggataccatacttgacagagctcctatacagataacataaa

SEQ ID NO: 521307 - DNA, 293 bp, Homo sapiens
tctagaggatccctataggcgctaggtagttgcacttgcgtcttgtgcagtcgtgggtcccatccgtgcagtggttacggggcttgcaacacctgatgggtacaccatgctgctgttacacagagctttcgagaatcctcagatatcatggaaacaagaatccagatccctgtcatctctgagtagacagaggctccatttggcagagtgtgggttacctctgtccctccccattctccctgcggctataagcaaacttggctttatgttcatttttcttgaattggctcaga

SEQ ID NO: 521308 - DNA, 275 bp, Homo sapiens
  misc_feature (28)..(28): n is a, c, g, or t
aagcagttaatacagactcagagacacngggttgggactgaggggagaggtgggagggaaagaaagaagatttgggatgagttgctttgggaacagagactagggagggacgatgtgtaaaagaatgcctggacgtgaggggcctcagaccatttgcccatttatgacaagaattatctagatcttgtaggatggaaaaattgaaagtgccattttctggctattgggaaccactgttgagtctgtattaactgcttggggtaccgaagctcgaa

SEQ ID NO: 521309 - DNA, 949 bp, Homo sapiens
  misc_feature (344)..(345): n is a, c, g, or t
cagtgaatattcagtacttgttgtcattcataaaaactagcgcatgaaagcgtacacaaatcggatatgacctgaaattcagctgcgtcgtgtatacatagaggtaacgacgattggaatcgacctattagtagaataatatacataatgatgtgcgcccacatgtgagtgttgaaaaaaaatgagtatgtacagtatgaagagagaaagattaggtacaaatattagtttgggtgaccagtatggtgtaaaaaagaacagaagaaatgatatatgaaatcagagattatatgatagtagaggggttgagtgcagtagagcggagacgtatatggatgtagtcnnggtagatctacggactactgattgaggtggaagtagcagtaggaaagaggaatgtgacacagcaggctccgtatatgagtgagagtaacagggacgagcaaggaattatgggaggtggttagtgtgagccagcacgtgcgttccgtagcagccaccagtgattgtatcagtgtcgagtacgaggaccgcgctgacggtgtagattgtcgctagtcctagcacctgagagcatgctagacgcaaggagagccagcgaggaggctgcgaaggagcttctgtgaagactcataagcagtagatagcattagaagtgcgcgatctggagagtgtagaaggtagacgagcgtagatagatgcatagggaggacgtagcgtgagtgaaggaagagagctggtagtatggtaggttcaagagcagaatatgcaaggaggtgggaagcagagttagacatgagtcatgggtacctccttgcagagagaggagatactctgtgctagtaagagagcttacgtgctctagcgtagaggttagtggctggcgacgagatgcaggtcatagtctagaggcatagagatgttatgctgctttagacgcaacaagata

SEQ ID NO: 521310 - DNA, 1356 bp, Homo sapiens
  misc_feature (1)..(2): n is a, c, g, or t
nncacccccccccccgcgccgcgctgctggtcgtgtagataaacaccacgctggtgggtgttcgctacctgtcatcgtagccgcgtgggggtgggagccagcctcacctagccttttgtgttggttgtctttcacttttctgatatatttatagcatcagcgtgcgtgtgtctctgcatccgtcacgcgtgcctttgtgttgttgtgctagttagtcggtcccgcgtgccgggtgcatggataggtagtgtttgttcgttcacgcgaccctggctggggtggtgctagtgtgtacgctacggatcgtctcgccagtctgatgtttggggtggcgcgcagcgcgtaactattatgaccaacttgaggtggtattcgctacttctaatactacaactacggttgtgatgagctttgccgcgcgggtgggttgtgctgcgacggagcggagtggtttgtaagttacttaaaactatccaccgctaagttgccacccccccccaacccgtggaagtgggtgattttttggttgctatctcgtcatcctcgtgggggtaggtgaataagacactctccgcgtggtcgaggtaggggccagcacagaaagcacagcagacacgatggggtggggtgggggtggagcggagagcaagaggagcgaacagatgaactcctcgcgcgcgtcgccgcgcgcgcaacgccaaacataccaccgcagcctccgcctgcttgtgttgtacggatctcagtgcgcgcgctgcggccgcccgcgccacataaagatatgatgtgccgcacgacgcaccccccgctcccgcaccgccgccgtgtagctcccacccctctctttctgcgcgcacacacacaacacacacatatatatattttttggagagcagacacacagcgccacctcactcacaacacacaacaagagaagatgaggttgtgcgctccgcccacctcctctctctttgctcacacaccacccacccgcctcctccctccccgccccgcgcgcggcctccctcccccctccacaaatatttcgggaaagactccaacaaacaaaaaaaaagaaagaaaacaaacatcccacccccccggggcgcgccgcgccccgcgcacgcagagagaacacacacacacacacacacacacagaggagcagcacccccccctctgtgtggtggggcgcgcgcaggcaccccccccccccccccccccctctctctcctctcccctcccctctctctctctctccccccctcctctctctctctctcttttagaacacacacacactctctcttgtgtgtgtggtgtggtgtgtgtatatatttcatatcatatcacaca

SEQ ID NO: 521311 - DNA, 216 bp, Homo sapiens
gaaaccccggggcctttttacagtagagagagagttatgattaggcaaatagcgcgttatcagccaccacctcgtagtcaagaaatagaactgtgtccggccaccggaagaaaccccaccacatgccctgactcaatcgtagctccctccttccccctgaacaagtaactctttgacttatagtaatcacctctgtgtatttactttataattttt

SEQ ID NO: 521312 - DNA, 668 bp, Homo sapiens
ccaccgtcttcagaaatcgcggcagaggaagaaggttgtagagcaaaataaaatacttcaggctgggcacagtggctcatgcctgtaatcccagcactttgggaggccgaggtgggcagatcacctgaggtcaggagatcaagaccatcctggctaacatggcgaaaccctgtctctactaaaaatacaaaaaattagccggacgtggtggcacatgcctataatctcagctactagggaggctgaggcaggagaatggcttgaacccgggaggcagaggttgtaatgagccaagattgcaccattgcactccagcctgggcaacaaggcaagactctgtctcagaaaaaaaaaaacaaaaaaaacccacaacattcactaacttagccatttttaagcgttctgtgacattaagtacattcgcactgttggaaaacagatctgtgagttttacatcttgcgtatctgaaactctatgcctgtgggacaacagctccccttttccccctcctaatagcccctggtaaccaccattatttctgtttctaccattttgactactttagataacatcatgtacgtggaatcataccatgtctgtattttgtgacagacttattcacttagtgtaatgtcctcaggactcatcctgttgtctgtgtaccgga

SEQ ID NO: 521313 - DNA, 444 bp, Homo sapiens
ccctcttgtcccattattttttttcaataagacgtctaccgccatgtattgacatttctaccacataagttcttgcgcgacaataagtgttctaagagcaaacatttgcgagccttgctgctccccctgcgagattttataagccccctctggtgaaggatttgtgcctttcccctctcttgagatttcttgtcggggaagcgggagggcccccgcggctgtctatatgcctgtcggagaatacgaaacttctcgaggagccctcccgcgctgacgtgggagacaaccacccagcgagctttttcaaatattcgccccccacgacgtgcgggcaagcttttgttagatcgtttgtaatccaacttattggacccatctcgactctcgggcctcgtggcagcacatatccccctagttattctccaagagaggaacaaaaacaaa

SEQ ID NO: 521314 - DNA, 741 bp, Homo sapiens
cggagtcttattgtggcggtggttgtctcagaatcagcggactttttgggtcgtaggaacctggtatgagtctctcttctctctctctctcttttcatttttaaaacgttaaagtatccacaccccaaaagccgccctaaagccgcccgaggggcttacccctatccgcggtccccagcgaatagaaaaaaacacaagaaggtctctcaccgcgccatagtgaggaaacgtacgtacccatatacccgctcattcggctctagtacgaaatagagtttagaaaagctcctaaccaagaaggagaaagataagtaacttagaaaacaacccaagagggtcccgctcgtccgggagttagtcggtaattcgggccttagactagcgagataagaaagaagtaaaagggactctctagatccgacctcccaccctccatatttcataacctctaagatctcacagaacgagggtagaaaattcgggccgcaccccccggaactcttctcatccctccgccactcgccctacacccccctacatccccctaacgatcctctcctccccccacctccttcctacccttcccgcctcccttcgacccttcccttcgaactagatccttaagtttccctcacgcagcattggcgacttacgggcgaacgcgacaaaaatgacgacggcgtcaacgacgaatacgatatcaatcgctactgttccaacggcctttaccctccgatttac

SEQ ID NO: 521315 - DNA, 734 bp, Homo sapiens
cggagtcttattgtggcggtggttgtctcagaatcagcggactttttgggtcgtaggaacctggtatgaggtcttacgcttagaccggaagtcgaggtatgaattaacgaggtaaagcgctcgcgaatataagtagagctagttagagtcaggtctttcctacatattaggggaccttgggcagggcctagccctcggtccgcccgcgtagcctcgcgacgggagctagcgcggccggccaaaccagtagagaggagaatctacgcactcgcctttacagtttatttagcccgcccgccccttagcaaaaggacctcatgacgaagtaacagggaaaaccccactcgtaccattagtaccctagctcgttcgggaacaaacgcaaagaaccgggggcccctttggagcgaaccccaggatctttcgagcgacgatacctcttactctatctctcgtcgggcccttcctcgtcctctagttttcctctatcgcttcccgattggcttctccctcctatttattacccagacaccaggacctcaaggagtaagtcctcggttcgtcgcccgtataatactctcattatacgctatcctccattacgaccacagttagcattcatttatcgggtatcccttagccctcgctatcagacttcctcttcccttaaaccggcactctcgatcttagcctcgctttaggctcaaggagacccccatacggctagatatata

SEQ ID NO: 521316 - DNA, 730 bp, Homo sapiens
cggagtcttattgtggcggtggttgtctcagaatcagcggactttttgggtcgtaggaacctggtatgagcggaaatcccggtaacacattcgtcttaacgatagcaggaaacacctaggtactctaataggcctcgagcggcgccgtctagttagcagtccccggctaaggataatagcccccattagcctacttataaaacttcggacccgcctagaacttcctaggagtttctttcaaggtacacttcgacaactactctagctaggcggacgcaaacgaaccgcccctaaaaccgtcaaaaataggaacctctaaaccgctttaaatcgacctagtcataatataagcaagcgaagcaatcgtctagttctttttcgaagaggaggaagactaaaacgaagactaagacgccttagactccatcaaccccatagccgaagaaccgaaataatgccacgatagcgccacaaactgatcgcatatcggcacctagcgccatctccgcggaacgaggcccataatactatagatagacgcccacgtagactacccggatcggtaccactggtaaaacagaatcgaaaaggacgccagttgaaaagctatctacagatgccggcatcatagcccaatagatcggacagaacccgaggagacggtcgactcggaagaatggtaaagagttagccccccgaaaaggcgtaccgagaaagcgggtctaaaatc

SEQ ID NO: 521317 - DNA, 282 bp, Homo sapiens
acgcaggttgtggggaaactgggttgttcagacactgccactgggctgtagcgtactatagccactttcataaacagtttgtcagtttcttaaaaaactaaaccttgaataccgatatgacccagaattacaccccttggcacctaccccagagaaattgaaacttcactggttgggccaaaaacctgttgtagggaattgttcccagcagctttattcataaatattgcccaagacagggaaacaacttccagctgtccttccagtaggtaacatagttaa

SEQ ID NO: 521318 - DNA, 727 bp, Homo sapiens
cggagtcttattgtggcggtggttgtctcagaatcagcggactttttgggtcgtaggaacctggtatgagtccgcattctccttctagctagaagcctcgagcattcccgtttcacctcgaaaagggtcaggggtcttcgtctttagtcgtttctccttcccggtccttaacctagcctttctcgttttgtacttcgtagataggtgtctttgtagggggtttccgcggattcgtatcggagctcgccgttcctatcgagtcgttcgcgtcggttccgtacggcgttcgcagggggacccgtcccgtcgcgttaccggggcatagtcgtcgtctccatctcagattaaaaagctgggccgagcgatcggcggtagggttatagacagagatagtggggagggcggtcgatttcggtggtttcggatcgagtgctcggaggagctgcggaggtctccctttcctccctcttctcgagagtctgcctcctaggtctccttagtccgctacgctgagcgttcggttatcgtctagggccggaggtctagctttcccgtttcgctcgccttagtctcggagtcaatctagggactttcgactagggccatacaggcccggcaaaacgagcgtcggaaaccaatccctctttagcagctccaggctacgtccagggaatccaaatcccacttagacaccggcccctcccaagttccctcaccttttccctca

SEQ ID NO: 521319 - DNA, 724 bp, Homo sapiens
cggagtcttattgtggcggtggttgtctcagaatcagcggactttttgggtcgtaggaacctggtatgagggctagaagagccgcgtatgtagaccagtaggttaaggctcgagttatagtagtacccccaccctagaccccgacaatcgcccacacgcgccgaaaattaaaacgatactcccccaaagtccacttacaaaaaaaaacagacgctccccacagcggaaaaatatacggggaaaaaaactactcaccccgacgtagtacccgacaacgacaaaatattctatattctatctcccacagcgtataaaacgaacgaggctcgggtcaggcagaaaaagggctaacgtcacccccgcccccagaactaccattccccattagtccccaattactcgacactcacagcagatatatcactacagccaatacagccaagcctagtatccgctctaccccaacgcaaagacccgtccttaccccttcataggtagctctctctccttctatagctttatcgcgtaggcgtcaccgccatctccatgaacacccctagcaacgccacccctcctcaagcgaaaccctcagttcgtatcccgacgctacgcgcctttcccgctccctaaatcttaaggccttttcgcggtttcctctttccatttcgggaaggttctcccggagattcccattttccgtcggcccggatcccggacatcccaa

SEQ ID NO: 521320 - DNA, 156 bp, Homo sapiens
aaaaaaattcccccccccccccccttaaaaggttggggctttaggggggggtttagccccaaaaacccaccccccggatgggggggggggacccaaaaaaatttttggcccgggttttttttttttacccaaaaaaaaaaaaagccccccgggcca

SEQ ID NO: 521321 - DNA, 719 bp, Homo sapiens
  misc_feature (71)..(71): n is a, c, g, or t
  misc_feature (89)..(89): n is a, c, g, or t
  misc_feature (100)..(100): n is a, c, g, or t
  misc_feature (108)..(109): n is a, c, g, or t
  misc_feature (111)..(111): n is a, c, g, or t
  misc_feature (132)..(133): n is a, c, g, or t
cggagtcttattgtggcggtggttgtctcagaatcagcggactttttgggtcgtaggaacctggtatgagnactctggtctatcgtaantcttgttcttngggcctanntnacctcttcgttctagttcttnnagcagtcgggatcataggcgttcgttattatgtttagtcaaccccccgcacccccagcagagatggggccctattgcgccggttaggacggctctgactcttcgattctgcgacttatttgttctggttctttaaagcgtcgggaccataggtgcgagttattgtgtttggttggctacctacctccgtaataagtacccaccgagtattcatcgcgcgtctatagcaaagaaatgcgactccactttagcagaggcagacacctcgaaaaagaacaacctccaaatcgtccaaaataggggcttttatttttaggttatagattagcattagcttgcggtatcggccaggaattaggttatatagtagggggcgagtggcgggcgagcgagtatagtcctactcgcacccatagtcgtcttttagagtccgtaccatcgttcgagtcccgttctttgctaggctagtagtagtaccagagctctacgggagcgtgaatttcgccgcgaatcgtatacgttaagggatcaggccgggtttcttccacgagaactcaaggttcgacgaactcaacgttctacgaatc

SEQ ID NO: 521322 - DNA, 718 bp, Homo sapiens
cggagtcttattgtggcggtggttgtctcagaatcagcggactttttgggtcgtaggaacctggtatgagggaaatctcgtaacgtatcgaagatactcgcaacacgacgccattaaagtagcccatacacgcttccacacgtacaccccccaccacacacccagcgccccacagaaccccccaaagccaatacacaacgcagacaccaaccccccttctggtcgcaaaacgtcacgggtaatataactacgtaaccacaacccgaaaacacccttcccaaagatagagcccgaaatctactccggcaaacaaaccgtaaaccatctgcatagccccataaggactctacggtagaatagtggaagatccggcttgcaatctaaggtcgccgcacgtaaatcatctcctcagcggccaacgtatccgatacgcatagcacgccctttacgttgccgcgaccccgatacgcatagcacgcccctacgttgccgcgaaccccgccgcctaatttaatccgagacggccctaggaacggtcgtaactctaaaagtctaacgcatcgtttaagaggtattccgcgtaacacctttactttcgaacccagtaccgcattaggaagacccctcccctatctaatcggaccagtaccgctcccgcggcagtaccactccagataccaaacccgaagcaatacacacttcgcagccataccagttt

SEQ ID NO: 521323 - DNA, 972 bp, Homo sapiens
  misc_feature (904)..(904): n is a, c, g, or t
  misc_feature (907)..(907): n is a, c, g, or t
  misc_feature (931)..(931): n is a, c, g, or t
  misc_feature (943)..(943): n is a, c, g, or t
cggagtcttattgtggcggtggttgtctcagaatcagcggactttttgggtcgtaggaacctggtatgagggacgataaaagggaaaaaaaaaaaagatagagaataaaagaaatctatagtcctccctccccgggccgaagcgcactcccttaaaaagacacgcctaagctccaattttcgggattcgcgaacgagattccacccggaaacaggactcccgtagacgcaactaaaacaagacgaagccgcatcagaacacggcgaatttcaacttagcgaccggtacttccacgaggagagggaaacccagagttcgagatatatggagggaaggtagcgcgaagatttaggaggacgttttgtggcgttagtagttaagacggctacgatgcgttatgaattttaggacgttgaggatagtcgatgactattagaagtcagagagaagtaaggaagggcttcttctcctagttcctagggagagtcgggctcgtcgatattcggaccccggatccagggttcttagaatcgcgagagaacaaaccctcgccgcgctaaaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521324 - DNA, 707 bp, Homo sapiens
cggagtcttattgtggcggtggttgtctcagaatcagcggactttttgggtcgtaggaacctggtatgaggcggaggggtcgcccgtcaaactaactagacatacctctcccccgtcaccaaagctactcacccagaacgccacccctaccttactcatcaacccccccccaaacagtaacccaacctttaggcccggggacagcatcccccggccccgctccgctacatccaataccccacccccgagatcgacaacgctcctagctagacgcgaacgaacgccagtatacaattttcttaaacctacgcacccagacagtcatcgtcatagcgtatcgcacggagcgtcgacgagaatagataaaaggaataaaattattccctcgctttagagtcgtccacattcccgcaatagggaacgcgctcacgacagccagggaaattcgccccagaagagtcagacactcgctcaatacccatagtagccaaaaccccaaaaacccaccaccaccccgagaaacggggctcggtcgcgccgcccaggtcggttcagagccttcggacccaagtgacttcttcatcctaattcctcgagcagtcgagatcataggtgtacgttatcgtttcgggcccgaaataccgaaaaacccctagttaggcgtaacgatctatattcgggactttagtatccggggaggtccaggc

SEQ ID NO: 521325 - DNA, 704 bp, Homo sapiens
cggagtcttattgtggcggtggttgtctcagaatcagcggactttttgggtcgtaggaacctggtatgagggaagacacgagaaaacctacggaagaagcaaggaaaaggagagagtcagctcagacaaaaaaagagacaaagatcatagaaggaaagagactccgttccccgaaaagacgaaggaataaaggccgagagaatacccagcctgccccgaaaggtcgtgatgagtaacggaatcctgaagatgaagagagaccgtagagagagagtgctgagagtgagaatgtaccagaacaacctgcgaatgggaagaatgggaatgtccatagagagagagagagtgttcagaaaccgaaaggtaaaaatcagagagagagagaacggaatgtgaatgtccggaaagggaatgtacctgcaccgaataggaatgctgcaaggaagtcgaatggaccgtctgagaaagagaggaatctagaaggtaataatagtagtcctgccacgaataagaaaaaaggaaccttccgaaatgtttatgcgacgcagactacaggtgagacgacttccatcggagtgagaacaaaaagccgctctcagacatagacgtatgacccggttacggacttgatcatctccgttaatagaatagacccaaggatcccgactatttagagaggggtaagccctttcgagaagctaata

SEQ ID NO: 521326 - DNA, 1231 bp, Homo sapiens
gaatctgcacgagtgtgaggatgcgcttgtggtctcatgacactgaaaccatggacaacgaactaggtacgacccatgagctgactgtctgggtccggcactgacgcttgccttcgaagcgccttggttgcgacactggggtcaatctctcactcatgcatgtgctgctgacaaagtggagccatggccttacttgactgagacccaatgccaaaagtggcccaggtactggctgttgcaggcatgcactgggcgctctatacggatctggtctgaggtaccaggtccatgcagacggaacttacatgcctgaaagttgacatccctctgggaatcagacccagtgacgtggtgtgccactttctcactaggaccgccatgttgcttagggagcttgcatttcagtggacccctacttcctctctcaggggaactaaccgaggcttgtggaatttggatcaccaagggcccaagggaggcactcgttgcatagcgaacatgccttgcaagtgtacaaaccttggccaacagtgcacacggaaggaacgcctgctgatcccggttccgtgcgcccattaattgcggagggacccgatgtggcgctcacttgtggacccaatgggaatggccctggtttccccgggcagcggcatgttcgcggtggaatcagttataagtccccaagggaaagcataccacatttgtgttcccccgcggatgccaaatcgccatccaggagttccaagtacccggggccagtaaatccttgtggtagacgacacgtgaccacctgtgccgaggagggccttggcacattcggtctacatcttttacgcacgggaccgtgagacaagtgaaccaaggttcctgtaaatgcggctcgccgggatccccccttcgtggtgacaaccgaggtcgcccttccactgcgcagaggaccatttgcacagaatcccctgggtggtagcacaagagtagtagcaaacgactctggtgtctcggtcctaagagacctgggcaaggcgcctttgtgcctacctttgccctcaattaaagagacattttatcgtgctatggctaccatggggggagcattggaattcccggacctacggggccaccctcatggagcatatcgttcctacgaccaaacaatggttgcagccccttcaagaggctcgaatccctcaactgcgcttaggccattgactgaatactaatggcggtccag

SEQ ID NO: 521327 - DNA, 179 bp, Homo sapiens
ttcagcgctgccacctggttatcccctctctcgttgaatatagcatcgcgtgttcaattcctaaacacaggctgcctgcactcggtgttacctcgggctgaggcactgatcactattttattttttaaatgccgtgaggaaatgaaagtgaggctttgtctgcggcatctttcctggga

SEQ ID NO: 521328 - DNA, 481 bp, Homo sapiens
cccgagaggtactgaaggtatctcatttataatagctacaaaaagaaaaaagaaaaaagaaaaaaagaaaaaaaaacccaacaacctaggaataaatttaaccaagaagatgagagatctctacaaggaaaactacaaagcactgatgaaacaaatcgaagaggacacaaacaaatggaaagacatcccatgctcatggatgggaagaattaatattgttaaaatgactcttctatccaaggcaatgggtagattcaatgcaaccgctatcaaaacaccaacatcagtttttcaaagttagaaaaaacaatcctaaaattcatatggaaccaaaaaagagcccaaatagctgaagcaatcctgagcaaaagggacaaagctggaggcatcacactaccggacttcaaaatatactacaaggctctagtaaccaaaacagcatggtattgacctaaaaacagacacagaccaatggtatcag

SEQ ID NO: 521329 - DNA, 250 bp, Homo sapiens
tctcccgtcgactctgcaggatcccccagcttacatgcatgctaactaggacaaaaagttttacggtgctttctcacacaatgtctgggatttacagatacaccagtcgttttggtcagccgcttaatattattatcattttaaccaccagggccaggtggtggcgccaaggtcgtctagctatttatcttacttctgtttctttccagctttttgctttctcccttttctcctgtcttataaactaggg

SEQ ID NO: 521330 - DNA, 601 bp, Homo sapiens
  misc_feature (46)..(46): n is a, c, g, or t
  misc_feature (257)..(257): n is a, c, g, or t
  misc_feature (416)..(416): n is a, c, g, or t
  misc_feature (419)..(419): n is a, c, g, or t
gccttccctttctaagaagatgaggacatcattagcagatccagancgccgccttcatgttaccggccagccccctgaagccacatctcagctggagccatttacctcatcaaccacctgctgcaggtgaagatgcgcaaacgctacagcgtgggcaaattctcagccacccctggttacaggagtaccaaacgtggctggacctcccaaagctggaggggaaaatgggagaaccattcctcacgcattaaagttcncacgcgcgctgggagcagttttcaacaaagcatcccctgcctgggtttgggctgcccccggacagggatttcggtggggcctgtcccccccaggaccccgacatgcaggggctggcggagggcatcagtgtttttttaggtcctgtgcccttgtccaantgntgccctccccaacggttttttccaggattccaccaaataacttgttttagggaaaatggcttcctgccccaactggatgggacccgtggggagtggggtggggggagctttttccaaggcccctccctgttttcccagcaatttaaacggactcatttttggccccatggccttgttttcca

SEQ ID NO: 521331 - DNA, 165 bp, Homo sapiens
ttatgtgtgtcgtgcaggtgacggcttctacgaacgtgtgaacccgtaggcttggattacggcgaagcgatttctaggatacgtcagtagaactacgacatgtgaagactatcacgtgtacgagggaaggttaactggttgatattgctagggtggcggctctgg

SEQ ID NO: 521332 - DNA, 939 bp, Homo sapiens
ttggtccgagttcccagagtttccctctgtgtgtgccctaggctcggccggccggtgccccggctcctttcctcctttcggccttcgccgtccaccaggtccctctctctgtccccggccgccatggagcagccgccggcgcctaagagtaaactaaaaaagctgagctgccgacacgttcgacctaagcagcctgaacgcagttcttctgctgtattagagaagcttgcgagaagggtcttatggacgtgtctttaacacgcactacacaaggaatccggtcaagttcgctcgccattcaacaccagtacctgctctgcatcagcatcttcagcgaaatcatcaaagcacatttccataatgcagcaactgtgacagcccatatgctcgtaccgtactatggcagttatctcaacgaatacagacctctggactcgctcatggagtactgtggcgctggctctgctctcacacataactcacgattacgaacacaagaccatccactacgcacgatgcaccttgcaccattcttacatctacatcgaaaggcactcgcctctccgcacctccctgcagccaccatacaccagacgactctccaccgctgccacatctcctcctccatacagaccggaccatgcaacctcgcgccgcactcccgccactggctgggtcacctcaccctgactccctgggccaaacgtcgcctaccgctcatctgcgcacttccctccgcgcctggctcctgaggctgagtccccaccaacatccggcccactcacccgcgtctgccaccaccctccggccacgcgtggcactaacctccatctcgaccatcgctctacagcaccgcccccctatgcctgcctattccctcacattaccgcgcacccttacagacctcctacaagaccacccccccaagctagccagccc

SEQ ID NO: 521333 - DNA, 337 bp, Homo sapiens
  misc_feature (227)..(227): n is a, c, g, or t
  misc_feature (322)..(322): n is a, c, g, or t
ttcactgctaacatttttatttataaaaatatcggccagatgcggtggcttgcacctgtattcccagtactttgggaggctgaggcaggtggatcacgaggtcaggagatcgagaccatccgggctaacacagtgaaaccccatctctactaaaaatacaaaaaattagcatggtggcaggcgcctgtagtcccagctactcaggaggctgaggcaggagaatggtntgaacccgggaggcggacttggcagtgagctgagattgcaccactgcactctggcctggggtgacagagcgaaactccgtctaaaaaaaaaaaantcacaccgtgcctgc

SEQ ID NO: 521334 - DNA, 554 bp, Homo sapiens
gtaaccatggatgttggtatgacaaagtttgaaaccacaagccaaagttattacattcaatggattggggggccccttccccccaggggcccaataaagggacttcagttccaaatatgattacaggagcagcccaggcggatgtagctgtttagtgtgtaagaacttgccgccaagggcaggggagagttgtgaaggcgtgggacttttctgacgcacctgcgacggacgagaaccacgaagagcacttggacgtcctctgggttcccggtttcctcacttgcgcgaaggtgaaccgcatggcctttggcaaggtatggccaagggtgttaactcaacaaaactcggggactccaaggctttacactttcgggggcaaaaccaaaagcacacagggctttctcaaacgcgagacaatgtaacctgggccaaagacacccttgcgaggccaacccgttctccttttaacaggcccaacaggcgaaggcgccttcctctcacaccgcgcgaacgcacgcctgcgacttgcgttacggcgccttgcctcctcaatc

SEQ ID NO: 521335 - DNA, 140 bp, Homo sapiens
ctaggtactctcaggatcttacccgactagccgacagggctatggggtatgaggcaggaggatcatggggctgtgggaccagaagagaagctggggtcagaggtaggagctgacgctgtcgggctagtcgggggggtcgg

SEQ ID NO: 521336 - DNA, 146 bp, Homo sapiens
gtactctgaggattacctactcagcagtttgcaaagatcctagttccatttcctactgagaagtgagggagcctgtctaccagaaggaaatggagctaggatctttgcaaactgctgagtagagaggagaaaccgtcgaattcgag

SEQ ID NO: 521337 - DNA, 253 bp, Homo sapiens
gcgctgagtatcgtcgataaaaactggctcatgcagactgcaaatggaagacgatgccagcaacgcatgacgcttggtatctaaaggattatggtcatactatagttgtcacggtttggcaaacaatcgcgtgaagtgtttgccatgctggcaagcttatcgggtaatgaatatgaacatgtactgtggcaagatgactttgataacacaccgcctaatacgttacttgaatttatccaacatgacatcttaa

SEQ ID NO: 521338 - DNA, 387 bp, Homo sapiens
acacaggatggcagtgctcatatcccgcattatctcatgacatcttctctctcagatgaaagccttggtcgccgacgcgtcctgaatcctgctgaagaactgcaccacctatccatgcattccatgatgatgaggagacagcgcttgccatggtgcatgttctcatacacatccaggatgcagacaatatgggggccgccagaagcctgccagtgatggtctacctcctgccgggccttggggctgtcatacaggagcttcagggcacacttctgtccagtgcgccgatggaagcactccagcactttgccgttcacacccaggcccagcacctgcttggacaactggtagtcgtcgatcactgcgtacttcttgggctcccgccgc

SEQ ID NO: 521339 - DNA, 396 bp, Homo sapiens
  misc_feature (211)..(211): n is a, c, g, or t
  misc_feature (255)..(255): n is a, c, g, or t
  misc_feature (287)..(287): n is a, c, g, or t
  misc_feature (300)..(300): n is a, c, g, or t
  misc_feature (361)..(361): n is a, c, g, or t
tgccgtgcaaggcacaccagagtcaccctactgaaagccagaggtcaacgaagacgagaagaccaagaagacggtggaacgacagcttcaaatgctcaacaggaccaggcaccgcggctcccgcctggaatcccagcatccaggagacagagtggggaggatcacttgaggaaatcaagaccagcctagacaacatggtgaaacccatctntaccaaaaaattaagaaattagctaggaagctcacgtgggaggntcgttttagcccgggaagtcaaggctgcagtnagctgtgactttnccagtgcacttcaacctaggcaaaaataataataataataatttttaaaatggactgggtnagggtggatcatacctgtaattccagcacttttgg

SEQ ID NO: 521340 - DNA, 593 bp, Homo sapiens
aggagactcacctcgcacataaggactcacataaacttaagtaaaggagtggaaaaaggcatttcatgcaaatggacaccaaaaacgagctggggtagcaattcttacataagacaaaacaaactttaaagcaacaacagttaaaagagacagagatgttatataatggtaaaagtccttgttcaacaggaaaatatcacaatcctaaacatacatgcacctaacactggagctcccaagtttataaaactatgactaatagacctaagaaatgagatagacaacaacacaataatagtgtgggacttcaatactccactgacagcactaggcaggtcatcaagacagaaagtcaacaaagaaacaatggatttaaactataccttggaataaatggacttaacagatatatacagaaaagttcatccgacaaccgcagaatacacattctattcaacagtgcatggaaacttcttcaaggtaaccatatgataggcccataaatgagccttaataaattaagaaatcgaattatatcaagcactcttgtagaccacagtggaataaaactggaaatcaacttcaaaaggaac

SEQ ID NO: 521341 - DNA, 714 bp, Homo sapiens
ttaggtacgaggctgggtgttaatcggccgagggcatgaccacggtatctcgaggtcattggcttcaccatgattgtcgttggccgcgctgcagtgtgggcggacacggcgagcggctgacgcagtgtcgcgaggtggtgctcaccacatccaaggaccatcccggtgcaggtggatgtgcgatgccactgcaatgctatgcatgcctcactgcatcctgcatctgccctgctgcaaccatggccaccatggtgcagaatggccaatgctggctggatgctgccgcccccctgcacagtgctgaccatgctagcctggtgccatgatgcatgtttgctgcaatccatggtgatgtcgcgtcatgcatgcactgactatgagtgccctgcactactgacaatggagcagctcaatggaggcctctgtgcctgctgggcacttgtgtgtggtcccagtgagacatgtgacctagagctctgccgtgcccgacattgatgatgactaccatgcattggatgccctgatgtgtgcttggagccaatgtcccctgacatgccagaaactgtcccccaagtggtgcttcctggacgccatcactgccagtcgcttctacagtgatcgacctgagcccagtgagcacctcaactatgtgactgagatcgcacaggatgagatttatatcctggaccctgagctgctgggggcttctgccgg

SEQ ID NO: 521342 - DNA, 245 bp, Homo sapiens
  misc_feature (23)..(23): n is a, c, g, or t
  misc_feature (26)..(26): n is a, c, g, or t
  misc_feature (56)..(56): n is a, c, g, or t
tgtattcgtatgatgtataggtnatntacaacatcccatgcaaaaaactgggtcancagccaaagcagtagtattcagaatccaacttgggacgcttgtgcactgtctgtgagtctgctagaatggagctgtcagtgaattggtccaagtctgatggagtctgatggcctggaacatcatctgccaaagtgtccaaatagctccctacagagatgccatccagcccatcactgccatcatggagg

SEQ ID NO: 521343 - DNA, 622 bp, Homo sapiens
gagagagagagagagagagagagagagagagagagagagagagagagagagagactgatacatttagatagatcttgactggacctctccttgatctgtaataccggattaagcctgctcaagttgacatcctgacctaagcaccggaccttagttgccgcacctattccagtctagcctgtgtggagcctgtctgactttgttgaactctctggctataacacccatgagagttttgactcggactatgttgttccttcccattttctcgtgctcatgatggataccccttcctgtattggctcacagacactttgtgcgccttcgccaagacactcccggactgctttagctgccttctacagtggagcgacgccttcttcctattctttgtgctcccttgcctcttcttggataatattgctcttgagggactattctccttcttcttggggtttttttgggggtgtgtgaccttaccattctaatttttcttgtgattctggatatatgtgccctcctgggccttttgtcctttgcaagtccctggtgacagtttcccacttttccgttgggattcccgacccattccttagccccacccttcttttttccgttggtg

SEQ ID NO: 521344 - DNA, 169 bp, Homo sapiens
tggctgtggtggctgccgggatcttgggggcctcgggcgctgaccaggtggactgggcgaccctccgttctgttgctgcctgtgtgaggcgggagagctgccggggccgacacgcgccccactgtcagaccacggaatgatgtgggggggggggcggggggtggggggg

SEQ ID NO: 521345 - DNA, 223 bp, Homo sapiens
gttccagtcatgggtttcccgccatttcggcgaggcccaggccatgaacggaatggtgaacatcggcgccgtcggccgggattagttgcgccccagggtgtcatggccggcggagtcgaagacgtcctcgccgtggtccgagaggaacagcaggaaaccgttggggtcggtcttggcgtagttctagatcaggttcgagacccacgaagtcgttgtacagcac

SEQ ID NO: 521346 - DNA, 100 bp, Homo sapiens
agcactgtttggactctgagcactgtgtgtactctggccaccgttcgaactttgagcactgtgcggactctgggccctgttgcggactctgagcactgtt

SEQ ID NO: 521347 - DNA, 362 bp, Homo sapiens
attactggacttctctcacatcccctctatgtgcagcctgtttgtgctagcatcaaaatgcagctatggatctgaacactttcaaacttggatcttcacggaactagtacaatgaacataagcaaagcatacgtgcattatcataaagcaacatgatttacctccactgcgcctccaaacatggtcattggagaaatccttcccatgcccctagatgataatttggacaagcccatgaccattctgacagctcctgggtaaggcgaagttctacagccactttcaagtggaaaatacagtttcaactcggcagttgaaagtgttcaggccaggtgtggtggctcatgcctgtcatcccagca

SEQ ID NO: 521348 - DNA, 140 bp, Homo sapiens
tacatgatacgaatcgagctggtacctcttcccttggacaaagtgtattctgtagacagtagtggagaccagcagctgtgctttgtgccaagggaagaacactgcatgccctgggtctccaaatcccagagggtaatggt

SEQ ID NO: 521349 - DNA, 710 bp, Homo sapiens
cctgtacactgtatccgtgacaaatctggatggtgccttcaatgtgctctcatctgcatgctcatgtacatgctgtgtggctcagtgtcctgctgtgctctccgcaccaccccacttccatttttggccaaaccaacctgcacccctgaatttctccgcaaatttcctgccggcaaggtcccagcatttgagggtgatgatgtgattcttgtgtgttctgagagcaacgccatttgcctactatgtgagcaatgatgtgagcttgcgtggtgaagtacgtccaaggagtgcagcaggaccaagtggtgcagttgggtgagcttttgctgagttccgatatagtgcaccccagccaggtacctgggttgttaccccagctatgggcatcatgcaaccacaagcaaacagagacactgagaattgcgaaatgtgagggcaagttgataggctgatctatcattggagtgccttgcttgtgattggctttagctatggaaacagaaaccaggagggcgaccctataattacagtcgtcgattgtggcccatgaaggctgaaggtttggccaattcatgtagcagttgccagattcaacacaagaaatgtcatttctaacccacaatggtaatggttgtgcctcataaatcaacgtccagtgtgaccttacaagccctatccttaagccttggccaagtgcctatacccccaag

SEQ ID NO: 521350 - DNA, 996 bp, Homo sapiens
ggacccccgggcactgcccccgacctcttcctccctcatttcctagggggagatggcccgtgtctgaccccccagcctcgtcgctccatgcagtgtctggccaaccgcagcctgcgccgtggcgggaggcactcctcgggcagcgccgacgaagcggcgagtgaagaaggtgctgggccatgccccgtcagggcggctgtcccagccgcttccactcagtaccagcagcaccgaccgagtctggagggcggcacggagtccccagcagaacggcccgtagcggagcagcaggaggtcccagggtccgggcgccgtcttggccccgagtcctgcagccgcaggcggcacgaaagtggagccagcccgcaaacttgccccgctgcggcccgcggctcccggcaaatccccctcaggaaagaggtctgaaaatcaaagatgggaacactcggagaagatggcccttccccatggccagcttgttcaatggtatacacttgtatgagcaagcaatagataatcagagttgaagagcaacactataaggttgccagctaaccaagatcacctctgcgaaaaagaaatgaaaacaacctttgccaggattctgttgcatcctgacacgaattcagagagccaggaaaataagcctttgaaaaataccgagaacattaaaaattcgcatttgaagaaatcagcatttctaactgagtgagccaaaaggaaaatatgctggggcaaagttagtgatccaccttctcctagtgtcttccaagctcctagtcactggatggacgctgttgaattccaacaaacaggagctatggaaaccttaaacgcctcaagtcaaatatattacattagttgtggggtaaaaattccaaatcggctggaatgtaaaatgaaggctgttacacagtgaactgaaacacaacggatatatcaacaggccagatttaacatcaaacataattccacacttactaccaacatgttatc

SEQ ID NO: 521351 - DNA, 201 bp, Homo sapiens
ctcaggaaaggtatcacattgtgggtcagaaactaactgaaaatgaggctgggcacggtggctcacacctataatctcaacactctggaaggccaaggcagacaaatttgcttgagctcaggagttcaagaccaaccgaggcaacatgacaagacccctgtctctataaaaatatttttaacaaattatgctcgggtgtgg

SEQ ID NO: 521352 - DNA, 246 bp, Homo sapiens
gtcacttccccatcacgtagtacagatgggtctctagtagacactccgaaattcttgggtgaaaaatatataccgcaggtacggatgagaacaggtgtagctagtacagtatactcaagcccagaaagatgatttaatccttgaaggaaatgacattgagcttgtttcaaattcagcggctttgattcagcaagccacggtcaacccagaagccacggtcaacccaaaagccacgggtcaacccac

SEQ ID NO: 521353 - DNA, 773 bp, Homo sapiens
  misc_feature (705)..(705): n is a, c, g, or t
  misc_feature (708)..(708): n is a, c, g, or t
  misc_feature (732)..(732): n is a, c, g, or t
  misc_feature (744)..(744): n is a, c, g, or t
cggagtcttattgtggcggtggttgtctcagaatcagcggactttttgggtcgtaggaacctggtatgaggcgtcgggaccatagatgcgagttattatgtttagtttagaaaccgaccctcacccgttacctcttaaaagataaaaaaagccggccccccccccccctggctccccgcccgcccgcccgccccccaagagacagggctccgtcccgccgtttagatcggaggctagcggtcccctatagtcgtagccacagttcatcgtagttctgaatctccggttctaagtaacttctttattctagttctttaggcactcaggataataggtacgtaatataaagtatagtctcaaaaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521354 - DNA, 697 bp, Homo sapiens
cggagtcttattgtggcggtggttgtctcagaatcagcggactttttgggtcgtaggaacctggtatgagtcctttcgggcggttgcaggatataggatgggaagcgtgcggcgccccctctcgctcctttcatagtattaagtatagaaccgggcgttcccttagttgctggcttccttccgtcgagacgccagatcggaagacgagaaacggtactaccccaaggtaccaattgccttagttaaggaatctctaccctataagcctagcgaatctccaatcccggttctcgtcgtaggggatagtagtgcgacgccctagaattcgatcccggagctaaataaagttcggacccgaagtttagcctcgttattcgtcagtcgccggtaacccatccaattctctttcgtcctagcccttctactcgtaaaggcgtcgtatcctacaggcccgccccgaggaccaagctgcacaaagtatggatgaagttccgacgtttggagccatcgtcttcgccatctcttcggcatagtataggctctttctattatagggttaggggtagggttaggtagttccgcaccggcccttccaaatggggccgacgttgggatccgggcccggtctaagtctatttcgcttgagaacgccggcaaattaagtccctttacgtttgagctattttagggtccggga

SEQ ID NO: 521355 - DNA, 1561 bp, Homo sapiens
  misc_feature (159)..(159): n is a, c, g, or t
ggtaaaacctgagcccatgcactccctaacagggcgcctctctcagctcgctcctatatgactctcgcggtcctcatgccatgtgatttcacgttccagctccataacgcatcctcagtagctagcgcgcgtagcgtaacgcaacagcacttaatccantactaccagagtgatgggcggcgactttaacacggagaagaggcgacataggcaaggccaccacagaccacctgtccaaaaatggccgttcgagtacaggggagtaagtcactattttatttagccgtcaggaaagtttggtgttactttgcgcctagggagtttcctctacgttgcaggcgcatatttgacacactacctagaccttagacgcctcttaagcccccgaatttcagtgagggcactttggggccccgcgatatactgggattgcacctccggcctgaacagttccacgctaagaaagtgcgcgcacataccatggaaaaacaagccaatacgcctgtgatgtgacctccggaagagttcgacggaaagtgaagtacacattgcagcgcgtagaagagctacagcgcaattaagtctaggatagaagaaaacatagccagtagacactcgagaactaaatgtgcggaatgcccacttgctcgaatttaccacattaatacaaggtggggggtcttgcatcatgttggtgaccccatgctcttaacaaaagacgcattctagagaggctcacatttctgcaggtcctcacctatatcgaaccgaatttgctgcctggaaacgggctatctccttaagcaggacatcgaatccaattctctgttaagcctaggcgcaacaagcggacattcgccaaccgaggaagctttccaaactctcaacttactctggggcatcaaaccatttaatcctgccaagctaaagtacgtggcgtgtcaacttcccggcgcgaaagctacagttaattggacagcctgtaagcattccccaaggatgcaattccaaccttttattggcggacttgtccgcaaaaagcccttggccggacccttggaaattaccgttggaacaattttctcgggcagcaaattgtcgggggattgacacgtacagtaaccttggcgattggttcctcaccatctctcaattggaactgaaggggggcttagaaaaaagaaaaaacagcctcagcagtcaagagaacacaaaccaacaacaaaaaaaaaccctggggccaatatcctacggggcggacaacaacaacgcagacacgagcagggccaacacggcgccagcaggagaaactaagcaaccaccgccttagacgcaaaagaggggagaaaacacggcaggcacccaataatgagagccgctctacttactcaccaaaccggaacgcagcacatcgaacagcagtccaaagagcacacaacacgacgacgcaaacaacgacaatcagaagaagcaagaaagagcaaaacaaacaacaacacaagcacgcacagcgaacacacacgcatggcacaccctcccagccaagatcaaacacacgaaa

SEQ ID NO: 521356 - DNA, 888 bp, Homo sapiens
  misc_feature (54)..(54): n is a, c, g, or t
  misc_feature (72)..(72): n is a, c, g, or t
  misc_feature (83)..(83): n is a, c, g, or t
  misc_feature (91)..(92): n is a, c, g, or t
  misc_feature (94)..(94): n is a, c, g, or t
  misc_feature (115)..(116): n is a, c, g, or t
  misc_feature (820)..(820): n is a, c, g, or t
  misc_feature (823)..(823): n is a, c, g, or t
  misc_feature (847)..(847): n is a, c, g, or t
  misc_feature (859)..(859): n is a, c, g, or t
tgagcccccccccccccccccctctcgctgtttaggtcggagcgtaccggtgtnactctggtctatcgtaantcttgttcttngggcctanntnacctcttcgttctagttcttnnagcagtcgggatcataggcgttcgttattatgtttagtcaaccccccgcacccccagcagagatggggccctattgcgccggttaggacggctctgactcttcgattctgcgacttatttgttctggttctttaaagcgtcgggaccataggtgcgagttattgtgtttggttaagagtcttcctccaattgtataggtacgcgaggtttagaagatcggtctcgttattagaaggaaggaccgcccttcctaattaattccccggccgtcattaccctccgcttccgagaaaggcgtcttcagcgtccgcagagggaaatgtcatgcttgtctgcgttgaaccttcgtagtttgggggacttatcagcctcagagtggttgttattgtggcggagtcttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521357 - DNA, 298 bp, Homo sapiens
actgaagcgcctcgtgctgaattgcatgccaatctctgagagctgtatcctttattgaacttagcaagccacaacccacagtctctctgtggtattaaaaataaaagagattacgttagattccccacttcctttcctgccttgattctttccattttaaagtgagaccccttgtctctacaaaaaattcataactaactgggcgctgcgttgtgcatgcctgttgtcctagctacttaaaagactgaggtgagaggattgcttgagtccgggagttccaggctgcaatgagctatga

SEQ ID NO: 521358 - DNA, 953 bp, Homo sapiens
  misc_feature (71)..(73): n is a, c, g, or t
  misc_feature (83)..(83): n is a, c, g, or t
  misc_feature (87)..(87): n is a, c, g, or t
  misc_feature (92)..(92): n is a, c, g, or t
  misc_feature (96)..(97): n is a, c, g, or t
  misc_feature (99)..(99): n is a, c, g, or t
  misc_feature (102)..(102): n is a, c, g, or t
  misc_feature (163)..(163): n is a, c, g, or t
  misc_feature (218)..(218): n is a, c, g, or t
  misc_feature (222)..(222): n is a, c, g, or t
  misc_feature (225)..(225): n is a, c, g, or t
  misc_feature (885)..(885): n is a, c, g, or t
  misc_feature (888)..(888): n is a, c, g, or t
  misc_feature (912)..(912): n is a, c, g, or t
  misc_feature (924)..(924): n is a, c, g, or t
cggagtcttattgtggcggtggttgtctcagaatcagcggactttttgggtcgtaggaacctggtatgagnnncataaaaacnagtngggtncggnngngtncgttcgcaactttagtcatctaggaggtcgaggtaggagaactgtccgaatttgggaggtngaagccgtagcgagtcgagactgtgttatcgtatcttagttcgggcgatagagtnaganctngctctacaaacaaacataaagtttacctccttagagctccgcgttccaaacaaaatatattctctcgtcgcgggaagatcgcgtaacggtatagttgtagagtccggcccgggaggccgaagcgtctcggggagaacctgcagactacttctagaaaagttccgtttcggcgcctcattagaaaaatgctctttaactatttaggaaagtcgcttatagcagcttttttccacttatggcgctatcccttacgggcctagccactcgtggctaattatggctcgataacaccaaacggaaaacctcctaaatagccaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521359 - DNA, 650 bp, Homo sapiens
cttacccacagtttatctgcagatgagaccgaagcacagagaactgcctgctcatgtcactcgggcttatgcccaagatgtcgagtttgccgtatatgcctgagccttaatgctgcaagcagtacatcttatagccgcagctgctaacgtaccaatgctgccatagggaagaacagtgattatacgctcagagctgaacctagcctacgggcacaacatgctaagacactagcggacagtgcgttcgactatacgctatagacccaatcactggagctacgcttcatgatgatgtagccattaccgcgcatgcctatgctagagatgatactaccactggtactgacctgctacgctctatagccaagcatggctatgagacgatcagtattggagctaagcagtgtaaatataaggggctacatgatcctgttgatgctgtagtgctgcacttaggaagcagctactccagagaccaccctgtgcgaagtgcacaagatgctacgactacttgcacacgcgacttacgacgtagctgatatcatcttagatcagtgtatacccacgcccaacccgggtgcagcacttgaaagggatggagctcaattactggatacttgattaacacgtcagggtgcgcgcctagtccc

SEQ ID NO: 521360 - DNA, 673 bp, Homo sapiens
cggagtcttattgtggcggtggttgtctcagaatcagcggactttttgggtcgtaggaacctggtatgagcgataacgaggcactcgcctcggaggttatcggtactcctaagaagccgtttaattcgtggaaaacaaactcgagcaataacaagactaaggaggcgtgagagggagtccctgacggagtagttagtgcgtaggagtcgacgtcgatagggaattagtcggagattgcgtatgggtgtgcgccttgcggttctagcggttctaaaattccgacgtcgaggagcaatccgactggtcgcgcgagcaacgatattcccgttggttcgagcctggcgagatcgtcgctttctcacgataactggactattattactattttcggggttcctattatgtccgctctttcgcttattacaaattcttcgcttaattttcctaatcgtaatcgttattcggttcggtctggtaagcggccgaggaagaggtggactgctagcgggaatttcaggcgttagaagttacccccttctaaggagacctttacttaggacgcggttacttaggatcctattcgcgacggtaatgaggagagcaatcgttagtcgagtttgggtcgtttggagtaacgtattcgcccggaaatagcggcgtgacgtagtaataa

SEQ ID NO: 521361 - DNA, 951 bp, Homo sapiens
  misc_feature (883)..(883): n is a, c, g, or t
  misc_feature (886)..(886): n is a, c, g, or t
  misc_feature (910)..(910): n is a, c, g, or t
  misc_feature (922)..(922): n is a, c, g, or t
tggcatttctactcggccaggtgcttacactagccggatggtagtctctaccacctcgtttcctgcggtgtccgttggtcacgccgcgtttcccgtccctctgggtttcatatattgggtagtttgttatacgtcgtgtgcttgtggcgattctatttagtactctattgatatcatatagggtacgtgggaagcttctggacctggtcacggggactgctgttctgttgaaatcgattgcacccttgaagaggccggtaacgtcgtccctgtgaattgttctattcttggcacttgctgtagctctcgcgagggttcttgttcccctgtagccgcgattatcgcatccgccggcgtcgatgtcgcctgttgtggtgattctagtaccttttattcggtcactcgtgtaatagcggtaccgggagcccctattttggtttgtggcatagaagaccctgttgatgacccggaatgtcttcccgttgttgttgaatgtacgagtgccactaaacattgcgaattgttcgtagtttgggggacttatcagcctcagagtggttgttattgtggcggagtcttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521362 - DNA, 464 bp, Homo sapiens
ttggcggggaccctcggcgcgtgtccctggcagcagaccgtggcgggactgattgtggcccagcatccaacccttctcacggccagagacaccaatttcccaacttttccggagagctgttgctgaatgggaggctccgaacttctcccccggccgccgtcaatcagcccattgagaggggctccagcagcaggcaaattgctttggacaaggaggtcaagttgcccccatgtcatccaagccaaagaaagtgggtgtcctgcctccgccaaaagcctgccaatgtcctcaatgatgcccagaccaaggctcctggccgtgagtggcccctttccactaactggggtcctgtgatcgatggccacttcctccgtgagcctccagccagagcactgaagaggtcttcacgggtagaggtcgctctggtcattgggaggtctcaggacgacgggctcctcaacaga

SEQ ID NO: 521363 - DNA, 650 bp, Homo sapiens
cggagtcttattgtggcggtggttgtctcagaatcagcggactttttgggtcgtaggaacctggtatgagaacatacgcaaaacgtataaaacatcgtaacacccacccgcaaaacgacctcgagcctccgacaagcactcttaacccagcacacttataccgagggatttattacggacaagcaggtacccccagcacgccaagacacgccgcacccttctcgaggaacctcccgcccacaaacgaaccatacccaccccccctcggtttaccaaacgccaacacataagcagtcgtagcggcccctcactcggcacatacccgcacctaccaacgccattcccctcggaaatttcctcagacaacgaaacccctattagaaagcgccgtagtgcccacagtagcttccggtacctcccttaccaccgtataggcgagccctcccccccagccagagcgacgctagcgatttcggtcggttacttaaatcggggttctactcagcgacggcactccggcggaactaataaagctaggagctcgaggccgacaggcctagaaacctaacccggccgcgcagtcagcgccgactagacccccgggatcgatatacccaacacaggacacacaaattgcaaagtcaggccac

SEQ ID NO: 521364 - DNA, 255 bp, Homo sapiens
cggagtcttattgtggcggtggttgtctcagaatcagcggactttttgggtcgtaggaacctggtatgagcgtgaatttgggtttgggggggatggtgtttgttaggagtgttttttatctttaggttagtttattttgctggattgggttttgtgtgtttaggttaggtattgggtctttttcgtcttttgggggttttcttttgtgaggtggtatcatgttgtctttggttttttgcgagtcggttatgtttt

SEQ ID NO: 521365 - DNA, 81 bp, Homo sapiens
tctgaggacacggccgtgtattactgtgcgagagaggggatagcagcatataaaaacccctttgactactggggccaggga

SEQ ID NO: 521366 - DNA, 193 bp, Homo sapiens
cggagtcttattgtggcggtggttgtctcagaatcagcggactttttgggtcgtaggaacctggtatgagttccacaagaaacacgggatcgcccataaacgagcgaccttagcaccctacccagaccccttcactctataaactagccaacgcgcggtcccccgaactcaaccgggcggctacactcagcta

SEQ ID NO: 521367 - DNA, 156 bp, Homo sapiens
tccctccataatgtgtgccaagagggcactactgtaattttaccagtcctctactgatggagtatttactattcagactttattgttagaaatggtgaacttcctggttgacaagattcttatgccataagctcaagtatatttccaggtataaga

SEQ ID NO: 521368 - DNA, 179 bp, Homo sapiens
ccccaacaaaattgtaaacgttgttaggtttttgggtaaaactcttgctgtattgtgacagctgtgattggtgagttgcccgtcctggctgccagttaccctgggattggaacaacatttttactttttggacaacaaggaaaagctttgtaaataaaattttaaccttttgaaaaaaa

SEQ ID NO: 521369 - DNA, 243 bp, Homo sapiens
cttttttgggggccccccccccaaaaaaaaaattgggccccttgggggggggggttccccccccccccccccccttgggggggggaaaaacccccttttttccccccccccccggttaaaaaaaagggttgggggggccttttccctttttggccccggccttttttaaacgggcccccccccggggtttcccccccccccccccccctttttttttaaaaaggggcccccggggggttttta

SEQ ID NO: 521370 - DNA, 307 bp, Homo sapiens
  misc_feature (118)..(118): n is a, c, g, or t
ttctcaaaatagggccgggcatggtggctcacgcctttgcaacccccaacatttggggggccgaggagggcagatcaacccgaagtcaggagttcgagaccagcctgggccaacgtgngtaaacctcgtctctactaaaaatacaaaaaattagccaggcgtggtggcacgcgcccgcagtcccagccattcaggaggctgaggcaggagaatcgcctgaacccaggaggcagagattgcagtgagctgagattgtaccactgcactccagcctgggtgacagaacaaaactccatcacaaaaaaaa

SEQ ID NO: 521371 - DNA, 1649 bp, Homo sapiens
  misc_feature (651)..(651): n is a, c, g, or t
  misc_feature (657)..(657): n is a, c, g, or t
  misc_feature (661)..(661): n is a, c, g, or t
  misc_feature (664)..(664): n is a, c, g, or t
  misc_feature (672)..(672): n is a, c, g, or t
  misc_feature (679)..(679): n is a, c, g, or t
  misc_feature (687)..(687): n is a, c, g, or t
  misc_feature (695)..(695): n is a, c, g, or t
  misc_feature (699)..(699): n is a, c, g, or t
  misc_feature (703)..(703): n is a, c, g, or t
  misc_feature (714)..(714): n is a, c, g, or t
  misc_feature (718)..(718): n is a, c, g, or t
  misc_feature (732)..(733): n is a, c, g, or t
  misc_feature (737)..(737): n is a, c, g, or t
  misc_feature (743)..(743): n is a, c, g, or t
  misc_feature (755)..(755): n is a, c, g, or t
  misc_feature (763)..(763): n is a, c, g, or t
  misc_feature (767)..(769): n is a, c, g, or t
  misc_feature (779)..(779): n is a, c, g, or t
  misc_feature (783)..(783): n is a, c, g, or t
  misc_feature (788)..(788): n is a, c, g, or t
  misc_feature (792)..(793): n is a, c, g, or t
  misc_feature (795)..(795): n is a, c, g, or t
  misc_feature (798)..(798): n is a, c, g, or t
  misc_feature (859)..(859): n is a, c, g, or t
  misc_feature (914)..(914): n is a, c, g, or t
  misc_feature (918)..(918): n is a, c, g, or t
  misc_feature (921)..(921): n is a, c, g, or t
  misc_feature (1581)..(1581): n is a, c, g, or t
  misc_feature (1584)..(1584): n is a, c, g, or t
  misc_feature (1608)..(1608): n is a, c, g, or t
  misc_feature (1620)..(1620): n is a, c, g, or t
cggagtcttattgtggcggtggttgtctcagaatcagcggactttttgggtcgtaggaacctggtatgaggacggggagaaaaaaaaacagcggccccttccgcccgtaaaaatccttccttcacctctacccccctccaacccctcccaacccagcttaagccttagcctccccaggttcctctcccgacccaccccttttcgtacgcgagaagtagcctagaaaaaggctcacactcttattcttcagcgagccagagcgcccctctagagtattctcgggcggtaaagggaagtacgccttcgttaaggcccgtcgcggacctagaagtattaggagtaagagattagaaggacgactcgtcttcccgcaatgccgccgagggtttctccgcccttaacgagtagtccacaggccatctatagcttatccctctatcggatatataaagcggtctcccactcattcccgtgggagacccctatctcttcgtaaacgactgcctctatatctacaccagtctacgccggaaccctttacttcgttacgcttccctttaccctcccccggtccccccgttcttattccccagtttatactacccaatcttatcatcgcgaaagtccgtccaaagaaaactttctccggtngggcgnggcngtntatgttcncaacttnagtatccngggaggtnaagngggnagactataagnctangagactgagattanntcgnttaatncggcgaaatttngctctcancaannncataaaaacnagtngggtncggnngngtncgttcgcaactttagtcatctaggaggtcgaggtaggagaactgtccgaatttgggaggtngaagccgtagcgagtcgagactgtgttatcgtatcttagttcgggcgatagagtnaganctngctctacaaacaaacataaagtttacctccttagagctccgcgttccaaacaaaatatattctctcgtcgcgggaagatcgcgtaacggtatagttgtagagtccggcccgggaggccgaagcgtctcggggagaacctgcagactacttctagaaaagttccgtttcggcgcctcattagaaaaatgctctttaactatttaggaaagtcgcttatagcagcttttttccacttatggcgctatcccttacgggcctagccactcgtggctaattatggctcgataacaccaaacggaaaacctcctaaatagccaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521372 - DNA, 120 bp, Homo sapiens
gtgggttcccgagccctcttccaatccgccgagggggcacctaccaacccgttctcgacccggcgaggccggggaaaggtggaagcacggagcccaccgtttttagtggcccccaaaaaa

SEQ ID NO: 521373 - DNA, 155 bp, Homo sapiens
tagctcatagaggatccctacacgtgcgaatatatattatttagaatgcacactaacagcatgacgataaactgtcatacacaaacctgtacaagaagcacgtaatactttaaaatgtgttgttattcaccaagtaatttaagttatagcattac

SEQ ID NO: 521374 - DNA, 83 bp, Homo sapiens
ccctccaaaggatttttttttgggccaattaaaaaaaaaaattttttggggtctttccccaaaaaaaacccgggaaagtttta

SEQ ID NO: 521375 - DNA, 754 bp, Homo sapiens
cttggaattccgtgatgggaaagcacgtgctaaagaatgtcaacgacatgtagaacacgctcttacatgacagatggtaagctgatattaaataagcgaatgggtcgccgtgatgcaacagctggtggtgctgagaagtcacatatgttaaaattcgagagcactccagtcaagcagtcgaggtggaggttgctgctgaagatttgactccatccttttctcagagtaatgaatttgcagatgctgtaacctctaagtgataaaaagaagagattgcttgaattgtactgtgtgtggctgcactagaatagattgttatcgtgtccacaaaggtcagagattgtaaatggtctgtactgacttgctaattaaatatcccttgtatacatgacagctaaattcatggttcagaactgtgttgaaacgcattagtggtgctgggtaataagaagtgaatgagtgtaatccgttgtgtgttttacctgattgcctagacggttttcccagtggttgggttagaatatatttggtctcgatgtttatattgggcatgtttagatgtcaggtttagtcttctgaagatgaagttcagccatttggtatcaaacagcacaagcaggtgtctgtcacttttccatgcttaaagtttagtgagatgtgatatgtaagatctgattggctagttcttccttgtagagttataaatggaacagattaacatatctgatcactagttgttcatactctggatata

SEQ ID NO: 521376 - DNA, 197 bp, Homo sapiens
actcctcgtaacagcgcctacgagcgaactttggagtctgggggtgggtaaagtctgagaggttggatccctggatccccaaaatgctggaagcaagccatgtttgttttcccagtggcctgggaagcaccatgcctgggttccctaggaggacagagccctggatattggaggggttaggaggcgctcgttacgga

SEQ ID NO: 521377 - DNA, 242 bp, Homo sapiens
tgtggagcctcctgtggccttagatgagtccctatttagaggtaggcaaatcaaggtgatcccacccctcttctccggctccctgcccctccagatggcctggtgatctatttggtttccttttggtgtttctttttctggttttggagtgtctttctctggcaggtttctggtagccgggaagatctccggttcggctccaacggaggctcacagtggctcaacggaggctcacagtggct

SEQ ID NO: 521378 - DNA, 308 bp, Homo sapiens
  misc_feature (138)..(138): n is a, c, g, or t
  misc_feature (141)..(141): n is a, c, g, or t
  misc_feature (143)..(144): n is a, c, g, or t
aggtggcgagcgccgccccccggccccggcccgccgcgccagctggtggaggagctgcagagccgctaccggcagatggaggaacgcattcacctgccccatctgcatcgacagccacatccgcctcgtgttccagtncgngnnccccacgcatgcgccccttgcggttctgccctcagcgcctggctcatctgcccccagtccattcgtgtccgacatacagatgtttgtgtgagtccgcaccgtcgtccgcgccccatctgcctttgagtggccccgtcctctgttctatataaagatagattctc

SEQ ID NO: 521379 - DNA, 595 bp, Homo sapiens
atttattgtttcatagttcttgtattagtcagggttctctagtggggcagaactaataggatagatgtatatgtgaaagggagttcattaaggagaattgactcacaagatcacaaggtgaagtcccacagtaggccatctgcaagctgaggagcaaagaagccagtccgagtcccaaaacttcaaagtagggaagatgactgtgcagtcttcagtctgtggccaaaggtccaagagcccctggcaaaccactggtgtaggtccaagagtctaaaagctgaagaacttggagtctgatgttcaagggcagaaagcattcagcatgggagaaagatgaagcctgggagactcagcaagtctgcctcttccacattcttctgcctgctttattctagccttgctggtagctgattagatggtgcccacccagatcaatggtgggtctgcctctcccattccactgactcaaatgttattctcctttggcatcaccctaacagacacacccaggaacaatactttgcatacttcagttcaatcaagttgacactcaatattaactgtcacggttctggaagctagaagtccaagatca

SEQ ID NO: 521380 - DNA, 133 bp, Homo sapiens
aaaaagggggggggggcccccccccccccctgtttttgtggggggggggaaccaaaatttttcccaaccggggggcccccttttgggtttctttttgggggtttttgaaaaaaaaaaaaaaccttttttggga

SEQ ID NO: 521381 - DNA, 324 bp, Homo sapiens
gttagtatatagtctaaattgtatgctacgtaaaagagactagggccgggcacagtggctcacgcctgtaatcccagccaaggaggccaaggtgcgcggattgcctgaggtcaggagttcgagaccagtctggccaacatgatgaatccctatctctactaaaaatacaaaatttagccgggcgtggtgattcacgcctgtattcccagctactcgggaggctgaggcatgagaatcgcttgagcccaggaggcgaaggttacagtgagctgagatcatgccattgtacttcagcctggataacagagtgagactcagtctcta

SEQ ID NO: 521382 - DNA, 863 bp, Homo sapiens
gcctctccgaacgcaaatgaaggtgtccttgcgcgcctcatcggggtccgcttcttcctgtgctgcggggaccttctgcggccgatgagaagaagaggggcccaaagtcaccgtcaggttgtattgacctacgaatgtgagatgaagatgtaggcggggtgatcttgtctctccggaaagattgtccaaaaacagtggataattttgtggccttagctacaggagagaaggatttgctacaaaaacagcaatttccatcgtgtaatcaaggacttcatgatccaggggggagattccaccagggagattgcacaggaggaagagcatctagggggagcgcttccccggatgagaatttcaaagttgaaggcaatagtggccttggttggttgagcagtgacaaaaggcagggaaaaagaccacaaaagtgtccaaggttcttcatcaaggacatgcaaggacaggcttgttagatggaagcattgtgttgttggcaaaggtctaagagggcatgaagttgttggcaagggtgaagagcacaaagaaaagacagggggaataaccccttgaggatgtgatcatccgcagattggggaaagatcgggtgggagaagccttttgcaatcgcaaggagtaggcacagggactcttctatgagtgaacggtttgtgcaggcttgtaatccgacaaagggttttgagtgatggccggtggtggattgtggagggaccacttcctaattcagaggcaggatactttgtaaatcttcccctggacaaaaaagaaaaaaaaattgggcgggaaataaaatttggggggcagaaaagtgatctcaatgggatgttcaaagggggggaagtttt

SEQ ID NO: 521383 - DNA, 374 bp, Homo sapiens
ggcccccaaataatactacgtatggccacataattacccccatactccttacactattcctcatcacccaactaaaaatattaaacacaagactaccacctacctccctcaccaaagcccataaaaataaaaaattataagcaaaccctgagaaccaaatatgaacgaagaatctgttcgacttcattcattagccccacacagatcctcaggcctaccgcgccgcagatacgtgatcattcatatttcccccttctattgtatccccacactccagaatatctcatcaaacaaccgagctaatcaccacccagacaatgactaagtcaaactaacctcaaacacaaatgataacctatacacaagcactaaag

SEQ ID NO: 521384 - DNA, 922 bp, Homo sapiens
tgttgccccccgcggtgtccgcgggttatcctcacacttttttctcacccccccgcgggggaacacgctctcttttgtgtcccccctcttttgtggccctcatctttttatagtggggaccccacactctcatatgttgggacaaaccacactgctgtgtttgactcaccacacacatataccacctcgcgtcgtggggttgatccacccctgctgctcctgcagcaatttttctcccgcgcgagatgttttttttctctggagaccacaccacgcgcgctctctcgcggcgcgtgtatataagtgcccccctctcttctttgtgtgtccacagcccctctctctcacagctgttctctctttctctcttctcgcgcggtggagcgacccatctctctcttttggtttttctggtgagtttctctgtggcccacacacacaccgcggtctcactctctttgtgccgccacacaccgcgcgtgtgtctctctctctttgtcctcgcgaatactctctctctcgcgagaggcgctcttctctctctcgaggggcccccccctctctctctgtgtgtggagatttttgtggggcgcacacacaggggcgacacacacttcgcctcttctttctcttttggcccgcggtgttctctccctctcctctgtctcttggagagaggtggtctccctctctctctcttcgcccacacagcctctttggggtgttttttttccctctttttttttttttgctttttatataataatttgaagcccccggccccccccccacacccccccaccccccccctcgcgggtataatatatatatattttttttttaaaacgggttttttttttttttctccttttttttttccctaatctcccttatatataaaaattgggggcccccctcccca

SEQ ID NO: 521385 - DNA, 906 bp, Homo sapiens
gcgctcaccacccacagcgtgaatcctgaggtgccgcatgggcggttctgctgcttcgctgcaggataaggtggagctaccgaacagctgattcatatgccaagaattggagtcttctttcaaaccagtgggggttggacaatgaatgtagttaactggttcctgctcacactccagaattaaacttctatgtgaacaaggaaaatcagcaatttcagcaaaaaataattacaaacaataagaaaatgtaatttatgatagtaataaaatagagcataacgaaagtgtgaaacttttctgaagcctggtcagtggttaacaagtatttaacatctagtgttaatgacagatgtcctgttttataacctaccaaaaaaaaaaaacagcataagggcataaaaaaaaaacataccgtggtacgggtatagtacccatcctttatgtgacaaggccaaaagccaaatccggggtgccttattcagaagttgaggagttacttaagagaaaattcttacataagccagttaaattaagagactggatttaaattacattttacatttgaaaggatgattgattaggaccgctgaattatatggggtgggacatctgacataaaggattagcaggcattatgaagggagtaattcagcaaaaatgtctaggtggcttgaaagggcagcttgaacgtttttaaaaggtattacggggttccggaaaatttatgatgagagaagtagggggaaggggcagggtaaaatagtgacggtacaacaaggagctgtttgccgtgggtaagtatcaataggccacattacaggtataactacactatcactgtttctaaatggtaaacatggtggtaagagggaatggtaaacggagaaacgatggctattttcgtta

SEQ ID NO: 521386 - DNA, 168 bp, Homo sapiens
cagtgcttgtaaaaggtttaaagaactggaagtaaaatttttaaagaaacctaatgatggtaaaataaaaggcctggaatttattcaagatcctaatggctactggattaaaattttaattcctaacaaattggcaaccttaatgtagtgctgtaagatttctccttt

SEQ ID NO: 521387 - DNA, 415 bp, Homo sapiens
ggcagtgcacggttgccttgctgcatggtctgactctatgaggatacctctgtacaccactcgaggacacgcccctttgtttggtatcattatctcagtttttgagcagggaaacgtctacttccctagaggacccacagtcagtactcgtgcagagctggaaatcaaagcccggtccatccaaagcgttcagccatatgtctcttctctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtga

SEQ ID NO: 521388 - DNA, 157 bp, Homo sapiens
tatatgctgtctgtggaggcgtctgttgtttaagaagaccaccaaggagaagaggcgcaactggaagagatacgctttgccaggagtctttgcttcatttggcgctgattatgaataaaggaaagaggatagagaaaaggcagccactgataattta

SEQ ID NO: 521389 - DNA, 785 bp, Homo sapiens
agcggaatgaagagcgttttggagacgggggctgggtgaggctcacgtttggagggcttcgctgtctgcttcggagagcgtaaggatatcgatgatcatgagatccctgctcagtaatccccttcctgtgtggcctgctcgtgggtcgtttcgtgccccaggctgccagggatgagtgagcctgactaggccagactttctcgcaagccccggcagtgatggagcctagacagtacaggaagcactagttgcaacgaccataggcagcatatcagtggaggcagtctatcacaggttgtctatcgagacataaccgagacggctggagcgatgtcagcgcacgaacgaagttggcatgcctcgcacttaccttcagaatcctgcagtgagttactgcatgtgcaggactaagttgtgcctctgatggctttacgcaactcgtccacgagcacatctacgtcatgttccactcaacgcgagcgatacgggaggtgaaacagggcgccacctgaatgaggtgaacgagtgcaactgatttaagcataactagaatggtgtctgtgagacgagtgatgacaagaacaatagatggatacattgactatgctgagttgtgcctacatcacctgcagtcagcatcgttcattgggcctatctacctgagttatatacgaaatgtgacccgtgcataatgtgattcgaacacgttatagtaatgcaaaataactcatttccaagctactgctgcagcattgggtcaaaaacctgtaagcgagttcgccagc

SEQ ID NO: 521390 - DNA, 202 bp, Homo sapiens
atgtccccatttcagattatcgccgctccgagccctagcacgctgacatactgcacacacatgtacataaccagctgtgcctccctacatatgactcctctgaagaggtgcacaggatgctgcaagctggccctcagcgacgggtcgcgacgggctctggcctgctctgcccatcctcctgtccctctccaggtactcctct

SEQ ID NO: 521391 - DNA, 153 bp, Homo sapiens
tggcactgtatgtacgtgtacagtgtgtggggagtaggtgtgtgggtgtgggtgtggggagtatgtatggggtgtgtgatgtgtgtggtgctgtatgtgtgtggtgtatgtgtagtagattcatgtgtgtggtgtgggggtgtgtgcacgtgt

SEQ ID NO: 521392 - DNA, 366 bp, Homo sapiens
tagacgcgtggttacagacgtctagcggatcccgccatcatctttgcatcccccccttttgcttgccacctctccttcctgcatcatgtgaagaaggatgtgttctgcttccccttctgccaggattgtacgtttcctgaggcctccccagacatgtggaagtgtcagtcacttaaccttcttcccttgataaattacccactctcgggcagtccttaatagacagcatgagaacggactactacatatacttcatgttcatagcatatattcatagtagccaaaaggtggaacacaaccccatgtgtccggcactggctgcgtggactaaaaaggaaatgctgacacatgctgcaacacagatgc

SEQ ID NO: 521393 - DNA, 1407 bp, Homo sapiens
  misc_feature (617)..(617): n is a, c, g, or t
  misc_feature (672)..(672): n is a, c, g, or t
  misc_feature (676)..(676): n is a, c, g, or t
  misc_feature (679)..(679): n is a, c, g, or t
  misc_feature (1339)..(1339): n is a, c, g, or t
  misc_feature (1342)..(1342): n is a, c, g, or t
  misc_feature (1366)..(1366): n is a, c, g, or t
  misc_feature (1378)..(1378): n is a, c, g, or t
cggagtcttattgtggcggtggttgtctcagaatcagcggactttttgggtcgtaggaacctggtatgagaccaaaacttccctaataaagaaacattttcgatcggacggccccattagctagcctcattagatacccaatgaaaaccaacgttaacttcccgtaaatctccctaaaaatccgaagaggaggaaacatccctcaatctacctcacgaggttagtaccgttccgacgtcagggctagataaagatatcataagaaaataatcgattaacaccgtccacgaataccggccaaaaaacctccaggaaaatagcgttaaatcggccgggtatagcggtctacgtcggcaactttagtatcccgggagaccaaggtaggcggactatccgagtctaagcctaagattagtcgggtgcggcggtttacgttcgcaattttagtatcccgggaggttaaggtgggcggactacgaggctaggagactgagattatagcgaaattttgctctcatcaaaaaacataaaaaaaccagttaggtgtagcggtgggtattcgcaactttagtcatctaggaggtcgaggtaggagaactgtccgaatttgggaggtngaagccgtagcgagtcgagactgtgttatcgtatcttagttcgggcgatagagtnaganctngctctacaaacaaacataaagtttacctccttagagctccgcgttccaaacaaaatatattctctcgtcgcgggaagatcgcgtaacggtatagttgtagagtccggcccgggaggccgaagcgtctcggggagaacctgcagactacttctagaaaagttccgtttcggcgcctcattagaaaaatgctctttaactatttaggaaagtcgcttatagcagcttttttccacttatggcgctatcccttacgggcctagccactcgtggctaattatggctcgataacaccaaacggaaaacctcctaaatagccaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 521394 - DNA, 501 bp, Homo sapiens
  misc_feature (401)..(401): n is a, c, g, or t
gcattcacggtgatctagaggatcccgagctctctctgtggggtaaaagggttaggtttaatgagatggtaaggggtgcatgatcggtcaccaaggagggagtaggggtatcttatacttgtgggttaaggtggggggatacaagaggaggatgcaaaggaggctttggattgggaagaagggcggcaatgagatgcagctgtagtccaggaatagtcagggaagcagataattttgttaaaatatctctgcctaataagggaactgggcagagggggataactaaaaaagagtgcataaaagaatattgtctaagttggcaccagagctggggagttagaagaggtttagaagcctggctgtcaatacctacaacagttatggaggcaagggaaacaggnctttgaaaagaaagtaatgtggagtgggtagcctccgtattgattaagaaggggacggacttgacctccatggagagagggggaccccttcgcggtactc

SEQ ID NO: 521395 - DNA, 175 bp, Homo sapiens
  misc_feature (126)..(126): n is a, c, g, or t
atctagaacccgatatgcgtctcatctaacatcatcgggctgggagcagtcacacaggtgctcatctgggatgatctttagtcatttcaccttaagagagagaaacaggatgtcagatgttcctgngaatctgtaaagatatggttttattccacgaatcccctttgaaggatcc

SEQ ID NO: 521396 - DNA, 108 bp, Homo sapiens
ccgcaggctggggcttggcccgcatctggggtttggcataataacattacactgaatacatttgatgacaatcatagcagcttgcacttcactgagtatttactgtgt

SEQ ID NO: 521397 - DNA, 951 bp, Homo sapiens
cgcggtggctcacgcctgtaatcccagcactttgggaggccgagacgggtggatcacgaggtcgggagattgagactatcctggctaacatggtgaaaccccatctccactaaaaatacaaaaaaaaaaaattagccgggtgtggtggtgggtgcctgtagtcccagctactcgggaggctgaggccggagaatggcgtgaacctgggaggcagagcttgcaatgagtcaagatcatgccactgcactccagcctcggcgaggagcgagactccgtctcaaagtaattacattacttacttaattaactcaaattgaatttactttacaaaggattatacctcccatgaccaagtgggacttattcctggatctgcaagggataatgtgagtatataaaaagtccaatccagtgtcactacactgcatacacaacattggacgggaggaaaaccaacatgagacatctcctgttgatgccaaggaacgtttatttcggacaacaattcaacacccctctttgtgaattaagaccaaagattcaaacaaacttagggaatacacaaggcatcacaacgtcatgggacgccggttctgtaaaggaaacgtaataagggcatatattaaagcccaaagctaagattcatgctttatggggaagaacaaagggttttcctctaaaggcggaccagggggatgtccactttatcactatctttcaacgtggcagggaagttgcggccgagccttggcaagaaagcaggttccttggagagaacaccggtggattatcgcacgttgaacatcccacagagtgaacttagtaatcacgaggcatactaaaagggcggcgagcacgtcacagatgaggagggagaggaaaacacgaaacgctcaataagaagggcgcagatacgcggagagtcaacatgcaagaaacgcctgccgaaca

SEQ ID NO: 521398 - DNA, 228 bp, Homo sapiens
  misc_feature (182)..(182): n is a, c, g, or t
ccaagatggtcagatgaccatgccctcctggaggagcagagcaagcagcagtccaacgagcacctgcgccgccatgttcgccagccaggccaacgttgtggggccctggatccagaccaagatggaggagatctgggcgcatctcctattgagtctgaacagggaccctggcaggaccagcntgagccaccttgaagcagtatgcaacgcagcatctgtggtactaca

SEQ ID NO: 521399 - DNA, 286 bp, Homo sapiens
acccggttgaggtgggggaggggttttttggttttccaaaaaccccaaaaaccttggggtttttaattgggaaaaattccttatgtgttaaaaatccttaaacaaactggcacgttcccgtccccaaaaattgggtgtttgggccccccccccgggttttaaaaaatttttccaaccataaaccccttggggtttggaaaaactttttttttttcttttttttttccattttctttaaagccccaaccaactttttaaaaaaaaagggtttttttaaaccccgtta

SEQ ID NO: 521400 - DNA, 137 bp, Homo sapiens
aggaagtgtaaggggcatggctgtggtggtctagattactgttgcacacaacgccgtggcagacagccatggacttggaccaagatgtcctgagtgccctgagctgaacgtggcacagctctccaagtatggtctct

SEQ ID NO: 521401 - DNA, 306 bp, Homo sapiens
gacccccccctgtttgcaggccacccccccctccctgcagctttgaggctggcggggtttgctcctgggaatggggtgggaggcacagggacgacccggggcgggctaatgtttttttgggggcagaccaaagagctcaagtttcagagtcagaattaggcccttggagcgtttttgctggcttgcccttttttatttttttattttagagcgcttaaaaaatccggaaaaatggggtttaaaaaaactgtttctttcagtttacatttttgtttaatacgcttgagcaataaacgctgacttgca

SEQ ID NO: 521402 - DNA, 276 bp, Homo sapiens
cgaaggcacctcgaccctgttcatgcgcggtgcgctgaccaagggctcgaacaagaccgacgtgccgcgcgacaaggttgcatacgacgaagccgacaacaacccgcaggcctacaagacctacggcggctcggtgaaggcacgaaacgacttcggcgcgatcgacttcacctcgatcaccgcctacgaaaccacctccggctacagccgtggcgacaccgacggcggcgccgcggtgaacttcccggtcaacggcgtgccgaacggctacggcca

SEQ ID NO: 521403 - DNA, 1099 bp, Homo sapiens
gagcggaaggggaggggcgccagggcgactgacggaggggaacccccgtcctctccaagccggcctctgccagcggtggcggcggggctgctccgatgtaatcccacccaattcccagcttcgccgggagagagctgcagccgggagatgcgcgcagagcccgagcgaaggacctgagaaaggggaggggaaacgcagtcgcctagaaacacgccctttctgcctctctttcttcctcgtctcgctctttcatccgtcatctcaggctcctgttccttccgcgctttctccgtcctccatcctcttttctccttccatctcgctcgctcctttccgggaatctttccttcctttcccccccttcacgtaccttcccatctcattcactatgctaaccattccattcaatccgaggaccatcccgtcacgttataggcagatggcccccttttaatccatccggtaacaaaaaatggcgaggcactcacagagctcgcacgagatgggcccggactctcaccccaccatttgtgtgtggcacagaccttcccggtgtagacagctctgcttcctgccggacccacagacgacggtaccccaccgccaagcaggcctatggtcaccgtgttgaggctcccccgccaaacttcacgcccctagcacaccgagtgaaccaactttttgctcccaaagagactcacccgcaaggcgacgccacaattcgacgagtcgtaacaacagcatcgtcgatgccctcccccttgcggtcgacctttgctgtcccgcagctagttgggtcctatgggaaccacccggtggtgtgtcttttataaccccccacaccggatcgggctcaacaggacccaaacactgggcggagctacatcgcggactagtccaccatgatgacggctatcgtgcatctctgtagatcacacaccgccgctgtagttggactccgccgttcctgactatgactatcggcacaatcgtcgtggatcgacaacttttctcgaaaacgttgtgctcgtccctacagccacgaccccacatgctaccctcggtcctcgccaccacagagacggacgctattcccgca

SEQ ID NO: 521404 - DNA, 189 bp, Homo sapiens
accagcgcgagggaggtttcggtgtacaggtagaactgctgaggccatcaaggcgcactcgcagtactgtcttagacatggagtacaccaccttgaaagtggtctgcgagcaccactgagcgcgtcgatgccgcacgatgcggacatggcgtagatctggacgaaggtggttcccgaccatgcggccat

SEQ ID NO: 521405 - DNA, 84 bp, Homo sapiens
cgaattcaagcttctaacgatgtacggggacatgattgtttatgtaaagtatctttaataaagctggatccagtttggcttgca

SEQ ID NO: 521406 - DNA, 542 bp, Homo sapiens
tagatggactgagggacacggtgtgggtaggctacagaatatatgaataggtaacgaaacccgccccctcgcactgtatcctctctgaaataactatggagacacagcaggagtctagtgcagtatcagatgggagcagaagttactgaaacatattctgtgctagccagggagttgtgggagtggtgcactcacgcgagggcgtgggagaaatcagcaccatctcactcggaaagctatcgtggcggttcgtagcacgggtcatagatctgtatctattcctggtgtccggagagacgtgctgaggaacgaatccgaggggtggacaacagcttctaggcatgaagaggtagcatcataagttaagaaactagagccaccgtaaatatgcgatgggaaactgtttcatcagctcagccatgttcactttaatgagatagcatgtcatttgaagagaatagattacatgactttccagtgagatggagcaatgcacagccccaagatttgagcttaaagaggcggaatcgggtcgtgtcctc

SEQ ID NO: 521407 - DNA, 102 bp, Homo sapiens
ggcgttacctgtaggaagatgctgcttatatgacatcacgtgtactgagggaagattgggaatggaggcaggagttggctgtcactgtggcatcgataaaca

SEQ ID NO: 521408 - DNA, 385 bp, Homo sapiens
  misc_feature (9)..(10): n is a, c, g, or t
  misc_feature (12)..(12): n is a, c, g, or t
  misc_feature (24)..(24): n is a, c, g, or t
  misc_feature (335)..(336): n is a, c, g, or t
taaaaacgnngnaaattcctttantgttatcccccccaccaccaggaccatgtagggggcagtttttactccctaacccgtttcccgaaaaaggggctacctcctttccaaacagatgaaaaagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccanntgggccacggccatgcgtggggtggcccaataaacaccgtggactccca

SEQ ID NO: 521409 - DNA, 297 bp, Homo sapiens
  misc_feature (204)..(204): n is a, c, g, or t
  misc_feature (212)..(212): n is a, c, g, or t
  misc_feature (232)..(232): n is a, c, g, or t
  misc_feature (245)..(245): n is a, c, g, or t
ttcttggcgttttgcacaaagaattggacaaaacgtctagcagagcaaagaaagaatgaaggaacaaagaaggaaagcagggatttattgaaaacaaaagtacactccacagtgtgggaatggactcgagccacaagcagcagctcaggggcccaaatacagaatcttcttgggttcaaataccccctagaagtttcccattgnccactttngtgctcacctcatgtaactnaagcagtagcctncaaatcagaggctaggggtgaagttacaaagttgcccaagggagactggacc

SEQ ID NO: 521410 - DNA, 463 bp, Homo sapiens
ctaagggaaagctggttacgccttcaggataccggatccggcaattcccgtgtgttcgacccacgacgtccgcttgatctatcatctacttgggtatttggtgtaaggtggtcaccaagtgggaagacattggcctatgcagggcacaactccatggtttatttcatcgatgaagtcgaatcgtctcctgcagcacaaaatttggcgctgcgtgatctgcctctccgtgatgtgggttctttttgtctctgagcgcacattgattggtgtcggatttgactgcaatcctatgatctttgctgctgatgatactgggctttggagtttcataagattcttggatgagaggaaagctgccccatcagcttcaaaagcctcacagctctctgaagcccttggaaagctatatggccaatcaaagcaagggactagtagcgacaccgttgagccgtcaaaacctcgt

SEQ ID NO: 521411 - DNA, 299 bp, Homo sapiens
tgaatatgctgtctcatacacgtacaataggatttgttataacgctatcatttgacatgtgactgattaggaaatattttatggtctccacccctcagaagcaccaaagaaggccttggtttttgagaagggggggattctcaagaaatgagaacatgtaggagtttgaattgattggtttaacaaattatcaggtattcatatttttccaggaaagttgaggagaatagtttcataaaatgagaaatgggccggggtgccagtggctaaaggcctgtaatcccagcactttgggaggc

SEQ ID NO: 521412 - DNA, 115 bp, Homo sapiens
acaattttccgtggtttgtaaacacttctactatgctttcacatgcttctgtatgtatgctgtatttcaccagtgtcccatttttattaaaataatcaagaaatcccggccacaa

SEQ ID NO: 521413 - DNA, 604 bp, Homo sapiens
aatgtaggtttataaaatgttcagaatgcttgtacccaaaacaagtgcttaaaagaaaaaaaataaaaaatgctggtgctaacaactcttacaatttcagatttattttttaatagacatctaagactgcaagagtctgtatattcatgtagctctcgggtttaaggaggacctccatctccttcgcttacaaaaggctttctgcccctttgaaggacaaagatctcggagttggtttgggaaattatcccagcctgaaagacattcttctacaaaccgctccagcacagagtatgatctgtgggacatccagattaatggtcgggaatttcattggtaaattctctcataacctctttccagttgggtctacagtaagggtagaagatttccacaggggactttaataattccaaaatcatcttaattgtactttctccagttgactctaaaaccattataatagcttcatatacaagctcatggtgaaaatgaggtacttccagtcccttagggcaaggtccagcttcagatatgtctccagagagtaaatattctttcagcagcatatcaatctctttaacagggtgattgacagattgtt

SEQ ID NO: 521414 - DNA, 216 bp, Homo sapiens
tgcaccgaaatctatagtatatgtgcttaaagaataatttatacttatacaccataaatcccttgtacattttatattaagtgattccctaggcactttgttattcattgctaccgagcacgtaatttttttcagccaagtgcggtggctcacctgtaatcccagcaatttttctaattggatatttctctcatataggaaagcgactgatctatg

SEQ ID NO: 521415 - DNA, 204 bp, Homo sapiens
ctcggagtgggtaggatgagtggcacgaacaacagagaggaagtcagcttaacctatgcctttttgggttgaggtgactgatggacggcggacgattcggcgctgggaaactcgttttaggtaatagcttttctagtcaggtaaggtctaggatacagctagggagaggggatcctcctagcagtcgaccctgccaggcactgc

SEQ ID NO: 521416 - DNA, 486 bp, Homo sapiens
taaaacaacttctggtaaatctctcccagtgtgatcaccagctctttctttttgctctctttaccaaagacattgagcattctttttcccgagggagctgaggaagaaggcgtgaaccttggccagccgtgcccgcttgatcaggtcattgagcttcctgagggcggcgtttcggggcagtgactggatgtccttgaagaggtcctgctcctcggcctcaaagagcttgcggatgtcggggatgaggagcgggtgggaccagaaggagccgatgtagaccctgaccacctcgggggtgttgatgatcttgcccagggaccacatgagggccccgtacacccgcatcagctgctgcgtctcgatctgagctgtcttgttcagcaccacgcggatcttgtcctcatggttcttcagagccttgatcacttccgagaactcatcggagatgtccagcttgtgggcgtcgaagtgcagtgatcaagaccg

SEQ ID NO: 521417 - DNA, 340 bp, Homo sapiens
ctctatggactggcgcattagtggccccctggactcctttcctgagtgcagtcactggtgcgagctgggagtggaaggtcggagagactgttgctaggggccagatgctcatggcccacttcccgacggcagctcaggggcctttccggtgcctgcctgggaaacagggggcaatggctcgctagaactcagtctctgagtgggcgctgagtgtgggggacctgttgtccttgtcgccgggtgctttccttgccctggacttgaactgctggtgtgcagggcattgaagggaccagacaaattctgacgaagcacttgatggggcatctcggggagaccg

SEQ ID NO: 521418 - DNA, 316 bp, Homo sapiens
  misc_feature (44)..(44): n is a, c, g, or t
  misc_feature (74)..(74): n is a, c, g, or t
  misc_feature (100)..(100): n is a, c, g, or t
  misc_feature (117)..(117): n is a, c, g, or t
  misc_feature (150)..(150): n is a, c, g, or t
  misc_feature (307)..(307): n is a, c, g, or t
  misc_feature (313)..(313): n is a, c, g, or t
gaggcagagcttgcagcgagcccgagatcgcgccactacacttnagcctgggcaacacagcgagactccgtctnaaaagaagtgtataaacattcctttngctacacaatctcgcanacatctgctatgttttaacttttcagtaacagntaaaaattctgactggtgtgagatggtatttcattgtggtttttctgcatttctctgattaggcatattgagcattttttttcatatgctaggtggccatctgtatggcttcttttgatgactattcatgtcttttgcacttttttgggggggttgntttttngtg

SEQ ID NO: 521419 - DNA, 878 bp, Homo sapiens
tcatgatgctccggctgctcagttccctcctccttgtggtcggtggcctcaggctatggcccaccttcctctcactcttccagccgcgtgtccatggtgaggatgcgggtcccctatagctgggccctggcaggtttaccctgtcaggtcatgagaaacagtggaaaggcgttcttacacacaagcgtgtgtgccgtgatagtcactcaatcgcgcacaccgcattgggattgtgactggccgggcacgtgcgatctcgcagggctctgacgctatcaggtggtgttagggtgaagtacaacctctggctgtgaagtgaggggcctcgcaatcaagtgaatcgcccatccaacatctggaggagctgtgtgtgcatccattctgtgaaccgttcgtgtgtggacctggggtcataggatcgtcgcgctcatcaggctctcgacgctgcgtccagactgggagatgccggatccatgcatccgatctgcagtccctccacgctggtgactatccgttcgccatacaatgacatcctggtacagtcaccggttgcggcccggcgtcgtatagccaatgggccacatgctcaggataagagcagcaggaggccgaggtggcgggtgaactatagagcacctgcgcaggtgtactggtggggtcccaccgtgcagagaaccaggtgtgtgctgaagggtacctacggtcggcagggaaggtgactctggaggggccctcacgcccgagacgtaggggcgaatggccaggggtaaccaccttgtgtgggctgggggactcacgggacgcagagggcgcgaggccgcctcccccgagggggcacacagccgaacaagctgggcggcccaccaaaaagtggacaa

SEQ ID NO: 521420 - DNA, 561 bp, Homo sapiens
gtgcggtggctcttcctcttagcaaatccatatcttttagtaaaagttgcctttgagcataaatttcttgtgtttcaatctctatggtgcttgtagaattctttcaagtggtactcgttttcccggacagaacgcagagcttcagcattttgctatgacacagctttttcaaacatcattctgggaacataggttaacatccttttcatacgtatttttttggcctcccattttaattttaggctatctcgggtatctttcaaaaaacttcaactttggcacacatttctgcccagaagtggctcttctatttctctcttatactcatttagctttatttctaaagattcgaacttgatacgctgagggtaagcatctgcaaagtgatcatcaataagctgaagcttctcagccagagaatctctgttaaatgtcgaacttgtctgagtttccatattacaagtctctttagctggatgatattctgccaattcttttaaaaaatgcataagaaaacctttgtgatttctttatcagatcgtgaaaccagtgatttgtaga

SEQ ID NO: 521421 - DNA, 911 bp, Homo sapiens
  misc_feature (218)..(218): n is a, c, g, or t
  misc_feature (703)..(703): n is a, c, g, or t
  misc_feature (743)..(744): n is a, c, g, or t
gtctctctccctccctctctcatgaggcacagccaatgccaatccgcgcatgtagagcccagtgggccacgccatagaagcatgaggagggttacattgtatcagtctcccgtctgctctggtgtcagaaaccgagtagcggacactgcttgatattgcaccgcactgacatttacgtatgcgctgtagcggagtgctgccggcacatggagatcagntgcatctcaagactggcagatgcagtggctgggtcagaagtagggaggcacacatgagtgtctcacagggaagatacacagagggcgagagacaacaacgtgtctcacgctcgaaaggaggccctggttccctggagtccgggatgagaactgcaaagacttcggcttgaccacctggcgatgttggattgataccacaagaaccgtgagcgtggaacgacagtggtcctggttgcaggccattaactaaaccagagagttctacatacagagctagggacaaaagcaaatagatatagcaagctctgggaaagaaagagcgaaaaataggaagtttgcagaagccttggaccacgtcctgtcccgtgtagcgtcagatcactcaaaggcacgaatgtctggctttgcgtctattaagattggaaatgtacactaggcaaacactcagtccactgttgagccccagtgctggaagggaggaaggnctttcttctgtgttaattgcgtagaggctacaggggttannctggactaaaggcatccttgtcttttgagctattcacctccagtaggaaagggtcttagggaaggtcactcttagtgttagttctctttgaactctcgtcacctctaccctcttgggaatgtctctctctgtgtatatctaattcccacagggtatcatgatcgtcc

SEQ ID NO: 521422 - DNA, 319 bp, Homo sapiens
  misc_feature (11)..(11): n is a, c, g, or t
  misc_feature (35)..(35): n is a, c, g, or t
  misc_feature (254)..(254): n is a, c, g, or t
aagaaacaaanctctgtgaggtttgcttgtgaggngggtggacatgactttcgggcaagaaatattcccctagcactggcaattatatggttattttctcagggccactatcagtttaatgagtctctttctgtaaaagtttcatagcccagaggttttctcccttgttcccaagtttgctgtaacaacccatgtctctcagataaccattctagatctagcagcaacttgactatttcctgccctcctaggancacacctgagacttcaatctgtctttgtcaagtgaaccaacattcagaaggcttaaagagctcat

SEQ ID NO: 521423 - DNA, 911 bp, Homo sapiens
  misc_feature (40)..(40): n is a, c, g, or t
  misc_feature (559)..(559): n is a, c, g, or t
  misc_feature (590)..(590): n is a, c, g, or t
  misc_feature (607)..(607): n is a, c, g, or t
  misc_feature (641)..(641): n is a, c, g, or t
aggtaaataaacgaagctgcggaggagcgggtcccgtggnatgtgactcggggttctgttgtggctgcgtaggtgattttggaggttgtcaggtcttggcggcgttgcgaaatgggggccccaagttacccttcttgttcagtgtctataagaagctggacgtggtgcaagtagcgcgaaacttagaataaatggaacgagcggtaccagtgcgagacggagaggagtcctaatgatcttctttagtgccgactgtactcaggttgtcaattgccaaaaaaaatgccatttccagtgagtaaaagcacagggtttttcaaattcctgcatcacagtcaacttcacagcgaccaaagttacacaaagagtgatgaacagaaaagaccaaacctcagggtggagagggcaaaggcgctcagtcaactccgatccagcactccttcctcactgatgtctcagatgttcaggacgatggagagagggctgctcagtcttttgaatgatttccactctggaaaacttcaagcatttggaaatgaatgttccattgaacagatgnaacatgttcggggaatgcaggagaaattagntcgcttgaatttggagntctatggggagttagaggaacttcctgaggatangagaaaaacagccagtgactccaatctggataggcgtctgtcaaatttagaagaacttgaattattccatacaaaaactccatattaggcagatgacacaagatggtcacaagtactgcgtgctagagtaaaatgaaatgtagtcttgctttcttgtgatttgaagagaagcagcagtctttacttttccagccaaatccagatagcagaatcatcttacacaagcagaaatcaagtaagtacaggcagcttcatgacgaatcgggccga

SEQ ID NO: 521424 - DNA, 100 bp, Homo sapiens
  misc_feature (16)..(16): n is a, c, g, or t
tactgggcgtattctngtgtgcattctgcgagcatgcagtgaggcatctgggcgaccagacaattataccctagccaaccccttaaacaccccccgaatg

SEQ ID NO: 521425 - DNA, 986 bp, Homo sapiens
gtcagagccatctatgttcggttgtaagactttgggatattcagtgacttcacgattgaatatagccaggcacccaagaagtctgatggccacctgaggtgcacggtgacgaaggacctgacagagcgccgatgcagggcttctaggattcggacacacaaggagttgataacttcctcaatgaactccttgcctgatctaaactcatatcatgggtactagacgtgtttgagtaatcatcttcaaggttaaacctcttggacagttacccttttcacaaagtgcacaggtgggaatcgagaatcgatagggttaatatcggagcagtggcttataccattcacctcgtgtgttatggtgattatttcagcagataatgagaccttaataacaaataggcgtaagaaaattttcggacattgaagatgatagacaacatttgatgtaataaaagttggtaggcttgatactctgtaacggactgtgagacctaggcaatcttatttggacgacgacaggaatcggtctccagctgcctttgatcaagattcggggtgccacgtggagcatgagcatatacctggagggactgtgttgtcaccccaaagaggattttctcttcaacacctgtattgtgcctaggtttccaaattctttggccgcaaagctgatctggtctccttgaactcggattcccggagaagagaccggcggacctaggccaggtgggcgtcaagcgatctccggttccagcaaggagggtcacatcataagggccccccttcaaccccgggggccacactggtcagggctccaaacgaaaggaattgctaaaccgttgcagttgggccaacttccatgggacatgccataacgtacttggcgggaccgacagaactcacggcacgagaccgtaacgggtaccgagagcaccaaagaactgtgggcgcgacacaccagactcaggcacaaacacacacggggca

SEQ ID NO: 521426 - DNA, 317 bp, Homo sapiens
aattaaactccatgcgggtccataacagccaagaagcctgcaggagaaagccaagggcagttccctccgcagaacaccccatgcgtgctgagaggcgagctccttgaaggaggggctgttcttcaggagggcctaattttgaacctgcctaaggaccccacctggaggacacacagacatgccttactactgggcccatccttggtctatgtgctctgtactggaggctctgtctgcctctatcagcaaggacaggggcacacatggcttaaggtgacaagccagagagagacaaccctgacagcatcacggtgcat

SEQ ID NO: 521427 - DNA, 167 bp, Homo sapiens
tactctgatagttgctcattgtacaatcctgcctattagtaatactacgccaagaatctgctagctttcccactcgtgttgaattacatgtttccatgtgtgtgatttgggtccacaacaaaaaatcgatacacaatgtcatgctttttccttttcctttttttttt

SEQ ID NO: 521428 - DNA, 317 bp, Homo sapiens
cctgaacaaagatttgcgcacgttgtgtaaagtctgaagttcttttgccactgtctcttccaaacccttcaagtcttgtcttgcttgtcctcgtctatcttgcataaccgtaagttcatgtagtttacttgctcttttccttgtctgtggctttcaacttctcatgttctcactcttcagacgtacctgctctcaacatcattatcttggtatttggtcttgcacagcatccagtcaataagtttctcctatgcgctcctggatctgcttgtcccaacagcattgcttacactctcatttgcaacgtctgaaccatt

SEQ ID NO: 521429 - DNA, 1179 bp, Homo sapiens
tgcgtggtgtgtggtggtggtgctggcctgtctgtcgttgtgtgccgttcgctgctgggtgtctccgtctcgtgtcgtggcgtgtgtcgcgcctcgatggggtctttacttcgtggcggttgtctgttgtgggggtctctcgcgcggttgtggttgggcccgcgccgtgggttgtggggggcccctgttccctgttgttttgggtacgggcggtctttttggcacgttggtgcccccctgtggggaagttggtcagggttgtccctcttgaggacagcgcgtgtcccgaggggttccagatggcccggcttatccccggtccccattttgtggggccttgtttgactccatggccggttcttgcgacgtgtacgctgctgtttccttaactagggttgctggagtttcaggccaggaccccctttggccctttggtgcccgcccaaggggttttcctatgttctgggatgcacgatggatagtttctgaaaatgccaatctgccttcacccaagggcctaatttttataaatacttgacctagctttcgttttgtgcccttggagtaaacaccgtgatacctaacgtgaaaaagattttgccccgagttccaattttgcttgataaacctattttggcttaaactctttcactttcgcctcttctaccctgaggcttctctttaaaggagaccacaacacttgtttgaaattctcttttagagagcttttgcaccacttccaatatggtattccctatggagggccctgagttcacgaagcccctcacttgtttaaagctccaatttcttaagatgaaccacgtctttaattcactctggaaatgttccaccactaatggtcactcactaattctaatttatctttagtaagatttcacccctttttgtaagtatttgccacgcctttctaggccctaacaccactgtaaaaaggtaaaccactagccacgaaggtgaaatacaccacgttcttttaaaatttaaggatgctggccacggcgaggtggctcgcgccctgtaatcccacgcacctttgggaggcctgaggtgccgcagaacttggtttgagccccacggaaggtggaggttgccttgagctgagactgcgcccctgcactcccgcctggaccaccgagtgagatcctgtttttaaaatta

SEQ ID NO: 521430 - DNA, 193 bp, Homo sapiens
atctcaggcagtgacgatggcggtggaggcatgaggcgatggaagtccacggtgggaacagcgggcactcactctgggagagggacagatcatatcgtggctgatgtaggaggctcgccggcagaggtccttgatgacttcaggcacctccacccctttgacacagagctgcgtgaagcggcgctcgctattg

SEQ ID NO: 521431 - DNA, 592 bp, Homo sapiens
agcgggcacggggcgcggcctgccggggacccagcagcgggcgcgcggataatcgtggagctttcaaaatgttgccaaagcaaccaggtaattttcttagagaaagttgatgctgatggttgacctgattgcacctatcaagatcgtgaatgactctgattaagttagcgagacttctagagtctggtgactagaaacaagaagacgattctggtgctgggagagacccaagtaccagtttttatccctcacccttggcgatgtactcatagaagaccaatgtgcgagtccagtggtcgtggagtcggactttgtgaaaatacagagggccaagtttgcaaaccgacgtgagtggaaccctggtagactgcactgggcggcaacggtcaatctgaacctggggggcagcaagccggtgtagagagccagtcttcaattttggaaccctgaggaaggcaggaggtggatttgcaggcaggtcaatcatgagactctgtcgaggagaacaataaactctgacgtaaaccctgtgtctccagactaggtgctggatgggaaggaagtgacggtcctgtgcgttttgacacagaag

SEQ ID NO: 521432 - DNA, 817 bp, Homo sapiens
ctcggcaggttgatgcgctgacgtgccttcactacacgtgtgatctgaataccctgcttgctgctgatctggtctattgaattgctaagtaatatcaatggctttgtatgatttcctgccttcccaccttccgattgctcttgtaaattgccacaacgtcgatggtctatttaaatctgtgggcgatctttcatgatctgcctggcgttccatcattcaccacattgttctcaacaatatgttgtactatcggtcagattcaggtacgtaaacccaactggacttggcggaatgatgcaacacaattactgttccgttggagatgtacaggtgttttagctcacgcatgtatgtgagactctggtcttcgggtatgctgatagctgagaatttgaaaatctgctaaaatatgtcagatggttgggaacaggatacatcggtatgtttcggcgctgtgtgggtatgatgcgtaaagtctgtgacgttcaatggtacttacattagctagttcctacttgttcttacctcttgagcgttctacgagagtgagtgtttgagtttctagaatctctgaagagacattgtagctgtactcgtcagtacatgcaattatctaggctccgtactcctgacttcggcatctagttgctttcttggccacgtatgagtgtgtgtcgttcgcacacttcttgactcacaccatgcgcacagttcccgttgaccccgggtcaggctccgggctacccgccacggcgcgtgatagtatcgaaccgtcattgaaagcacccgtggtgaccgcaggggttcataaaccctg

SEQ ID NO: 521433 - DNA, 1142 bp, Homo sapiens
  misc_feature (330)..(330): n is a, c, g, or t
  misc_feature (462)..(462): n is a, c, g, or t
gacagtactccagacagaacggcttaggaatccaacaagtctagcatccagtactccctgtaggcagaggttgagaaatggagagaatgttatctctgcctggctctgggggctcttgtggcggactggggttctggccctgtctggtcctcgtgccagccctaatcagaccgcacttgacgaggagaatctgatccaggagagcctaatgaccggagggacacagccgtggagccttcgtgacttagtgcttcttcgcctaacgtggacttctgcttatcaggccttgttacaaggcatgtataggccgtgaaggccaccttgattaangaagtgtctagttcttctcaacccagtggagtcactcgtcactaccgtctttggagtgctttaccctgtcattcatggggagccccagtaaaatatcctacaccatgtacaggaagattatctgcatagggncgcatcaaaggttcaaaccatgcagcggaggagctctcgtgagggactagataactgtacagcaggatggcatttccaagcaggcttgcctgcgagcacccactctaagtgcaagtccgagcgggagtgaaagtctgccagtctaggaggttattcggggaagatgcccgatggtcaggatgggaaagaagccaagtgcaaggtacttggactggggaccagggttgcaacggggaagtggcatgccgcagaggagggcctgtaatggggcatgcccaggtccgggcctttgtgggcgccaacgttggaaccctctgtgcaccgtggcaccttccagcgctgtgggaagacctaaaaggaaaggcgtccaagtccaaggtggcactttagggttgggaaaagacaatcggttcgacctcacgtgggggggaacacacattcctaccggggaaacttctggacttccatggggcaccccttggaactgtccgacctgtaaaaccaatggatgcggatcccctggggtggagatttccccagtcatgctctctttaaaacgggccccatgatgagggaggaagcggccccttttgggagctcctccaaagcatgtccctcgatccaggtcgcgggcgtcctaactcgcagagcatagtacagcacagcggggggacaacgga

SEQ ID NO: 521434 - DNA, 428 bp, Homo sapiens
  misc_feature (73)..(73): n is a, c, g, or t
cccgacagcaccctaaccaggacagcatcctaaccagaatacctattattaaaaagacaaaaaataaagatgntggcaagatggtggaaaaaagggaacacttttacactgtggggggaaatataaattagctcagccatggtggaaagcagttgggagatttctcaaagaacttaaaacagaaccaccatttgatccaacaattccactactggatatatactcaaagggaaacaaatcattctacaaaaaaagacatatggctgggcgcaatggctcacacctgtaatcccagcacttggggatgccaaggcaggcggatcccgaggtcaagagatgcagaccatcctggccaacctggtaaaaccccatctctaccaaacctacaaaaattagctgggagtggtggcacacgcctgtagtcccag

SEQ ID NO: 521435 - DNA, 374 bp, Homo sapiens
atcccctcaggattactcagaaattgttgccaagatgaattctcaggggtttcttgaatgttttcttgtaatagtttcatagatttaggtattagatttaggtctttaatccgttttaatttgatttttgtatatggcaagagataggggtcaagtttcattattattcatatagatgccctttatttatttctcttggctgattgcactagttaggacttccagtactatgctgaataagagtggtgaaactgggcgtccttgccatgttccagatcttagaggaaaggctttcagtttttctgcattcagtatgatactagctgtgagtctgttgtatatggctttcatcatgttgaggtaatccgtgaggg

SEQ ID NO: 521436 - DNA, 409 bp, Homo sapiens
ccataatgtagaatcagtgggcgtgttaagcttgttttcctgcaactggatggtcccacctgagcgtgatgggaggaagtgacagatcaataggtattagactctcattaaggacagcgcaacctagatccctcacatgcacggttcacaacagggtgcgttctatgagaatctaatgctgctgctgatctgagaaggtggagctcaggcgggaatgtgagcaaaggggagtggctgtaaatacagacgaagcttccctcactccctcactcgacaccactcacctcctgctgtgtggctccttgcggctccatggctcaggggttggggacccctgctcaagtgcatcagaaacgacccttcttcccacaccagtcttcacagtggtcaagtgcagcaaccacttagt

SEQ ID NO: 521437 - DNA, 769 bp, Homo sapiens
gcctttcgcctggctgctgcttctgtcgctggggacaatgcagacgctggcgcggaagatccccaagtcgccctggctccgctgcaccgcactccctcccgccaatgctgatagtcccctctcctgcatccctccaccccaagatcacccgaggaaaggccggtgggaagagggcaggggctagcggttccttcagcccctacgggaccctgctcagcgcctcaagctggcttcccaggatcactgcggtcaccttacctgtgtgccatggccagatgagaccctgaacaacctgttccagacttcgactattcccaggcaaggagggaaacccggagaactgcattattctgtgccctgctggggtggcgaatgcgctcttcaccaggaagaaggtccgcggaggaggatccgggcttctgttgactcctctgattcagcctgttaccgtcgaggagatcgttccatgagaggccatgctagggcgtggccaggatgcacacgaatggcttaccatgaacgtataccttggccccagcagcggcccagattccgcaggtgtgacgcatggtagccccctgcgaggggccacacgctcacggaatactagaacgtgggcagcttggcgagacagttggccagatggacaagggaggccggcgaatcctcactcgattcataacgtggatccctgcctctccttggttcctaggcttactgctgcaggattgtccacaaatgtcctcatagggtcctaagtgggtcatcc

SEQ ID NO: 521438 - DNA, 161 bp, Homo sapiens
  misc_feature (97)..(97): n is a, c, g, or t
aagaaactgatgtctaccaagatttgtgctgggaacatctgagtgatgaatacgtgtgtagccggcctcttgtgggcaagcagacaacgtacactgngtgctgctgtctgtatggagaggcctggggcatgcagtgtgccctctgccccctgaaggattca

SEQ ID NO: 521439 - DNA, 116 bp, Homo sapiens
  misc_feature (12)..(12): n is a, c, g, or t
  misc_feature (59)..(59): n is a, c, g, or t
gcagcacagcgntctgcgtggaattcatgagcggcccagttctgtaccaggagaagctnctgaagccggcagctttgctggacgaaagggtgccgaccaggaggaagacgaggccc

SEQ ID NO: 521440 - DNA, 256 bp, Homo sapiens
accgattcaaaaaggaagttctttcaaccccacaaaagcaactgaggggccaggtgcagcggctcacgcctgtaatcccagcactttgggaggccgagacgggtggatcacgaggtcaggagttcgagactagcttggccaacatggagaaacccgtctctactaaaaatacaaaaattagccgggtgtggtggcgcgtgcctatagtcccacctactcgggaggctgaggcacaagaatcgcttgaacccgggag

SEQ ID NO: 521441 - DNA, 432 bp, Homo sapiens
cacgagggcgggggggaagctcccccgcgccggcaacgtgctgctttcggtgcgcgcggccgacaagccccgggtgatcgagatcgcccgggccctcgcctccctgggcttcggcctcatggccaccaaagggacggcggcggcgctcgaggccgcgggcctgtcggtcacgcccgtcaacaagctgggcgaagggcggcccaacatcgtggattacatcaagaacggcgagatcaatctcatcatcaacaccaccgacgacagccgcgcggcgatccaggattcctattacctgcggcgcgaagcgctgcagcaccgcatcacctactacaccaccgtggccggggcccgggcggcttgcttggggatgcagcacatgcccgagtccaaggtctacgatctccagggactgcaccgggcgctgcgggcgac

SEQ ID NO: 521442 - DNA, 208 bp, Homo sapiens
  misc_feature (83)..(83): n is a, c, g, or t
cactggtatcccacctagctgaagaataagctagttaatgtctcaataacaggttgagagtcaagtaggaaaaacactggagnactggggccaaattcctgctcttctactggcttggtaaagcaaagggagcgatgcatctgctgtgcctacactttcccgacttaaatttgaagttgccttgctctaacctcacagggtctaatta

SEQ ID NO: 521443 - DNA, 101 bp, Homo sapiens
tctgagaattgatcatatgtctcccctgtattgtcattgaaattactggtaaccccctctgtttccaggctgccccctgtactgctgccctgtagcaccgg

SEQ ID NO: 521444 - DNA, 922 bp, Homo sapiens
  misc_feature (11)..(11): n is a, c, g, or t
  misc_feature (159)..(159): n is a, c, g, or t
  misc_feature (207)..(207): n is a, c, g, or t
  misc_feature (220)..(220): n is a, c, g, or t
  misc_feature (228)..(228): n is a, c, g, or t
  misc_feature (230)..(230): n is a, c, g, or t
  misc_feature (239)..(241): n is a, c, g, or t
  misc_feature (244)..(244): n is a, c, g, or t
  misc_feature (252)..(252): n is a, c, g, or t
  misc_feature (254)..(254): n is a, c, g, or t
  misc_feature (258)..(258): n is a, c, g, or t
  misc_feature (271)..(271): n is a, c, g, or t
  misc_feature (286)..(286): n is a, c, g, or t
  misc_feature (289)..(289): n is a, c, g, or t
  misc_feature (293)..(293): n is a, c, g, or t
  misc_feature (303)..(305): n is a, c, g, or t
  misc_feature (312)..(312): n is a, c, g, or t
  misc_feature (314)..(314): n is a, c, g, or t
  misc_feature (343)..(343): n is a, c, g, or t
  misc_feature (345)..(345): n is a, c, g, or t
  misc_feature (357)..(357): n is a, c, g, or t
  misc_feature (370)..(370): n is a, c, g, or t
  misc_feature (483)..(483): n is a, c, g, or t
  misc_feature (551)..(551): n is a, c, g, or t
  misc_feature (584)..(584): n is a, c, g, or t
  misc_feature (601)..(601): n is a, c, g, or t
  misc_feature (610)..(610): n is a, c, g, or t
  misc_feature (799)..(799): n is a, c, g, or t
  misc_feature (836)..(836): n is a, c, g, or t
  misc_feature (901)..(901): n is a, c, g, or t
accaggcaagncgttcatttgtgaggtctattccttatcagggatgtattaccatgggtccccgagtatcctgttaagtgtctatcacagggtagcctaccttcatgttaatttccacctcattacaaaggcgaggctgggactactctcatgcacgcntgcttcacttagggctgagtgtgatccgtctatttcagtgggtaattngaggataaaggcnccattcgncnaagccaagnnngcntaattttngncgtngaatttttatggnagacggatatctatnganatcnacttattttnnncggtttncngatacactacaaatggaatagatcatttngncaaccgcccgantcaaatataaaanattacaaccccacaaatatctgcatttcctgataacacagcttttttggctcacaaaattttctgcatttctgcttaatttttgatgaacatatttttgttcgcccccacggnagcagcatacgagggtctgatttcaagtcatcgtcatcattttcccaaggtatcttatagaatctgcnaggcctttaaaataggattttcaactatttttntcctcttgggttttgcngggggagangctagctttatgatgacctaacaatgccagctcagaggcagtgatagcttagggtctctatgtttcacgtttcagctatcagtggctgctagaggtggtggatctattgtgttttacccaactttagaacagcttcccacgcaaagaaaagtttctcttcaattcataagaaacctcctgcctacagtnaaataagtgtgtgttaatcatattttacttctaaganactccagcaccatgagtggtggttttctgactggacagttctgttggacaactctgtgacacttncatcaacgtgaccggctatta

SEQ ID NO: 521445 - DNA, 925 bp, Homo sapiens
ttatatgggggctcctttattttagcctccccgcggtccggtcccagaagaacttgcggaagtggccgccttttaaaggtgtgcttaagtgagtcatgtaagttttcaactgggaacttaatagtcctccccctggattctctccggttctcctcgccacgcgccccgaatgcctagctatgattggggtgagtgtccgtcccgtctttttcgcccagtgctctacggcccgtgatccccttcttggcccccgggaacctttcgttgtacccccccaggcccttttttctccgttttgacacccctgttcgcccgaatgtccgcccccgtatttatgaaaaatgggttcctctcttcccccaatggggaacccccaattcctcccacaatatatttgtgaagaaattctttcccccggttatggctcttccccccagagggcctaattctcaagaatacttcttggcccccctgggagaggaaactcttttctctaaaggaaaaatatactgtttgccaccacgtttggtttaaaaaaagtttcctccgccatctactatctccttctctgttgtccaccctgagaaatctcgtgcggggcgcctttttatttaagccagggagtgtgggcccttttctcccttcaccgtgtgtgatgaaaaagtggggccgcccgggtggtatgtcgtaccaagaagatggtggtgtcgcacaaaatccgcttgttgatatgtttttataaagagtggcacactcccccccctttgctctttgtgtttagaagaatagtagtgggaatgttattcgtagtaaggacgactatagttagtagccgcggggtccacgcaccacatggaagtatgtgggggacacccaaaaaaaaacggggaaaaaaaaccccgttttttaaaaaacccaaaaaaaa

SEQ ID NO: 521446 - DNA, 258 bp, Homo sapiens
gtcgacaaattggaattgaagagatttggttctaacatcttttgacaaataagtagtagaaatttttatctgcagctggagttttttggtggtataccccatttctctccccttctctccctctctctctttttactaatgtgctcctcatctctgagacctcatcaaaatggattttaccacccatatttctaccagttttctgatcagtatcacttaggtaatctctaagaagactgaggctttctctatagctct

SEQ ID NO: 521447 - DNA, 118 bp, Homo sapiens
tacgagaacgttgcctcatctgcactttagagtgtatacgcttcttgtgagactgatgggggagtgcctctagaagttcgatcctgctacggcatggcgatgcttgggcacctggact

SEQ ID NO: 521448 - DNA, 640 bp, Homo sapiens
  misc_feature (14)..(14): n is a, c, g, or t
cccttcccctgagngtggagctctccaagagccacatcccccatcattgggcttcgtgctggcctggctgttctggttgtccaagctgtcctgggagctgtggtcaccgctataaatgtgtaggaggaagagctcaggtggaaaaggagggagctgctctcaggctgcgtgcagcaacagtgcccagggctttgatgagtctctcatcacttgtaaagcctgagacagctgcctgtgtgggactgagaagcaggattttttcacccctttcctttgtgacttcaagagcctctggcatctctttttgcaaaggcccctgaatgggtttgggttcctgttagcataatgtgaggaggtggagagacagcccccccccgtgtcccccgtgacccctgtccccacaatgacctgggttccctccccgatcatttttcctgttccaaaaagggggggggggatgtctccatttttgtttcaaattcatggggcactgaggggccactttttacttccctaatgaagttaagaacctgaaaataaatttgggttttcaaatatttgctatgaagggttgatggattaattaaataagtcaattcctagaagttgagagggcaaataaagccctgggacccttcca

SEQ ID NO: 521449 - DNA, 156 bp, Homo sapiens
agttattaaactttatgtatatatttgagccagagcttaatttttatgaagataaaggcatgaagtttaacaatggacgacagttggtgcgataattgtgaggacaagtcttgttggacttggggacggctttgttcacaatattatatggcacat

SEQ ID NO: 521450 - DNA, 129 bp, Homo sapiens
ctgaagatgctgttggagattgtgctgaggacgaggtaggcggtgggttggtcatgctcactagtgccatctgaccaagctgaagaggaggctcggagccacaagggtgttgccacatgtcttgggtgc

SEQ ID NO: 521451 - DNA, 169 bp, Homo sapiens
tgacatactaaaaatgcattgtaagctactgttaaagtcctgtgactcatcgtttgtgtttgtcagtgctgcagttcagcttgagcccttccctgattacctgatgtaattaacaatctgtgccctgatagacatcgcgaggcactgtcagtaagtgaggatcttttct

SEQ ID NO: 521452 - DNA, 258 bp, Homo sapiens
agatcacctcggtggtatggtgtggtatggtatggtggttggtggtatggtggtggtgatggtgatgtaggatggtggtgatggtggtggtgatggtgatggtggttggtgtgatggtggtggtgatggtgatggtggttggtgatgatggtagttggtggtggtgatgattgtgatgatgctggtgatggatggtgacattagtgatgctgggagtgatggtgatgatagtaggagatggtggtggtggtagtaatg

SEQ ID NO: 521453 - DNA, 631 bp, Homo sapiens
agaggagggtctgcatgggtctagagcagcgagaagtgccctgggcttgccaccagctctgtcctggctggggaggaacacttcggtgcctcacacccagcgtaacctgccaaagaaaccgtggagagcttttcggggccatgcattgtgcaagactctaattcccacaagctcagaagctgggagtccacaccgttgagcctgaacctgacaggcccagtcggggtggtcaggggtgcgcactcctcatgccctgcctcaccagctctgtgatttagataggggtcttcattgtccagaaatacctcgctctccgcatgatctgcacgccagagcctgaatagtctcatcccgtatggagctccaccgttggaagtctaagggctgtgccatcagccacaaatgtgacccaggatacagagtgttgactgtcctcagggaggtccgatctggaacacatagttggaattggggccaactcctaatatagggtgggtaaggccttataatgtaaagagcatataatgtaaagggctttagagtgcagacaagacctggattcaaatctgccatttaattagcctgcatatcaccttagggtacagcacttaacgcaatctgcctcaatttc

SEQ ID NO: 521454 - DNA, 342 bp, Homo sapiens
tgtaggagacgcactgagtacctgcagcggggcttcaatctgccctaccaggatgcccgcaagtgcctgggcctgttcggccatggagagtcatgcccatcaccatccagctcagcaaactctctggtggtcagaaggcgcgagttgtgtgtgctgagctggcctgtcgggaacctgatgtcctcatcttggcacgagcctaaccaataacctggtacataaagtctattgatgctctaggggaggccatcaatgaagtacaagggtgctgtgatcgtcgtcagccatgatgcccgactcatcacagaaaccaattgccagctgtggctggtggaaggggag

SEQ ID NO: 521455 - DNA, 234 bp, Homo sapiens
gcacaagaatgtaaatacatacattactcagccataagaatccatactttaatatatattatgacatagatgaatctttaaaaactcatatgcttccaggcacggtgagctcacgcctaccatacccaccaccctgtggaggccgaggtgcggcagatacacaaggtgcaggagatcgatgaccatcctgagtcaacatggtgaagatacctatctcgcaacaaaaaacaacat

SEQ ID NO: 521456 - DNA, 2683 bp, Homo sapiens
ggcacgaggctgctttgtctgctgtcccctctctgctggagaacttagcccagagctagtgaacgagcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccgccccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 521457 - DNA, 5810 bp, Homo sapiens
gctgtttccagacgctggggactccctgacccatctcggcccttgccaggacaccttttcacccagggcaggggacagaggcctctgagccacaggcctccagcagtttcccccagattcccagtggcctggtggccccaccccacacagtgccacctcttgacattgtccactgtgtggagggtgctactatgtagaatgtggaccagcaacagccctgcccccgtgtctgggtgcaccatccagttctgcagatgtggagacaggctgccgtggcagggctcgggttattgcccggtgtggggaacactggacagggaaggaggtactacccgggtgaccgcagaccctaggtacacagcctggactgggcagaggggacacgttcagaggtgtgagaagctgaacccccaggacttagtgacagggctgtgaggggtaaagaggggtcaccatgcccaccccccgggtggggaacgtggagggcagtgaaggtgtggtggatgtggctgcattggacgggttgggtgtggagatgcctgagggccataggtgggtggctggacgtggtgagggtatggagcctgacagacaccccgctggagtcagatggaaacctgggaggggtccctgtgcagctggcttggaggggatttggtctgagcatgcagggcaggggtgcaggtgcaaaccggggccccagggaacagcccgggcgaggtcgggaggggcctgtggtgtgatcgccggaccagcagaggtggggaaagacgtggcaggaaccctggggcggccaagtgcggggcatcagctatgcctggggacggggtgcgtgtccatggcccggtgcctgcagcaagcggacactgaggcagagaggggtgtgagagtcaggggctgggggcactgctagcccaaagattggttgggtgtagcaggtggttgggtgtgaaggacttggggagggggagcagtatttaagggctggtggaacagggagttgactgctgtatctggaaggccatccaaaggccaggggtaaactgaggctctgtgaagctgcctgacttgtgagatgtctgccccgagcccaccccatagccccttcgtcctcccctcccacacctgccccgtggagaatccctgcctagctcattgtctgcctcccctctggaccgcaggctcccggggcaggggcagggtttgtcttactcctggctgtgaggtctcagacaggttgcttgctctgagaggtgagggtagggacctcagggtgcccagaaggggcagggctgggtgagggggcacagtgagctaggggtgcaggtctcagaatagcaaggacctaaggctgctcagtgaggcctggggtgtggctggagaaggggtgaggactcggggctgaggtggccacgtgggtggatggatgacgccctcacctcttcccgagggctgtgggtacaccaggagcccctgcagggaacagtcgacttcaggggctgctgtgcagcccattgtgcctgccctaggagcccaggatggcataggagtccccaggaagttcaccacctccctggggaggacaggtctgtgctgggaagcagcctgggacctgtagctatagagtgctagaagtggggcagccacggaaggctgcctggaggaggtggaaggaggcctgagcactgtcccagagagcgctcccggaggcagacccacgtgggcagctgtggcactttgcctcagggcttccctctttgcttgttactctacttcctcttgtggtgactgactcttgggaagacccgcgctgcccttctctgaggttctcaaaaacgtaagcgacgctttatttttatttgtttttaaaaatatagccctgggcaggaatccaagagtgcttcctggaggcttgctgggtgtgtgcccgcagtgccacatgcggtttactcacggggcccagacagaagatgcctctgctcggggctgggggacagtggtggccccagggggactgggagcctcctgcctgccctctactcccctcgcttgggtttgggtcgggaatatcacaagaacgcgggcttttgcccagggtcccacagcacatctgggcagagtcagggttccaggccctctcccacacctcaagtttccttcatgacacccgggacttctgcctgtcccgtccccatctcacagcaacacaatccaaaagatgttggtcccagatagcccctgggctgtgcacccattgcaaggaaagaactgctggctgctgaccccactctgacccagacaaccggaagtgcagcccctgccttggggagctccgagccatccctgttggaggcccccacactaccctcctgcctttgcacagctttagttcaggtgaattgttggcaggtggctcggaagagtgggtcatagtgggtctctgtttcctgagcatgtggggctctgcatcctggggtcctaccctccaggagaccccattctgggggaagaaaatagagcctcaagaattgtctgggtttctggaaggcttcctggaggaaggggaacttgagcaggccaggaccttgccaggtttcccgtgctgcatgcagcctcattggccatggtggcagacactgcccgggcatgggacattgccaccaaacatctctctggcccagagaagtgacccagggtcccagggccacacagccattttggggaaagcaggtctggtcttgggcatggcactgctgactctgggcctcagccatcccaacctagcactgtggaggagcaggagtgagggccccagtcacctgtgccacccagggccagctctgtgatagcctgggtgctgatgggtgctctttgtacctgggtcctttaaaccgcccccaacacactggccaggttctggggtcaaagactcctccagccaccacctgggatttacctgtgtgagggacactggtggagtctgaggaaccgcccaggccagactggctcagggtcagagtccctgactctggggcgccgtggtcttcagtgacgcccgggaggctgggtgtgtgtgagtgtgtgtgtgtgtgtgtgtgtgtgtgtgcgcgcgcgcgcgcgccggtactcgcgtgttagtgcggcacgccccggctggcctgcgggccttagtttcccccgctcagcgccgcggcccggcccgccgccgccatgtcgttgcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccgccccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 521458 - DNA, 245 bp, Homo sapiens
gccaaacccactccaccttaccaccagacacccttagccaaaccatttacccaaataaagtataggcgttagaattgaaacctcggcgcaattagatttagtaccccaagggaaagttgaaaaattttaaccacggcttattatggcagggtttaccccttatacctcctgcatattgatttaatcgggaatatctttgcagggggagccaactctaagccccccgaacccagagagctccctca

SEQ ID NO: 521459 - DNA, 2749 bp, Homo sapiens
ggcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccgccccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 521460 - DNA, 199 bp, Homo sapiens
  misc_feature (36)..(36): n is a, c, g, or t
  misc_feature (53)..(53): n is a, c, g, or t
  misc_feature (67)..(67): n is a, c, g, or t
  misc_feature (88)..(88): n is a, c, g, or t
  misc_feature (106)..(106): n is a, c, g, or t
  misc_feature (169)..(169): n is a, c, g, or t
tttgttactgcacctctccctgtgcattccagacanccctgacctcttgtgcncaaactgccccgcnagagtttgaggttctgactancagtaacccatgcccccncagtaccccttacggctcagtttactagataggctcccttttacttgagtactgcctgttganttgtacttgtgattttattttttgtttcaa

SEQ ID NO: 521461 - DNA, 2690 bp, Homo sapiens
atccttccctcttcagggggtcccggggtggagggggaaatacagtcctgggccctggcctaggaaaggcttctacaaaagtttgctttaatgggatgttctctgctgtgtgcagaggggcacacattccaccagggtgaagctggtggggtgagctcaggaggtccaaattcagccccaccctgctcagcaggctgtgcggccataagggtcgtgggagggacaggccttgcatggcagtgacccccttgcctcctgcaccaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccgccccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 521462 - DNA, 540 bp, Homo sapiens
taaatatagcattatactatgtatagtgctctcacaaagcttagacctttaccttccagccaccccacagctgccttgaatacttctcagagctcagctcaattggttaatacatgctgctacgctctcccaaagacacataagctagcaacgaacgaaactatcctcctagcgagccacctacccatcgtgctcttccacacaatgacaactgcccagcacaccactacgacacctcacacacactccaaatctcccagtgtgccacccacgaacgtgaccatgctacgctctacactctcagctgctcaccgaagcacactcctacctgggcaccctggcacacctccctaagaagtgccatttcccccacacaaacacgtgcatctagccttcctctggctccgtcggcccacacgattagttccacaacaccgaacttgggcatctaacgtggccgagagcgcacacaacctctcagttctacacctcttacgcacaacaacacctgcacacggaactcattaagttacgcccaac

SEQ ID NO: 521463 - DNA, 2810 bp, Homo sapiens
ggcacgaggctgctttgtctgctgtcccctctctgctggagaacttagcccagagctagtgaacgagcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccgccccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaagaaagacaaaacaaaaaagaagagaagagacaaaaagagaaaagcaggggggcgcagaaagaagaacacacgagaggggcacagaagcgcaggcagaccaccgagaacgagcaacaatagggacacaa

SEQ ID NO: 521464 - DNA, 397 bp, Homo sapiens
ttttttttttctttgcaatggaatctcgctcttgtggcccatgcgatcttggctcactgccactctccctcctgggcccaagcgattctccccccccagcctcccgagtagctgggattacaggcatgcaccaccagccgtggccaattcttccacctttagtagagacagggcttcaccacgctggccaggctggtcttgaactcctggcctcaagtgatctgcccacctcagactcccaaagtgctgggagtagcatgagccacccctttttaatagaaatggggtctcgccatgttgcccaggctggtcatgaactcctgggctcaggctatcctcccatctctgcttctcaaagtgctaggactacagatgccaccactcccagcctacataa

SEQ ID NO: 521465 - DNA, 701 bp, Homo sapiens
gtaccacggccatgccctcttcaagcgcaccttggtgctgatgtccctgccgcggcgcccaggggtcccgggcgcaggcaccgccccgtggggctgctgcttgcctcctgccgcctggccctagcaatggactggcctccgggagagagagcggaggctgtggagccgactgccccagtacccactcccactcccactccgcactacccactcctgctcctcgacgtctacccaccgatcgtgtagtagtaagtctgcccgcaggactcgctcagtcagcagcctgaaaacttgctacaagtatctcaattcagaaccagtcgcagatatcgcagctgttatccaaggcgctggatggggaaatgcgcaacgcagtgtgcatattagatcgtggttctccgagctctggatcacactggaagatgacatgaccatcattgtggcaaaagaaggtcccgctgttacacaactttacactctttcctttatcaaaccagactggcggttcatggagacgcaaggagcaaggatcgccaggtgctggaggacttcccaacgatctcccattgagtttaggaaatctggctgagaaataccagacaggtgattgcagagcatatgccggagaatgggcattgggatggcagagtaaatggataagcattgtgacctctgaacaggagtggaccagtactgcaata

SEQ ID NO: 521466 - DNA, 410 bp, Homo sapiens
  misc_feature (174)..(174): n is a, c, g, or t
acatcaattaatcccagcactttggaaggctaaaacttccgaattgcttgactccaggagtttgaaaaccagcctgggcaaacatggcaagaccccatctctacaaaaaattagccaggcatggtggtgcacacctgtggtcccagctactttggaggctgaggtgggaggatngctttagccagggaggtcgcgactgcagtgaaccaagattgtgccactacactccaacctgggtgacacagtgagaccctgtctcagtcaatcattaaaacagggctccatgcctgtaatcccaccactttgggaggccgagatgggtggatcaccaggtcaagagatggagaccatcctggccgacatggtgaaaccctgtctctacttaaaataggaaaattagccaggtgtgg

SEQ ID NO: 521467 - DNA, 359 bp, Homo sapiens
cacgcagaaagtaatgagctaaagctaacgtcatgcacatctattagactaaaagaaacgactttaaccccttcagttgtttgtaggacagcactccttaacagggagtcaggttcggtaaatataaaggatacataaaaaatacagtataaactgcataagcttaacagtagcaaaaacactgatgaacttttaaaaagtcaaaaatatataaaaatattagcctgaaatggcaaattttcaaacaccgatctgtgtaaaaatgtttaaatattgatgttactccaaaaatatatacttattctattttttttctattcgcaacagtttataaaggcaaacaaacacctgcaattgag

SEQ ID NO: 521468 - DNA, 150 bp, Homo sapiens
cacatggttcactaaatattattttcctgatctcagaaagcttaacctttacacattttaaaattacagggccctgccagaaaaggttggtcaaaggaggcggtgttcagggaaacccgttcctaccgcgggggcgtcatctcagacccc

SEQ ID NO: 521469 - DNA, 592 bp, Homo sapiens
gccgggctcccctgttcgctgcagtggttcggccgcggcgacccctcagcggcgcgtcccccgccgcggtcccgctccgcttctccccgaagccgcgcgcccgcgcctgtcggtcggcggaccatcagccccccgtgaggcccacggcctcccacccgccatggtccgcccgcgccgtgccccgcaccgctccggcgccgggggccccctcggaggtcgtggccggccaccgcggcccctggtcgtccgcgccgtgcgctcacgttcctggcctggcggtcctcgaggcccgcagccaccgcggatccgggctcgttcggcccctcccatggagggtgctcgagtctttggagccctggggcctatcgggccctcttcacctgggctgactcttgggggcctcgcagtgaacgagcaccggctcagcaacaaactgctggcctggagtggcgtgctggagtggcaggagaagcgtagacccttctcggactccacagccaagctgaaacgcaccctgccctgccaggcctatgtgaaccagggcgagaacctggagacggaccagtggccccagaagttgatcatgcagctc

SEQ ID NO: 521470 - DNA, 435 bp, Homo sapiens
agggactcataaagcatccccacacataaatttgcatttttccaacagatttcttttttttcttgaaaaacaattacccttttaacaactatttttcaaaagtaaatgtaataaaaatgcccaacataaaatgtttatgatcccaccaacaccctttttaaaaaatgtgaaagccaaaaaattaagttctagttttgcccccccccaaaagggcaaaagtatttgcccctggaacattcaattcccatttgagaataatggtaaaaaaaacttgcatttgccttaccatcatgatccccctgttgagttaggaaaaaagggttaaacaaacccccattcctttttttaaaaggaaaactttaaaatgttggggcaaccccatactatttggccataaatgaaaaagcccccgaaaaaaaatgctttttgtggttt

SEQ ID NO: 521471 - DNA, 169 bp, Homo sapiens
atgcgaaaatccttcataaaatattagaaaactgaattcaacagcacaaaaggattgtacatcaggacaagtgagatttatctctggcatgcaagaggtttgacatacacagatcatcagtgtgatacattatcttaacagatgaagagaaatacatattatctaattg

SEQ ID NO: 521472 - DNA, 170 bp, Homo sapiens
aactgatacaagactctccggaaatgtagaaatgtgatggtgctctaaatcaattcttcaagtgcactgcactcgctaatgatctggggaatagctgacagtctgttatatctcagaccaagacgacttaaactggacaggattcctatagtatctggaaggtctagcag

SEQ ID NO: 521473 - DNA, 130 bp, Homo sapiens
gtttgtctaattacttcctcgtgatagctctggttatagaatctggttattcttctccttatcaaactttatctactagttttgtcatctattgatgattctagactatgtacctacaatagtttagctg

SEQ ID NO: 521474 - DNA, 588 bp, Homo sapiens
ggggcgctccgggaagatgcagctcaagctggatggagatcaatcacgagatgcttgaacaaagtgctgtaccggatgagggtcgccggccagctggcgctttgtggacgtgctggggctggaacaggagtctctggcgctcggtgccagcgcctgtctgtgcgctgctgctgctgtttcccctcacggcccagtatgagaacttcaggaaaagagcagattgaagtagctgaaggggactagaagattagatcactaaagtgtacataacatggaagcagtagcattgggaaattccatgtgagcacaatcgtgcacttattcacgcagtgtgcctataatcaagacaaacgtggggatttgaggatggatcagttcgtgaaaacagtttcttatcttgaagacgagaggaaaagtgtcccctggaatgacagaggaacaagtgctttgaacagagaatgaggccactacagggcgagcccatgattgccgctggcaccaccgaaggccacattgtcggggtagatgacaacggtgaaatactccagttttattactgtttaaacaacgtggattggccaggctcta

SEQ ID NO: 521475 - DNA, 273 bp, Homo sapiens
attaaaatatggccattttttttccaactaaagtttggacccggaaaagtcctttctccgtgatttgtaatttggggcctgggttatttttctaaaaaagtttggatattttggccggaactaaaactgccccgccctcctgggggctgtcctggtttttccaaaaagccccccctggggccccctaatgttgcctgtttccgtggggtggaagttttgttttttttttgtttttaccccaagggtccttaaataaaaatctgttttctggga

SEQ ID NO: 521476 - DNA, 292 bp, Homo sapiens
attcacacgaaatggagcaggcttcaaactcaaaagtgactgaagaatacttacaatggaaatgaaagtgaccatagagcttcattctgtaagtttatccacacacacaaaaagagggtttgtaagagttaaatgtaactggctgaagcttatagctggcagtttgttacaaagtacccaagctatacctttccaacatcgtagatttgaagaattaaaggaattttatgaaatactgttggaagttatactgacagagaaaacaaaaaaggggtaaaagttggattatggt

SEQ ID NO: 521477 - DNA, 329 bp, Homo sapiens
gccccatttttttttgggggtttttaaaaaggggcccccgggggccaaaaaaattttaaggggccccggcggtttttaaaaaaaggggggaaactttttttttcccctttttgggggggggtgcccggccccccccccccccccccaaaaaaatttggggggtttttttgggggaaaaaataccccccccccccccggggggggtttttttttccccccaaggggggggtttttcaaagggaaaaaacttttcccggggtttttttttttttttcccgggggttggggccctttccctttttttttaaaaatttttttttaaaggccca

SEQ ID NO: 521478 - DNA, 1181 bp, Homo sapiens
cccttgcaggtgcccacccgagcttaactatctaagtgcttttgggtaaataaggccatcgctcgcgttgttcgagggccgttaagcctagagggttaacattggcctgcaggtgctaatttggggacagttagtaagttcccccctcttttcacagtccgccggttctttgtcagactctttggttgggcccactaaagacaaggctcccccctatgttggccctcctttcgtctgtcaggtaggtggtgtaatccccttggtagggtttaccgtaatgcatactagataggggtttagaatttgaggaagtaatggctaatggttcataagcctttatacatttggcttcccctgaagggtccgaacgggccctccgagagagaggaccacgtcgtggcgccaccaggcgcaaacctcttgggtaatggtgtccgcgggcatttgttgcgtgcttggcgatgcacgccttgctcaaaccaggtagaccattgttggccttgccacagcgctaacgtcctaggcacacacttttcgctccctccttcccatcctagatagggggaccactcggagtcaatcaaagcgatggcaatcgaaccacttggcgccggccgtctcgcttgacaccgctcgcgtcgcgtagcgtcgcgtgccccatggcgcctcgcaaaagggttcataggttactcgattctctctcctcatagctatcgacataaactaacctcctcggtacaagtcttgtggattgttttattgttcaaggttccaatttatcgacatcgagtcgagacgcttgctgcatactcgatgcggccaagattggtcatctcgtcagttgtccctcgcgtgttcatggcacgcatctgaatctcactcttctcgcgcgcaatgatacatcatctttgtaggtggaaagcaagagtgggcatggcggtgcatggcaaggtctggggtgacacgatctacctccagtccccctaggcgacaggtgggagccacttgcccttaggtatgatgcagtcagagtgagacaagggggtcccgatatcgaccatatagaggtgtaggggccacctcctccacctgttctgttggggaggggtagaccatgagtttaatgtcccagcctggggctccctctctggtattaagccgggggtacttgataaaaatct

SEQ ID NO: 521479 - DNA, 397 bp, Homo sapiens
agactctagaggaaccccttcccagtcctagttgcaggccattgaccacttgaggccaggagttcgagatcagcctggcaaacacagctaagccctgtgtctactaaaaatacaaagagtagccagatacggcggcacatgcttgtggtcccagctactagggaggctgagacggcagaaccgcttgaatccaggaggcgacgggtgcaatgagctgttatcgtgccactgcactccagcctgggcgacagaaggtgactctgtgtaaaaaataaaagaatttgcggacacctgggacacctcacaccttgccccaagcacaagatcacaaggtggtaaagctatttcatacatcctgctggctccagccagtgcccctagggaatatctctcacct

SEQ ID NO: 521480 - DNA, 210 bp, Homo sapiens
  misc_feature (44)..(44): n is a, c, g, or t
gagctcggtacctcatagttcgcaggagacccatctttaccaanaaaaaaaaaaaaaaattagccaggcaaggttgacacattgcttgtggtcccagctattcaagaagggtaaggtgggaagagcacctgagcccaggaggtcaaggctgcagtgagccatgattatgccactgctttccagcccgggtgacagagcgagaccttttca

SEQ ID NO: 521481 - DNA, 390 bp, Homo sapiens
  misc_feature (339)..(339): n is a, c, g, or t
  misc_feature (381)..(381): n is a, c, g, or t
aaccactaatcttctttctgtctctatagaattccctatcctgaacttccatatgaatgaaatcgtaaggtctgtatggggaaaagaaagagagatcagactgttactgtgtctatgtagaaaaaggaagacataagaaactccattttgatctgtactaagaaaaattcttctgctttgaaatgctattaatctgtaaccctagccccaaccctgtgctcacagagacatgcgctgtattgactcaaggttaatggatttagggctgtgcaggatgtgctttgttaacaatgtgtttgaagcagtatgcttggtaaaggtcatcgccattctccagtncttgagtacccagggacacaatgcactgtggaaagccatggngacctctgc

SEQ ID NO: 521482 - DNA, 224 bp, Homo sapiens
gcaaagtggtatctgaggtgcaggcacactgtcccaacactcccatcatcctagctgggaactaaacttgatcttagcggatgataaagacacgatcgagacactgaaggagaagaagctgactcccatcacctatccgcagggtctagccatggctaaggagattggtgctgtaaaatacctggagtgctcggagctcacacagcgaggcctcaagacagtgt

SEQ ID NO: 521483 - DNA, 157 bp, Homo sapiens
tatatacactcattaagtaaatggacattccagactcatagatgtgattatagtcataaactaattcttattaaaccaatgatgcagaaaatcagtgatgcattagttatagagtataactcatcgtttacagtatgtttaagttggcagtatcata

SEQ ID NO: 521484 - DNA, 139 bp, Homo sapiens
  misc_feature (113)..(113): n is a, c, g, or t
ggcgaaagatcgaaaaattataaccaaggataatatagcaaggactaaactataaatttgcataatcaattaactagaaataattttgcaaggagagccaaagctaagaacanacaaacagacgagtatccaagaacag

SEQ ID NO: 521485 - DNA, 83 bp, Homo sapiens
acatgtatatacatttggaaatttgaattaaatactgtatcatactttcaaaggataaaaagactacccctctgaaaaaaaaa

SEQ ID NO: 521486 - DNA, 133 bp, Homo sapiens
gactgggaaaccctggtggaggggctgtgggtgatctggtgatgaggccttcgctgtgagctctcagtgtgtgcggacggagcaccagacctgtgcaaagcccagtgaagaagagctggttattggtgagtgc

SEQ ID NO: 521487 - DNA, 361 bp, Homo sapiens
cctggcggcattttagaaaatagcttatgttacaacaaaaaccctttaaaaacattcatcccagcaaaagcctccagggctggggggtgaggggaaaagtttcaaagcacgtggattgtccaaatctgggatgccctgtcctcatccggctcccatagaaccacgtggtcccggtcgtagccccggcctgccttcacgtccaggatctgtgtctttaacatttggctgtaaatttggcccgatttacttatgctccacttttggcacggcaagctgttttcattctcccaaaccaccttttagcctgggctttgggggtcatatactcttatgtttctggtggggggcctttttgtttttt

SEQ ID NO: 521488 - DNA, 636 bp, Homo sapiens
  misc_feature (540)..(540): n is a, c, g, or t
gagagaactacctaatgtaaatgacgagttgattggtgcagcaaaccaacatggcacatgtatacctatgtaacaaacctgcacgttgtcacatgtaccctagaacctaaagtattataataatttttaaaaatctagacatctttcaataagttaagaattaattaaattattatacatctatattatagaatgctttgtagctatgagaatgaattaaagctacatgtgtttaatttccacatctgaccatgaaggacttagggagaccaatgcaaagaaatctgtagagtattgctagagtccaggtgagtaccttgtcctacctagagaatgattgcacaggtaaagagaaagatgctaaaaacttataggaggtggagcaagatggctgaatagaaccttccagtgatcattcccctcctccagctggagcacaaaattaaacaatcatccacacaagagagtactttcataagaaccaaaactcaggtgagtggtcacagtacctagctttaatatcatatcaaggaaataggncctaaaaagggatcaaggacagtcttgaactgccaacctccaactccccacagagcagcttggcataaagagagatctgtgtgcttggagggagga

SEQ ID NO: 521489 - DNA, 246 bp, Homo sapiens
agtgtgtgtgaggctgagaactttgtgaaggatgctgggagctacagcaagaaagtggtggggactcctgttaccagatcacaggcggagacactctaggacgctcttccagctgaagcagagaagaaatgttcccatgaagcctccagatgaagccaaggttggggacaccctaggagacagcagcagttctgttctggagttcatgtggatgaagtcctaccccgacgtttctgtggatatctc

SEQ ID NO: 521490 - DNA, 408 bp, Homo sapiens
  misc_feature (15)..(15): n is a, c, g, or t
  misc_feature (29)..(29): n is a, c, g, or t
  misc_feature (74)..(74): n is a, c, g, or t
  misc_feature (104)..(104): n is a, c, g, or t
  misc_feature (161)..(161): n is a, c, g, or t
  misc_feature (315)..(315): n is a, c, g, or t
  misc_feature (326)..(326): n is a, c, g, or t
  misc_feature (354)..(354): n is a, c, g, or t
acatccccgtccccnagtcaagagctccnctgtcctcgcttgaatgattcagggtcagggaggtggctcagagnccacctctcattgctgatcaatttctcatncctctacacatctctccacggagcccagaccccagcacagatatccacacaccccancctgcagtgtagctgaccctaatgtgacggcatactgcggtaatcagagagtagcatcccttcaatcacagccccttccctttctggggcctccatacctagagaccactctgggaggtttctagccctggacctgccagctctgttagtgganagatcgctggncaccataccttatggccaacaggtggcntgtggtgaaaggggcgtggagtttcaatatcaataaaccacctgatatctataa

SEQ ID NO: 521491 - DNA, 195 bp, Homo sapiens
tacaacaacgcgggttaacgtggcttgtaacaactcccgacttgttgatctgcctgctcggctcccaaagtgctgggattacgggcgtgagccactgctcccggctgactttttttatttttttaaagagactgaatctcacggttgaccgtggtttgtcaccaactcccgaccttgttgatccacctgcctcag

SEQ ID NO: 521492 - DNA, 381 bp, Homo sapiens
  misc_feature (7)..(7): n is a, c, g, or t
  misc_feature (19)..(19): n is a, c, g, or t
  misc_feature (57)..(57): n is a, c, g, or t
  misc_feature (73)..(73): n is a, c, g, or t
  misc_feature (94)..(94): n is a, c, g, or t
  misc_feature (102)..(102): n is a, c, g, or t
  misc_feature (111)..(112): n is a, c, g, or t
  misc_feature (115)..(116): n is a, c, g, or t
  misc_feature (159)..(159): n is a, c, g, or t
  misc_feature (192)..(192): n is a, c, g, or t
  misc_feature (218)..(218): n is a, c, g, or t
  misc_feature (249)..(249): n is a, c, g, or t
  misc_feature (259)..(259): n is a, c, g, or t
  misc_feature (274)..(275): n is a, c, g, or t
  misc_feature (301)..(301): n is a, c, g, or t
  misc_feature (340)..(341): n is a, c, g, or t
  misc_feature (372)..(373): n is a, c, g, or t
agagacnaaccgaaccccntcgaccttccgaaggggagtccgaactagtctcaggcntcaacatcgaatacgngcaggcccctcgccctattcntcatagcngaatacacnnacnntattataataaacaccctcaccactacaatcttcctaggaacnacatatgacgcactctcccctgaactctacacnacatattttgtcaccaagaccctacntctaacctccctgttcttatgaattcgaacngcataccccngattccgctacgacnnactcatacacctcctatgaaaaaacntcctacgactcaccctagcattacttatatgatatgtcnnccatacccattacaatctccagcattccccnntcaaacct

SEQ ID NO: 521493 - DNA, 882 bp, Homo sapiens
gctcaaggagtcattttgcactagtaggcaattcaacagtacacctttggtcgagtgtgaaataaacacagtgtgcactagggggacctgagactatcatcttaagggcagggtgggtggcaacaccatgtcgtgagtctccagctgttgtagtgcacctgtaaagctcggaaacttggaggtctatttgagcagtgtatgagtctctgcctgcctctggctcgagcatgcgcttcttctgtattgctctgatgggtctattgactaagagaggtctaacaatagttaaggcttcataaaagttaggaagttaacaagctcagaaagaccagaggtgttcgaggttcaccttcattccacatgcagtagtagcctgtacatggtgttgcagtggagacttaaagataactgccattgagtaagtgatggtggcgggcaccatgagctaactgtggtcagaagccggatggctccggttggggctggattctccgttgggagctgtgtgatcctggatgagttcatgccttgggttcagaagtcagacttccatgtagctgtatatttcaagtgaatcaatagcctctcggtcacgcttcatttcgtggaagaagttagcttggcaggggtgaggtccctggaaggcccctgggacgacgtggtgcagcaagcgggtctgccattctggggggtgccttgaccagaaaatcccaaccctgagcactgcagaaggggggcgcacaactagagccggacagacgcgggcttctacaaacaaggaggggcccacaaaagggggcgagacacatcaggaagaaacacataactaaatcgtgagatctgcgccaccacatcacattactagcaacgacaccaaaacgt

SEQ ID NO: 521494 - DNA, 330 bp, Homo sapiens
ggttccataaggttggggggagccctctttccccgctgggctgacctccccccccttaaaataaaaggtttgaacagggtagcctccagagtcctttccatctcccaatttgattaaaaacttaaggccccactatccaaaaaaggtctctctcttaaagggattaccttaaggaattaacatactcccccaaatggtgaatccctccctctctccccccgcacactgagggcaggaactctgctctatttgtttttgtgaaatccctgtcccctagtttgtacccaggaaatgcttgtatgaatgaataaattcgtgcatgtaccttta

SEQ ID NO: 521495 - DNA, 1011 bp, Homo sapiens
  misc_feature (438)..(438): n is a, c, g, or t
  misc_feature (482)..(482): n is a, c, g, or t
  misc_feature (697)..(697): n is a, c, g, or t
acgggcacctcagctttcttacatgtgtgtgcaacctggagggtgcatgtagtgggtgtgtgacgagcggatggctgttaatccctttggtctgttggcggagaattagggtcacaatttgggcacatgtggagcggaggtttttgacgatcttgaagatcctctgccatttgatttgacgcaaatgtgacgacttggccaaggattgagcggatgatctgctgccccgtcgcgccccatatctggaaacaacagtgatggcctcattgcctggaagcgatggaggaatccaatatggctggcaagtagccctactcccactgaccgggatccgctattcttcctgcagcgtgaagacacagcgcatctccccgctgtaggcttcctcccacagaacccgtttcgggcctcagagcgtctggtgagatgctgttgccngctgctgctgctgctacccatgtgctgggcctgtggaggtcaangaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccnaccgggtcaacgatggtgtattgtgactgctgcgatggaacagacgagtacaaacagctgtgcgatcatctgtgatgcacaccatgcatagagcaagggccgtaatgtgagagagcgtccctgcagcagatggccgatggtcacccgcgacgggtaccgtctgactatgatccttattgagggcttggcacgcaggcacgggcggagaagccgcaaaatgctcatatgacacaggctgggaagaagttcttggcagaccatgtggagctgctgtgcctttaaggccgagctaggacctaataaggcaaaacacc

SEQ ID NO: 521496 - DNA, 325 bp, Homo sapiens
  misc_feature (18)..(18): n is a, c, g, or t
ttgccccgccccgcctgngggcccccccccctttgttgtgttttccccgcaatttcaaggataagccttcctgcgggtccctgggccgctctcccccccctgtttttagcccaaacaaacatgagccccctgcttggaaccaccaactgttctggtttctggtcaaagggaggggaggcttttccagccggtgtgggtttccccgtgggcccaaagtggccccctgggcatattcccctgggttttcctttgtgcccccggagcgattttagtggcccccgttttcttcaaaggcttttaaagtaaaggcgttggggggtgggga

SEQ ID NO: 521497 - DNA, 412 bp, Homo sapiens
ggacggatggattacagacttgaacataagaccttaaactatacaagtcctagaagaaaactaaggaagaactctgggatgttggctaggcgaagaatttactgaggaagacaaaaatagacaaatgagactaaataaaactaaagcttcacagcaaaagaaatactcaacagattacccagcctatagaaggggagaaaaggttggcaaagtgataccttccagaaaggatgaacatcagaagtctacacggtaactctaggtaccggggacacaaaacagcttcttttaaaacacctaggcagaggaccatgagacatttctcggaagaaatacacgtgccaacaaacacttgaaaaacacatcactcaacattactaatcatcagagaatggcaatttaaaatcacaag

SEQ ID NO: 521498 - DNA, 505 bp, Homo sapiens
ataaaaaggaatgaagtactgacacgtgctacggcacaataacggtgaaaacgttatgctaagtaaaagaacctagctgcaaaaggccaatagtatccacttatattaaatgtccaaaacaggtaaatctatagaggcagaaagattagtggttgctagagactgggggatagagtggagggtatatgtagtcaggagtttattttcagggtgatgaaaattattaatatttttatttttcatagagatagggtctcactatgttgcccaggcttttctcaaactccttagttcaaatgatgctcccaccttggtctcccaaattgctggagttatgggagtgagccgccgagcctggccgaaaacaatttaaatttacattttggtaatggttgcacaattctgaatatactcaaaatcacttaattgtatgtgataaatgggtggatttcttttggtctgtgaaatatatctcaataaaaaattttttttaagatgaaaaaaa

SEQ ID NO: 521499 - DNA, 385 bp, Homo sapiens
cagagtccaaacagtgctttaactgaactacttatcttggtaaccactgcttggtgttttgtcttcaggattgcgctggtaaagccatgtttcatctcctgttacaatttttcaatgaaaggcttcaagatcctgatcccatttatttaaaatttccattgaaagctctattcttgtctgtagctgatctgggtgcaatggttttggcacctatcaggtttaaagtttgctgaacttttccagtcaaaattgtgtaaggtgaaccaactgaaatgtctatggtgttggctgttgtttctgctgttaattgtgggttttcttcaattacgcgcatgaactaacttttttctcacaaactgatgtggatgatctggcactgtttgga

SEQ ID NO: 521500 - DNA, 222 bp, Homo sapiens
gcacgaggaagtgtatcaatccatcaccagtcaagctgccgcagcctatgcactggtcttgaatggaaaatgtgttgattctgctaaagcttctctgtctttccctgtgtgtgaaaccttaacatctctacatgggaacacgggcccccttcatttggagttgatgtttccagatggctatcctcaaactttgtgttccaataaactctataattaatcgtg

SEQ ID NO: 521501 - DNA, 345 bp, Homo sapiens
tactagtcataaggacaatttataaaatatcaaagagtcccagtgaaccttcactaacagttttagtttctctgtttgtggagacagagtctccctctgttgcccaggctggagtgcagcagggcgatcttggctaactgcaacctccgcctcccgggttcaagcgattcttgtgcctcagcctcccaagtaactgggattacaggtgtgtgccaccacgcccagctaatttttgtatttttagtagagatggggtttcgccatgttgaccaggctggtctagaactcctgacctcaactgatctgcccacctcagcttccccaagtgctgggattacaggtgtg

SEQ ID NO: 521502 - DNA, 232 bp, Homo sapiens
tactaatagttactgatttgttaatataggtttgtaagttgtttttgaaagttaaaatgaagctgggtgtggtggctcacacctgtaatcccagcgctttgggaggccaaggcgggcagatcaaggagtcaggagatggagaccagcctggccaacatagggaaaccctatctctactaaaaacacaaaaattagctgggtgtgatggcgtgcacctgtaagctgagctact

SEQ ID NO: 521503 - DNA, 951 bp, Homo sapiens
ggggagcgcggagtgtggtctggttgccttacaccggttacttaagcgcggacggggcgtgtccttggactttaaagagtggggacgtccggttcggagcggggagtgttcgtagtgccagcgattactccgatgaatgaacattatgggtgatgttgtgagaaaagtgctaacgaaggcattttatctaatgaagtgtcccctaggtgcctaccaccctgtttgaaataagtgggatggcaaggcacaacatgagcgtgggggacaaaatctccatgcgtgctcttctgggacgggaaggacagggctcagggccccctggattatgtcttacacgaagctcggccacaataagaaacagaaggcgcagtcatcctgggggacgccggaattacagctgattggacgatacttgtggaggaaatctcgccaagaaggttaccactcgcctgggaaaacgaacaatattgattgcttctgtgtccggcgcttgtacgagaaagaagcggaacgaacaggggcagacttttagatacgtttatctcaagaaaacaagctacctaattggaggtaacttaagtttggggccgattgccctttattttttttttaccaagaactaggtaaatggtcttcaagggagcgttgttataatggttgtacccatggctgttattggagattcctcgataagaagcaagaaatgtcagatcatggaattgacttgaaaaggaatatttttggtgtggggcaatgccctggttttaacaacttaaagacgaggggtgtgtggttcaaagtgaactattggtccaggtttgggagctgtgaatgagttacttccacagtgcagtaaaaggggtatctctggtttgaccccttttttaaaggatttgatgtggagctcgctagaaaaggtgcactttttcaccaggaatgggggggggcaac

SEQ ID NO: 521504 - DNA, 139 bp, Homo sapiens
ggtaccgcgtgatcggcggcatggccggcaggcgtgcgaataggcgccgcgcgaaaagggatcgacgccccaactgctggcggcgaggggctccagacgtttgcgcatgttcgagcccagggccgcgaccagttcgctg

SEQ ID NO: 521505 - DNA, 222 bp, Homo sapiens
ggtcgaccgggcccagggcgttttcgctgccggtggggtaggtcatctgcacgttgacgttcatcgggtgcggcgcccaggcaagaacaccacggcttccttgcgccgacgcatccaccgccgagagcatggccgcttcactggattccaccagttggaacttgcccaggccgaactggttcttggcgatcatttccttgatctgggtgttggcgcccgagc

SEQ ID NO: 521506 - DNA, 215 bp, Homo sapiens
ggatccccatgtcatccccaacacctaacccctggcaaccactgatctttttattgttttcatagttttgccttttccagaacgtcatctagttggaaacaagggtgtgtatccttttcaggttggcttctttcacctggtaatattcatttaaggttcctccatgtcttttcatggcttgatagctcatttcttttagtgttgggcgataaata

SEQ ID NO: 521507 - DNA, 619 bp, Homo sapiens
  misc_feature (5)..(5): n is a, c, g, or t
  misc_feature (7)..(7): n is a, c, g, or t
  misc_feature (11)..(11): n is a, c, g, or t
  misc_feature (20)..(20): n is a, c, g, or t
  misc_feature (31)..(31): n is a, c, g, or t
  misc_feature (40)..(40): n is a, c, g, or t
  misc_feature (395)..(395): n is a, c, g, or t
tattntnaganatctaaaangaggatactancttattttntttggtcctatttttaatttaggggtaaacaaatttgggaccctttaaaattttgcccacgggggaaaaaggaacacaaaaggaaggtggggtccaaaaaactcttgggctttgggggggcaacccaccccccccactctttttgtgtggggggcgcgttataagacgcccccgcgggtgaaaaccaggaccccccgggaagtgtttgggggggaaaaccccccttttccacaccagtttttaaagaagagggtgttttttttaaaaaaaaaaaacacaaaaccccccctcgcgggggagaggattttttttttgaggagagaccgcccctttttttttttttttttttataaanaaaagaacaaacaagagggttgtttttttttttgggggggagggaggagaataaaaaaaaaatattttgtttgggggcggacccccacacccccccttggtggggggggagggggcaaccacccccccccgcgggggggcccaccccacccccgggggttatttttttttttttttttttgggggcgcgcccccaaccccccccccaaccccttttttggtttt

SEQ ID NO: 521508 - DNA, 309 bp, Homo sapiens
aactcaggggcgagctgctgtggtgccagctgctgcctcttcgggagcctccaatacgcctgccgagtctgagcccactggcgatccacgtgggcccagtctacatcgccaaagcccttttgctgaacagcatgttcaatttcagatcttctacttcatcatcatcacttggcaaatcaccacctatcaaactgctcgccctttagttgctcacccctctggaattcaccatcatcgacatagctgtcctctgcggagctaacccctgccgagaaaaccccggccacggtgatggttgtttccgggggg

SEQ ID NO: 521509 - DNA, 162 bp, Homo sapiens
tttcaaccccacgatcacagctgggctggacccagtgcaggagaatccagattaggacccggaggactctcacatgggcacctaggcaaacgatctatgccatgacaactgtagggacctgactcaaaggctgctggtcagcagcctcccaggatagggaag

SEQ ID NO: 521510 - DNA, 111 bp, Homo sapiens
gcttccgaggaagctaaggctgcgttggggtgaggacatcaacttcatccggcgactagcaccgcgtccggcagcgcagctcctaacactcgaccagcgcacatgagcctc

SEQ ID NO: 521511 - DNA, 356 bp, Homo sapiens
tgtggaactgtgaatccattaaacctctttcctcataaatcgcccagtctcaggtatgtctctattagcaacataggaacagactaatacagtaaatttgtaccagtagagtggggtgctgctgtaaagataaccaaaaatgtggaagcgactttggatctggaaaacaggcagaagttggaatagtttggagggctcagaagaggacaggaagatataggaaagtttggaacttcctagagatctgttgaatgactttgaccaaaatgctgttagtgatatggacaatgaagtccaggttgaagtggtctcagatagagatgaggatcttgttgggaactggaataagggtaact

SEQ ID NO: 521512 - DNA, 139 bp, Homo sapiens
ccaaaacaagaagtatttccataaggggatatggatgtcttcctcaatccattattctctcttcctcccacggcatccacagaacaggatttaccagtcccattctttttcttttcttttttttttttggcagactgtt

SEQ ID NO: 521513 - DNA, 122 bp, Homo sapiens
  misc_feature (58)..(58): n is a, c, g, or t
gccttaaggccgactgtagagaatccccccggggaatcgcacggaggtggtgaccccnctcatggtggccgacaccaggtggttgaggtccccgtgggtggttttcagcagcttgagggtgc

SEQ ID NO: 521514 - DNA, 238 bp, Homo sapiens
caccttatatatttttaaggtttatccacattgtgggatttattagtacttcattcccttttatagctgcataatatatttgtttatctatgcatccattgatggacatgtgaattgtttgcaacttttggctactgtgaatagtgctgctgtacaagtgtttgtttgaataccggttttattttggtaatatacctagtactcatataggcattaagaataaattataaaaacaggt

SEQ ID NO: 521515 - DNA, 572 bp, Homo sapiens
aagatgcgtggcacagccgtgcaactcttctagctagtttaaggctacataatcttatggctaatcaaccagcagcatacctatcactctccaaaattgataagttaatacttatggacaaaaaccactatggagaacttagcattcaaacagacaagagtcggccaggcgcaggggctcacacctgtaatcccagcatttggggaggccggggtgggcggatcatgaggtcaggagatcgagaccaccctggctaacacggtgaacccctctctctactaacaatacaaaaaaacccaaaaaacaaaaaacattagccaggtgtggtgacgggtgcctgtagtcccaactactccggaggctgagccaggagaatggcgtgaacccgggaggcggaacttgcagtgagctgagcacatgccattgtactccagcctgggcgacggagcctctgtctcaaacaaacaaaagaaaacatacacagacaagagtcaaatcaagtctatgtacatattcaaatattcacatgtggacaagattaaataagctttctaaatgatgagttactaaag

SEQ ID NO: 521516 - DNA, 108 bp, Homo sapiens
cgaactctcgaaacgttgtgcagacggtgacggggggcacgtcctgtcacccaacacggggctggactttctttcctgtgcaggctcagccgctacctgggaatgtgg

SEQ ID NO: 521517 - DNA, 967 bp, Homo sapiens
  misc_feature (11)..(11): n is a, c, g, or t
  misc_feature (17)..(17): n is a, c, g, or t
  misc_feature (117)..(117): n is a, c, g, or t
  misc_feature (439)..(439): n is a, c, g, or t
  misc_feature (454)..(454): n is a, c, g, or t
  misc_feature (780)..(781): n is a, c, g, or t
gggtaacccgngagtgnatgagatatttttaatgatggataaaacaccaatttgatgtgtagtatatatatttagtataaaatgatgtaatatttttttatttattgggtagttggntaaattaattaaatagaaagaagagtaacataagaacaaaaagaaccactcaaaaatttttgatagaggtggtttttagggagtttatatgattaaattggtttaatagaatattgatatcattaatgttgttatcattatggggtgggggtgaggtgtggtgattcgtttgtttgacggttatgaagtacagtgcaatactacacgataaagcacatggaccagaagataaagaagaatacaaaaaactatcaaataaatatagcttgcatgacaagagcgaatcccagaccagagtggcgtcaatctgacccggcaattntcagtgagcgcggtncctgttccctctcatgtcatcagccctcctcagctcctcccctagttccaatatacctaagcttcccctatactttgaatcattcaacatctttcatcaccgcttttatctcacacggtccatcattatatcgtatttccggcaaccgaactcacgccgctctatcaccccatcaacccacccgaacgaaacctactctacgcaccacactccgatctattcactccagacccacatacagctcccactggcacaagaaaacgtatcagacgagtatccaaatacatccttccctagatcaactttgacccaaaagtaataagtannaaataaagcacagagctcttaagcaacgcccctcatacccaccacgccaacttccaaaggaacccatcgctccgcgatacaagcacccgatcaatgaccctagatgctcgcacgcgaccctcatcattccatcagagttatagtcgatatctcttaattactccattccaacacacaccgccacct

SEQ ID NO: 521518 - DNA, 264 bp, Homo sapiens
  misc_feature (237)..(237): n is a, c, g, or t
aagctggtctcaaactcctgacctcaagtgatccacccacctcagcctcccgaaggtgctgggattacaggcatgagccaccgcttcctggccaagatgaacagttttgatgcctcttcaaacaggttttctgtaataggggcctgtagaaatatggtggtcattagtggaagtgcatggacgacgagtaggtgtttctaaatgatgggagacaatgacagctgtgcattgtgtgcncgatggagagtcaccccattagagaag

SEQ ID NO: 521519 - DNA, 256 bp, Homo sapiens
ccgccttagcctcacaaagtgctgggattacaggtgtgagccactgcacccagtcacatgtcgtattttaaaagggatttaaaagtatcattggattgtttgtaacacgaaggataaatgcttgaggggatggatacccattctccagcatgtcatgattacacattgcatgcctgtatcaaaacacctcatgtaccccataaatatatacacctactgtgtaccacaaaaattaaaataaatggagggtgagaag

SEQ ID NO: 521520 - DNA, 482 bp, Homo sapiens
  misc_feature (221)..(221): n is a, c, g, or t
ggccggggaggtctctgtaccatggctcgtacaaagctgactggcctcataaagaccgccgaaaaagcacccgagaagaaaggggctataaaagcaggtcgcaagatagcgctctcaacagaagggggctaaaaaccccttaggaaacatgggctatcaaagacaattcattcccgcctttgaagacgaacacaccccccacacccgatatccccatcganactcaccgccccgccgtcttcaccacaatccccccaattagaccgttcttcaccctcacgcccatttctcccaacccaactccctcctatcgccacactctaacaccacccctcccccctcaactaacaccaccccaccgaccttcatcctacgccctcgacacctcccacacaacccctcaccctccccccgcccacccactccaccccgcccgcccacacccaacaacccgcccacaccacacacattccacccacccc

SEQ ID NO: 521521 - DNA, 167 bp, Homo sapiens
gagaagggtcgcctcggtgcccagggcccaccaggagctccaggcccactctggattgcttgggatcactgtagcacggggtcttgcaggaccaccaggcatgccaggtctaggggaagcctgccctcaggtgtcagggtgaagtggaaccagagctacgtttcagt

SEQ ID NO: 521522 - DNA, 163 bp, Homo sapiens
gaggacccgtctgtgactacccatcagaaactactactcctccaatcttgatacagccaggtgcatggcaagtgtttaattcgactatacactgactaattaaaacaaatatatttgcgcttagtgattactgtattcatgagttattacattcgagtaaaaa

SEQ ID NO: 521523 - DNA, 426 bp, Homo sapiens
catacatgtgcgatgacagtatggaaaagaaacactgaggaggaacatggagccaggcacccagaaaatgcgctcaggaacccacagggtgatggtggcacagccaggaaggagcagaggggaaacagacaaggggacagattccagcgacatttaagaggcagaataaaagcgagctagtgtgcaactggacgcgagaggaacggaggggcccaggaggatgcagatctccagcttgggcaactgggagcgtggtggacaggtcactgagatgaagaacccaagataacaatcagacttgaagataaagctcatgagctgattcttaatagtcacagaattcccttaattttggcctttttttcccttccaagactccccagactttttttttttttttttttttttttttgggggggggggggg

SEQ ID NO: 521524 - DNA, 516 bp, Homo sapiens
tgggttattaagtcaaaacccaaaagccccctaaaaaaaggggttgatgtgaagttccgcctttagggtttccaagcccagccccaaccaaccacattctgggatggggtttgttacttccaggcccgggacttccttaaaacccttaaagtgggagaaaaaaccttttttttccctaaccactgcaaaaaacccggccttcccgggctcattaaaattgtgaaaaaggctttccccggcccccccccggtttagaaaaaccatccccctttttgcccctttaacaaagagggccccccctaagggggccctgaaaagttttattttttttttagcccggaggaaaaagaacccagtttacttagaatcttctgctggaaagggggaaacctttctgccaaaaaatccaactttttttccaaccaaaagggttagggggcctgcctgggatgctttcccggggttggggacccccgtgggttttttgggcctttttccataaaaaatccaaattta

SEQ ID NO: 521525 - DNA, 665 bp, Homo sapiens
gctgagggccagagggctgagtctccatggactatctttctgtttctcagctaatctcaggggcgatataatcaatgaggtggtcctaaagttgctcaaggctggatggtcccgggagagaaattactgatggaacacctggtagccccggatgctccaggacggagattgtagtgcacgtaccatagacaatggctttggcacacagtcgtcttggtgaaggacacacacctgagttgagctactgtcagtccccttcctgcctttggagtaccgtcagcgtgaggctgtgtgcacgggatgccttcctgagaccaggagctcctgatataaagaagagacactggatgaaatagtccagatgatggtgtatgtccccaaggatgaacaactcttttcttcccaagggctgccaagatctagtggtatcccaggaggattaagctagcttcctgtcatgaaggctagaggaagacttcctggaactgcctttcttccactaacaggaccctgggacctgtaggagacaccccgtttgggactgtgaggtgtttgagggtgtggactggcatccagcagcactaatcagacatcacaatggtgtgtgacaaggcaggccttacattagaagtcaagccaatcctttatgctgtcgtttggaggtc

SEQ ID NO: 521526 - DNA, 259 bp, Homo sapiens
acatggcgtggaagctcaggggctcgtacggagagatgggcatcaagctgcgcacgatgcggtacttgcgaaagaagagatgaggcctccgctggggcaggctgaagggcaggtagtggtagcgatactgctgcttccgcctgaagaacctgtcctggaagagctcgactatgatgctggacgcgcgcatgaagtgagcctgcatgacattcagcacgtgcgtctgctgccgaacgatctccatagcagttgggcaggg

SEQ ID NO: 521527 - DNA, 141 bp, Homo sapiens
tattgagtggccatgtgatgctgtgatattcagcccagctgtcgctttatcagtgctatatttatcttggaatatagaggctccttttacttgtttttaagtgtgctttgctgctaagtgatgaacgatacaagctcctca

SEQ ID NO: 521528 - DNA, 157 bp, Homo sapiens
aaatgtactgggcctggtgtcacaggtctgtggtcccagctgctcaggaggctgaggtgggagagtctcttgaccccaggcggtcagggctgcagtgatctatgattgtgctactgtacaacagtacagagcctgggcaacagagagaccctgtctc

SEQ ID NO: 521529 - DNA, 114 bp, Homo sapiens
  misc_feature (46)..(46): n is a, c, g, or t
cttgcagtgaccatcaagtgaatacgaagagagctcttcaccttgnacacttcagttcatcctcagaggagggaagaacgcttccaagaggcataagagactgcctcgccaaat

SEQ ID NO: 521530 - DNA, 906 bp, Homo sapiens
  misc_feature (13)..(13): n is a, c, g, or t
  misc_feature (29)..(29): n is a, c, g, or t
  misc_feature (47)..(47): n is a, c, g, or t
  misc_feature (51)..(51): n is a, c, g, or t
  misc_feature (58)..(58): n is a, c, g, or t
  misc_feature (70)..(70): n is a, c, g, or t
  misc_feature (80)..(80): n is a, c, g, or t
  misc_feature (96)..(96): n is a, c, g, or t
  misc_feature (98)..(98): n is a, c, g, or t
  misc_feature (101)..(101): n is a, c, g, or t
  misc_feature (108)..(108): n is a, c, g, or t
  misc_feature (116)..(116): n is a, c, g, or t
  misc_feature (119)..(119): n is a, c, g, or t
  misc_feature (125)..(125): n is a, c, g, or t
  misc_feature (129)..(129): n is a, c, g, or t
  misc_feature (135)..(135): n is a, c, g, or t
  misc_feature (141)..(142): n is a, c, g, or t
  misc_feature (145)..(146): n is a, c, g, or t
  misc_feature (152)..(152): n is a, c, g, or t
  misc_feature (173)..(173): n is a, c, g, or t
  misc_feature (203)..(203): n is a, c, g, or t
  misc_feature (209)..(209): n is a, c, g, or t
  misc_feature (211)..(211): n is a, c, g, or t
  misc_feature (214)..(214): n is a, c, g, or t
  misc_feature (217)..(218): n is a, c, g, or t
  misc_feature (221)..(221): n is a, c, g, or t
  misc_feature (227)..(227): n is a, c, g, or t
  misc_feature (229)..(229): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (244)..(244): n is a, c, g, or t
  misc_feature (250)..(250): n is a, c, g, or t
  misc_feature (253)..(253): n is a, c, g, or t
  misc_feature (261)..(262): n is a, c, g, or t
  misc_feature (266)..(266): n is a, c, g, or t
  misc_feature (275)..(275): n is a, c, g, or t
  misc_feature (278)..(280): n is a, c, g, or t
  misc_feature (285)..(286): n is a, c, g, or t
  misc_feature (298)..(298): n is a, c, g, or t
  misc_feature (302)..(302): n is a, c, g, or t
  misc_feature (317)..(317): n is a, c, g, or t
  misc_feature (319)..(320): n is a, c, g, or t
  misc_feature (326)..(326): n is a, c, g, or t
  misc_feature (328)..(329): n is a, c, g, or t
  misc_feature (334)..(334): n is a, c, g, or t
  misc_feature (360)..(360): n is a, c, g, or t
  misc_feature (378)..(378): n is a, c, g, or t
  misc_feature (385)..(385): n is a, c, g, or t
  misc_feature (389)..(389): n is a, c, g, or t
  misc_feature (415)..(415): n is a, c, g, or t
  misc_feature (451)..(451): n is a, c, g, or t
  misc_feature (540)..(540): n is a, c, g, or t
  misc_feature (758)..(758): n is a, c, g, or t
  misc_feature (764)..(764): n is a, c, g, or t
  misc_feature (900)..(900): n is a, c, g, or t
tgcttttattgtnaagtcctatagtcgtnggtggtcttgtggttgtntgtnttctgtncccatctaggtnctggctggcngcatgtatcacccctntngcntcattantgttaggngtntgggtncatnctggtnagctgnnccnntgtganctggggcagataaaatgccantttcattgttacctcttttacccctccttnttaggntntcnttnnttnccagantnttantgantnctcantccctnttntggttttnntttnttttttttntannnttttnnttttttggggantttntgttcaagatagggntnntttttntnnttatntcgaatttgaagagattgctgacgcncgagagcttcgctttttnatccttntttncttgttcagcaggctagacagtaaanatgttttgactgttagttgtccacaaatcttcagtnttttctccacttcatttttaagaaaggaagcaacagatagatgttgctctttcacctgggtgtttgggctcaagctttcccgcccagcntcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtntttttncaaatacatgtgtatattccttttaaagaagctttatcgaacgtggtctgattttgaggtttagcaatagctagctatatatggtaggtgccgctacagtttttatttagcatggggattgcagagtgaccagcanactgga

SEQ ID NO: 521531 - DNA, 279 bp, Homo sapiens
cgactctagaggcacccggatcattcagttcattcattcacttgcacttataccaaagggttattgaacatttaaggttaaccatgaactatgctaggggccgaagcatacaaagatgactacgaaaagtcatacctcttgagtgaggaaagaaagaagtgtagataatgacagggcagaaagaattatacccgaggtagtccagggtgcatgaaaatacaggagcaacaaactgcctcattgtagatctgtttgttatttaagaggacactaatgatt

SEQ ID NO: 521532 - DNA, 357 bp, Homo sapiens
  misc_feature (108)..(108): n is a, c, g, or t
  misc_feature (161)..(162): n is a, c, g, or t
  misc_feature (215)..(215): n is a, c, g, or t
  misc_feature (225)..(225): n is a, c, g, or t
  misc_feature (237)..(238): n is a, c, g, or t
  misc_feature (281)..(281): n is a, c, g, or t
taatagcacagctggatctcatagctgcctctgcattcaagtgtgcagtgatgttgtctagttaacagcatgggggacggggtgggggtggatgtggtctcacacagnatacacatggaaggtagcgagttctatttttaaataaatttaaatgtctttannataaacttatgtttataaaactaacgttctgaaactaattttcagacttacangaagtttcanaattattcttcnnaccctgctcccctaatatgttaacatttataaacacagtacanattattggaaacacaggaaacaagtagtgtttattaacatactctacagatcttattcacatgtcaccagatttcg

SEQ ID NO: 521533 - DNA, 129 bp, Homo sapiens
gcaaaaaggcagttgtgagcaaaccagaaacagagccctccccagaccccaaatgggttttgccagccccttttttttggacttcccagcctccagaactgtgaaaaataaatattgttttttaagcca

SEQ ID NO: 521534 - DNA, 84 bp, Homo sapiens
atgccatggtcatggatgaaaaggtcaagacaagctttgtgctggacacgggtgctgccatctgcaactacaatgcccactaca

SEQ ID NO: 521535 - DNA, 265 bp, Homo sapiens
gacttgaggaccccgggagtagtagagagggaagaaactgaagcaatgtactctaaggagaggaagatgaggaagacatgaaccctgcctaacaggaaccgaagtgaaagtaaaatattgacgagggaagactcagaaaatttatgaagcccgtattaaaaggcactgaaattgatgacggagaagttttatatttggtacatttactattgattgaatggtcggtatgatgagtgggttgaaggctgacaggataatctgggct

SEQ ID NO: 521536 - DNA, 399 bp, Homo sapiens
  misc_feature (188)..(188): n is a, c, g, or t
tcgtaggtgttagaggtgtctgagctctgttggcaggggtggtggtggtggtggagtaggaataggtgttggctttggtgtaggtctatgtgaggcttagaagtaggcctgttggtaatgataggaggaacatatggtgtcttcggaggccaccaagtacttccaacatcaggaatccaattattatntcctgtgtcaccctttaaaatggtaccatttccctttggtacatgaattgtacctgaaggttcaatcataacttttgggatatacacacaagtcagtccatcaccctggtatccttctttacatttgcacttgtttggcccgatacattcaccacgtttgcatcgtggttggcacacaggctgacactgtccccaagactggcgagcccag

SEQ ID NO: 521537 - DNA, 169 bp, Homo sapiens
tccgctctccatcttatatgtattctaaccaggaggggagtgatagcacatgggtagcctaggcagtgagtaaatacctcagatgtcctcctgcagcaagtgtgtatatgtgtggttatttctatcttacatgtctcgaatgttatattcaataaacctctacctcttc

SEQ ID NO: 521538 - DNA, 999 bp, Homo sapiens
gagaactagttcgagtatttttttgttttttataagataattagtataaaaggggaaataggtaggagtaccgtggtaagggcgatgattgtggggaggaatggggtgggttggtatgtccaaactgtcatttattttacgtggttaaatatggggagtatgtgatgaggtggagtagatcaggcgtaggtagaagtagaggtaaggagggcgatgggggctatgatggtggggatgatgaggctatggttttggtgaatccttcgataatggcccatttgggcaaaaagccggaaagcgggggcaggcctccatagggacgaggaggccggatgcaatcacgggctgtcagcatgtcagctagtccaggtcgcgagataacacgtcgggccgcgagggcgggagtaaaaaagtgcgagtagacaggaacggcgcgacgaacgacaggccaatcacactcacaccagctacaacacccacaaaggccactgtcaagggacgcaccaggcacaaccgccatcacaccaatccctatgcgggcaagacacagagcaacatacacagcacaaacactaagcgaagacggcataccgcacaaacacaccccaacaccgcccgcaccacacacacaccacacccaccactgacacaaccacgcaccgcacccaaacgaaaaatcggcacacaataaccaaccgcacggtcacaccacgcatcgagacgagcaagcatcgggtaacataactagagaccctagaaccccggacgaccagaaggaaacaggagaacacaacgcaggccacaaacgccaaccacaaccaagcacccacatacaagagacaaaaaccaacctaaaccaacgacgaagaacacaactctttctatacttagaagtcgacctacccaaaaacgaagcccgaacaaagcagacacgacatcaacaccactagaaccaagtcagtacgaacaggacacgaaagacgtccacgcccccccccc

SEQ ID NO: 521539 - DNA, 562 bp, Homo sapiens
agttccttcctacccccttttatagcctcccgctccaataataacgggatatcacgcagcgtgtggcagtatcgacgttatatcgatcatgatcagagggcaattgcatatccaagctcgactacaggcgccttgaaccgaataatgctccactgttcaagggcgtagttgagccattgatccctctcctcatgctaggtcctatggtgtgatcttccacatcgttcagcttgctgcggtctaacggaatggactcttactctaccaagcatatggacgggcaatcattcagctccggtcatcgtcgcttttgaatccacggctcagccaagcctgggacgcggagagagacctctttttctatggctttgggtctaggaaagtttctgggcttttcgaggaaagtcgtcgtttggacacatgccatttgttgttttttccggagaaagggtcagacagagactgtatacagagcaggcgatttccattctcccgtatgtccgatgccacggatggtatgcatattttccgggccagcctcacccataggatttttattctc

SEQ ID NO: 521540 - DNA, 701 bp, Homo sapiens
ttctagagcaatcgctaggcgcgcgggtcctgtgatgtcagtgaacttggtcatagctgtgtcctaggatgatcttgtttcttgactatgtgctgtggattctcaccatgtacatataggcccggtcggtcaaccagtagcgtactgagactgaatattccgacgaatgcgcaggttgcatgacgtgctctcttactcggtactcttactctacggcgatggtagtccttacagtgcgagtgctctgatcatcaagaaagttaccgtaccacgacccctgcattgaaagtgtgcacatcggacgatcaggcaaggaactgatactgcctaaacaagagtcaattggtctgtgtgggctccaagactgtgcgcctgaggatcgattgagccgcagtgcaagaaaagacgattcagccggcgtcggtggatcccatggatctcatgaaagattcaaagatcttcgcccacgccggaagctgcaagactaatcgagtgttggatcaggtcgggcctccgtccctgggtccatctggtggatgcaccattccaagcacaatgtcggatcaccaaatacaggagtaccgattgaggcacggacccttccatcttgttccaccgcaatatggcatatgttagacacactcccaccctcctatgaaagagcgacgttctcaaggacagaagcaatctacttaatgggg

SEQ ID NO: 521541 - DNA, 379 bp, Homo sapiens
  misc_feature (32)..(32): n is a, c, g, or t
  misc_feature (43)..(43): n is a, c, g, or t
cagtttcctccccttttttagactatataggngtaacttctgngatgttaccctatacgttaccctacaaataccaccatggcatttgtaaaccgtcatggtgctggtgggattgtcttttagcatgctaatgcattataattaacatgtaatgaggagtgaagatgaccacaggtcacttttgtggccatcttggttttggtgggttttagccagcttctttaccgcaacctgtcttatcagctaggtctttatgacctgtatcttgtgctgaactcctatctcatcttatgacttagaatgtctaacgtcctgggaatgcagcccagtaggtctccaccttattttatccagcctgagcgacagagcgagagactca

SEQ ID NO: 521542 - DNA, 492 bp, Homo sapiens
  misc_feature (451)..(451): n is a, c, g, or t
ttgctcgttatcgtctcccataaccaatgggaagagtcctctagggtactcaacatactttctaaggctggtgagactggctggcaggaatgaggactccatggcacacgggatgtgtcacatactcgcctactattccttcaaccaagggtggcacagtcctgctatccttcaccaagatggcaagtatctagatgttcacagcaggctgagctaagcttttggcaacaggagctgggatcttctcctccaggacttttccagagaaggcagtctttaaccctgtgaactctgctgggtctctgtcacgcagcatccatcatcaagatggtcagctacttcctggccgggcgtggtggctcaggcctgtaatcccagcctgaggaggctgaggtgggccggatcacttgaggtcaggagttcgagaccggcctggccagcatggtgaaancccatctctactaaaaataccaaaattagctgggcatggtg

SEQ ID NO: 521543 - DNA, 114 bp, Homo sapiens
gagcgatgggcatctctcgggacaactggcacaagcgccgctaaaaccgttgtcaagagaaagccctaccacaagaagcggaagaatagttggggtcgccagctgtcaacacca

SEQ ID NO: 521544 - DNA, 291 bp, Homo sapiens
tcggcagaaggctcacaggttcacaggtcattccccaaacccaggaaagggaatatgtctttcccatcctcagtgacatgaagcaaagagaatagcccttggaaaaataatttttttttaaacttaaaaaagaaaaggtcactttccttaagggttaaacaaagtaggctatcaggaaaatctagaaggttcttcccctcagccatgaaaacggctcaccattttctgtttctggcaagctttatcccgagccccaccgggggtctctgataagagatactttagaaaata

SEQ ID NO: 521545 - DNA, 674 bp, Homo sapiens
  misc_feature (79)..(79): n is a, c, g, or t
  misc_feature (103)..(103): n is a, c, g, or t
  misc_feature (108)..(109): n is a, c, g, or t
  misc_feature (119)..(119): n is a, c, g, or t
  misc_feature (145)..(145): n is a, c, g, or t
  misc_feature (164)..(164): n is a, c, g, or t
  misc_feature (271)..(271): n is a, c, g, or t
  misc_feature (331)..(331): n is a, c, g, or t
  misc_feature (366)..(366): n is a, c, g, or t
  misc_feature (671)..(671): n is a, c, g, or t
ccagctctgcaccttgattgtggaagctgagcataaaccaactttaaaaaatcagttgtttgtgcttggtttttaaatngggacaggatcggtatagtggctnacgcnngtaatcccancactttgggaagtcaaaatgggtggntcacttgagcccaggagtntgagaccagcctgggcaacacggtgaaaccgcatctctacaaaaagtacaaaacagcaggcaaggtggcgcacacctgtagccccagttactcaagggtcttgaggnggaagatccctcaagcccaagaggtcaaggctgcagtgagtcatgatcacgccatgccanggcactccagcctgggcaagacagtgagaccccgnctcaaaataaagtaaaatataaaataaaaacagcaagtgggaactcagcattcaagttaacttgtagagctacccagctgctaagagcagtgtgatctttggtgctcttaggatcactttggtatctgctcattttcctttttgtctaccctataaagcacaaaatcgagtgggtaaaaagtatgaaaccagcactgtttctactttcttagaggtctggtatctagtgagcaggctgaggcctcaggactagttcagtgttaaggatttcatgttgaaactcatttcctcgtgccaagcttgangta

SEQ ID NO: 521546 - DNA, 225 bp, Homo sapiens
gtcaaagcctggaaaaaaagatcggtcaagatcacacagtttaggctgggaatagtggctcaagcttataatcccagcacttcagaaggccacaggggttcatactgtacaaggttgattgctcatttacaaatttctcaatcaacagaattcaagaaatattaaaattcttacatttaattcaacatgtgccgctattgttctaaaaaccgagaagagacatgc

SEQ ID NO: 521547 - DNA, 269 bp, Homo sapiens
caggaccggagtaagggtgtgccacagattctggtcttgatggcgaatgcaggagcgatgacataccgagtcactaactcgtccatcatgacgagtttatcccgatgtccgagttgcacgcgtcgggatcgaatctcgcttcgggggcacacctgggcgggtcgccctggctgttcggcttcgccgaccgggtgttctggccgcacctgctcgtcggcgccatggagatcggcgccgggctgatgacccgcaccgtgcccgaggacggg

SEQ ID NO: 521548 - DNA, 725 bp, Homo sapiens
gttaacattacctattgtctagccaagagcgggggtgggaggggaatccacactgaagggagtgccagaatcaaatgcgacatagtgcgaaaccacaaaagaaggcgtttttccagaaaacaagtgtattcacacgccagtctcagagactatttagaccaagttcaagttaggagcttttaggaagtgggagtaaaactttaatgggaggggagggctggctgctggaagaaggaagaagcccagactggttagacaggactcttaactcctagccccagcctagcgtgccctgcccctttggcccctgctgcagacacctgccttacacacacaccttctaggactccaccagttttgccctaaaggaccttccccagtgctccccttccccgtctggcgttttcccttatagaagagagagatacttgtagaattgggtggggggaatgagcatgaacatgtccttcccatttgggatatgttacaatagagtgagagagagataaggagccttttttatggaagaaatgggagaagagagaccgggttctttttcagccagagtctagtagtttctctgtaaggccaaataattttaaaagacttacctgcccacccactccttatattgctgtgagattgcccctattttgtgcttttttgtttgcagtgtgcaccggccttgttttaacccggaattaaggtgattgattgtattgcca

SEQ ID NO: 521549 - DNA, 188 bp, Homo sapiens
atgcatgtgttagatgagaacgatcagtaccctattctttatcagcggatgcccctatctagaagatacctacactactctgggatgtgcatctgaggtagatctgagctctgtgttctgcttccggaatactgtcttaacttgcctgtaatttgcaagaagagttgctaatgaaacgtttagctggt

SEQ ID NO: 521550 - DNA, 427 bp, Homo sapiens
  misc_feature (213)..(213): n is a, c, g, or t
aaaaaaaaagataaattggagaggcccatttcctgatagtccacacccgttgcactaaattaacagtgttaattgaatgcagacaccagggagaagcaacttcctgggcatgtgcattaagagacaaaatggcggagtatgactttccagggttactccaccagaatagggaagaaagtctcagatgggcatgggtacaacttcttaaacacntgcgcatgctcacctccaacgggtgaggggggtaccaggcatgcgggcagcccaccctaagggaagaatcatgagaaaggggccagcctataaagattactgttaaacagagcgcttgacctcagtgcctggttgggtctcttccaagcatactttcctttccttttttatcctgttctaaagccttttaaataaacttccactcctgctctga

SEQ ID NO: 521551 - DNA, 120 bp, Homo sapiens
  misc_feature (20)..(20): n is a, c, g, or t
ctccgttatggacgggttcnttctacctacttacggaccttttctgcttcgacacgcgacacggcttctcaacactcactgacaacacttacttacactacttacctggcgtgttacgac

SEQ ID NO: 521552 - DNA, 187 bp, Homo sapiens
  misc_feature (48)..(48): n is a, c, g, or t
  misc_feature (89)..(89): n is a, c, g, or t
  misc_feature (139)..(139): n is a, c, g, or t
  misc_feature (147)..(147): n is a, c, g, or t
  misc_feature (182)..(182): n is a, c, g, or t
cgtggactggagcaaaggaaagggaaacaaggcccaaccccaaacagnaaaacaaccccatgagggaggacagtggagcatcaggttanaaccatagaaaaatacgagttatttctatcaggttaaccattagggtagntacagtangactctgtacagaaaagcgttttcttgtcgccccncacca

SEQ ID NO: 521553 - DNA, 305 bp, Homo sapiens
tgcttatccccgactctggcaagctggaggaaggcacctacagctgcctggccaccaatgagctgggcagtgctgagagctcagtggacgtggcactggccacgccctgtgagggtggggaggacacactggggcgcacgttccatggcaaagcgtgtgagggaaaaggctgctatgcagttgacaactacgtgcaagcatcaaggccggaggacaatggggacatcatatacctccacccctctgggaaccctgaggctgctgtcgcagaatgggtccctgggcaagtgtccccaggcctgctc

SEQ ID NO: 521554 - DNA, 706 bp, Homo sapiens
  misc_feature (637)..(637): n is a, c, g, or t
tcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctctggcaaccactttttactgtcgccatagttcttccttttctagaatgtcatatnggaatcatatagtatgtagccttttcagactggttctttcacttaataatatgcattaagttctcatgt

SEQ ID NO: 521555 - DNA, 225 bp, Homo sapiens
tacgatctcctcttctacccatttctgtcatctcttagctgagtttcctcttctaaggcagaggctggagcagttctttatcagttctcatcctctccatcccaatccggtatatcaatcaactctaactcgaatacgtctagctggcaatgtttctaaaactttcactgggatttctttagaactttgaagcaaacacatgtctaactcggtggatcctctaga

SEQ ID NO: 521556 - DNA, 350 bp, Homo sapiens
tgcttcccttcaagaggtagagtctagccaggtgcagtggctcacacctataatcccagcactttgggaggccgaggcaggaggatcattccagcccaggaattcaagaccagcctggacaacatagggagacccatctctacaaaataaaaaaattagcccagcgtggtggcacatccctgtagtgccagctacttggggggctgaggtgggaggatcactctagcccgaggttgaggctacaatgagtagtgatcgcaccagtgcactccagcctgggctacagagtgagacccagtctcaaaaaagaaaaaaaaaggggatcaggaatggcggctcacatctgtaat

SEQ ID NO: 521557 - DNA, 918 bp, Homo sapiens
  misc_feature (307)..(307): n is a, c, g, or t
ttaaggggcccctcgcacactgggcccgcacagttcagcccatatccggaccaagggtggaacgagtccaaacaatgggggaaaaatcggtcagaaccaacaggttccggggaattttttcaccatggggggcaccaatcctggtaacaacagagaggcgtcgcaggacccacgttgttgccgaggaatacgtgcgccccgccggccaggaactggtgggggaccaacaccccgccgtgctgcggacaccctcgtggaaaccagggccagtccccccacaacctccggggtgatcaattccagaganccccggtgtacgccacagaacggccgcgtgggcataaaacccggggccctccgcccctccgagaataaccccgcgtagttccccccccaggtccccggagaaccaaaaccgccgcgaccttcaggcgacagaaatatcttcccgcgctgacaaaccctgtcctcgccgccgcgagatacacacagcggctccccacgcgagaagatttccgccgagaggccacacccacgctcttgtcgcccggcacccccgcctcgcggggataaccccacgtcaagacacgccccagcgagggcaccacacaatgctgttcccaccttgctgaaagggacttcccccaagcaccagatacgttcacctcctccccaccgccaacaagatagtatcttgcggcactacacacccgcctcctggggtgcgccaacacgcgagaacaccacagcgaacaagagtcgtcacccgctttacacagtgccccgcaagtcgacgagagccctgactctcctctggggtgctcacacaacaaacaccctgcgtgactgtcgaccccccccaggagtcccccgacgcgccggggcccccccaaactctgtaaccccccccacaaaaca

SEQ ID NO: 521558 - DNA, 130 bp, Homo sapiens
cccctcttcccctaggtacactccagctctggcacaaggagagcgaaaggagcagtctaacacgctagtcacccacagactttgacagcttggaaatccagggccagtacagtgacatacacaacgcgct

SEQ ID NO: 521559 - DNA, 181 bp, Homo sapiens
gattctacttcattattgcactgatgccaagcagcagcattctcccctccggggagaatgctgctgcttggcatcagtgacattcatgttcccactccgttcccatgtcctaggtatggcactcaggcctcccatttaaggaagaaggtcgggaagcatgttgcttatcatggcctaagga

SEQ ID NO: 521560 - DNA, 131 bp, Homo sapiens
cggctccacggcacccagagctgggggccacctcagaagtgtcatctctctctgcaccacgcattcccctgcagcagctcgatgtgcactgcacgcagacttgagtgatgctgggtgcagagcaggcctgg

SEQ ID NO: 521561 - DNA, 494 bp, Homo sapiens
aagccgaggataaagcacttttggctaaatatacggcacaccacaatgcggaggaacaagttgagtctctagttgagaagaagcagctgctgcaaatgttcaaggaacaggttgaaatggagagagaaagatacttcagtacagtgcaggagacggaacgtatgacaatggagagacttcagatgggattttcctcagtttttgagtcactagtagattttgctagagcttctactaaagtttatgctgatcttgttacattctctcagaatgcaaaggtttaagaagggaagatgtgctgataagttcacttagattacattcggttgtaagtatccaagatactccaggtatagatgtcgtttgtgtgctttcttgagataattttgaagatagatggataactaggattgctgggatttatgtttaatgtaagactgtaagtatttcttccgaggaaaataagcaaagtaaataacagaacttggttaaac

SEQ ID NO: 521562 - DNA, 192 bp, Homo sapiens
cagtgggtgctaatggatgagcatatggtaaatgaggctggattatacatcgacgcgcacttgtccaagtactctgcatagaaaagattcatagaacttacataactcagggcaaagcacgtagagaatgtacatgtacacctgtcaggtacgtgtcagaatgtacattacgagaatgtaaggttagagata

SEQ ID NO: 521563 - DNA, 996 bp, Homo sapiens
gaggtggcttgagcgctccctcctgtgctggctttggcaatagaagggctgattcgatcggcttgagtgacgttggccgatcattacatccttgctcgcttccgatactgcatcagtcacatcctgtgtatcatacaaggcgacaatggagggagtagagtgaaagtagctacacgctgtaaaggcagtaaaggggagcgataacacacaatcggtgggaaacttgtggaagggccccgaccactgagtgacaaggatgacgaaccgttcgcgacgggacgataacaagctgaaacacgcgaggacgcaaggccgtattgggtaggcagacaaccagtcacgtcaagagggcaccaataatcaccgtgggctagctcaagatgagaactgtggcgaatgtattgggggtcccacgatgaatgctgcatgtgtctagacccagccaatggatccgggggcagtctgtccaggtacctaggtgggccagaagaggagaaaagggctgcgggaccgggggccagtggatcacgttctaggggagccagtttcgcccccctagtcgacaccctctgggcgaggctcgctatccaactaggtcggcatgctccaagcggaggaggagcaggatagctagttggctcctggggcatccgtggatccaggccccctccctctccagcaggcccgatgggaggctggagtggggcagaggagaacttgctgcctcgtgagtgccctttcctaccacccggtcccgcactttatttggcgaaaaaccagtgcaccccttcctgggcacacgctgctctgccgccaggcttgggcagaatttcccatatgccaggggccgtttgggttgcctgttctggcaagcgcatttgggggcaccagaaggctgtgggttcgggggggacgacgcgagggtactggggtgggcccacaaaatgggtctttcgcgccactggctggtctttacttgggggcgcctgaattggg

SEQ ID NO: 521564 - DNA, 631 bp, Homo sapiens
cccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccaggtcggggggcccccccgccggcggcagcggctttggacgagggcagatacccgacaaacgtgcaggtccacccctaccgacgctaccgcggcgccggagttgccggccagacccaggatccaaactgtgaactcgtgacaatcacaaacttggcggcaagtggcgactcaaccttgggggggggggcggggggagggcgcgaggctttggacggctgtggtgtcgtctggactgaggttttaaatattcttctctaacccatcagcacataaaaaaagtcctggttcaacaacggtttacacaacatgtcttcagcttaattcaaacttcaggttcttttctccctttttggaaatatttcctgagcctttgttacggcatatggtaactttatgttacgcaccatatcttacaaatgtgaatttacgaacttctaga

SEQ ID NO: 521565 - DNA, 250 bp, Homo sapiens
tccctttgtctcagagaagcaggagatgtgatgaggctgtatttttttttctttttcttgtctttgagacaagagtctcgctctgtcacccgggctggagtgtgacgtggcatgatctcagctcactgcaacctctgcctcctgggttcaagcgattatcctgcctcagcctcctgagtagctgggattacaggcatgcgccactatgcccagataatttttttgtatttttagtagacaaagggaaaca

SEQ ID NO: 521566 - DNA, 350 bp, Homo sapiens
tacctcaaggtagcagtcagagtcacggctctagctggaaatcaaagtggcgagtattctgtaattttgtttttgtttttttgtgaaataaatttacgttcttgtggcccaggtatggagtgcattggccccatctcggctcattgcaacctctgcctcctggttccaagcgattctcttgcttaatcctcccaagtatgctgggatttacaggggcctaccaccacgcctcgagtctaatttgggtaattatgagtataagaccaatttgcaccatattgtgcaggctggtctcaaattcttagcctcagtttatccacccgacctgcaggcctcccataatgctggag

SEQ ID NO: 521567 - DNA, 2380 bp, Homo sapiens
ggcacgagggctttctgcattgagttggtttcaatttgccttgtccttttccgctctgggagtggaggtcaagaggcccagccccctgcagctgatggagctgtgtcaccaggctcttgcttcgtggctgagtagccccatgctgttcaggttcacatcccagaaggtattcagccggagcctcagacagagttcagccctggcctggccgccagccgccaggaggagggaggtcttgggtttagatgaggtgcaaaactggctcccgggaaggagggctgagcatcgagaaacccagaaagctgcctcacagatgcagacatgacagtggctttgtggtctcgaaaacctggagtagacagcccctgtcttgtcattgttttcttgttagtccagggccgcttccagcttggagatacacagctccgagcccaccagagacaccacaaaacagaacttttctgccctctggtgttaaaagaaggaagagattttgctgggaagaggtacctgttttccttctcctggtactaggaagttggtgggtgcagatctttctcttcaggggcccagcagtgacttcattgaggaagatctggcctaggctggatcctcagccgcctgcaacaaacattcctgccagcaggtggcagcaggcctccaggccgcaatgcccagcctatctgctgaccacaaccttgccacacctcttggcatggggtgtgtgcttttggggatggggagggtagaaatgaatcagacatgggctctgcctgtggggaaattagagcacaggcagagagacagattcccaggctataaagcagaataaaatcgactgtctgaaatgtaggaggcagcatggtgtaagagaaaaagcaagggcagcggcattcacacagacctgtcctgaccctgatgccaccccttaccagccgggtaacccttggcacgttgaataacgtaacatgaacaattataatacctaacaatcgctaacattgatgtgatgtttcctgtggccaggcacagagccaggtgctttacatgtaactcatttaatccccaacaacccttgaagtaggtacagttatatccccattttgcagatcaggaaatgaaggcacaaagaaatcaaagttcttcctaaaggtcatgcagctggtggtggggagagctggatttgaacccaggcagggcagctgctcaccttcatgatgatgcatctgcatccatgtggctggcacagtgcctggagccagaataagacctcttatcatgagcagctgtcaggactaataattcatgccaattagggatgacataagctggcccccgagtgctgtgtgttcagtgtcactaattctccatcttcctggcagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacaggtcaggctgcatgccccccgtggcttcacagaggaccccaaattgtgtttatgtggcttaagctgaggattgctctactggaaggacacgcagaactcagagtccagccctgcagaccactgagactgaggaagtggtgtgcttaagtatcggggggattgcctgtgacatgcaggttctgggcccactctctgcagagtgatttggtagccctgggcaagagcctggaagcctctataacaaggctgctctccccaagcacatcattctgatgcaggtggttctggggtccttctacaacaaggtttggcaaactttttctgtaaaaggccaaatagactgtatggaccatacagtctctgttaaaactacagtagtcacttctgctagagtgaaagcagccttacatatgtaatgagtaaatgaatgggtgtggctatgcatataatatgtaaatgagtcaggtatggctaggttccaataaattataactac

SEQ ID NO: 521568 - DNA, 1088 bp, Homo sapiens
  misc_feature (378)..(378): n is a, c, g, or t
ggacgcggccggcggggcggacgggagcgggccgcgcgtggcggcggcgatgggcgagggcgggctgcccccggccttccagctgctgctgcgcgcgtgtgaccaggcgacacggagacggcgcggcggctgctggagccgggggcggcggagccagccgagcgcggcgcggagccggaggcgggcgcggagccggcgggggccgaggtggctgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactanggctggagcgcgctcatgcaggcggccaggtgaggcggcggtggcccggggtgcccgggaccagagtggtgcccggcgctggcccgagacgcggtccccggcggccggatgccccgggaggtgaagagttaaggactccttagagttggaatgatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggtcagtgccagccccacgccctcagcgacaaggccagacagatgctctggcctgagatggaggttcccaatgggctcttctggtcctgagatgctgcatacaaaccccagggactatgacgaccagttggagggcattggtagagactacaaacaaagtgtcggtgaacaggtgctcaatttatattccgcacagctttctggtgcgcaggagttcgcgtgttcccccgaaatcacaggattttccgcaaatggccctttaaaatatccattgctcaaggagagcatttatttgcgcgaggtagatt

SEQ ID NO: 521569 - DNA, 168 bp, Homo sapiens
  misc_feature (94)..(94): n is a, c, g, or t
cgcctttgggcgggatggggagcacacggagagggtgagagaagggaggtgggtcaggctgctcctgagggccggacgagtaggcaggggctantgaagcagctgagcctgggagatgccctggaatcactcaagtgcaaccttgagccacttgcattgctgtgatgt

SEQ ID NO: 521570 - DNA, 1917 bp, Homo sapiens
  misc_feature (1070)..(1070): n is a, c, g, or t
gaagacaaaaaaaaaataaggctgtaagcttccctacaaagcaacaaccccccccccaacccttcgccggttgccttccctcggcccagccagttgtgccggccgttggtaggcgcttgcccttgcgcccgggcccttccaagccaagcctttcttgccgggcccttgccggcgaatggaatggtgccccaagccgggaagcccggggcctaggcttcgggcctcttcagagctccaagcgaagcgcggtagtcgcggtgcgcgctccgccaaaaggagcgtacgcggaggcacatccctcaccccggagagctctcactcatgcgctaggagagtatatctactatagtggctctcactcgtgtgggtgtgtacctcccacgagggtgagctaggagagtcgaggcgactgtttatcacctctcacagcctcgtgatgcgctacctactacctcttcacgcacctcaaagaagccacaatttgcgccaactgagagcccatcacgcgcccacgggggcgacactaagtggtcacaagccgcgaaagaggatcaccccccacaaaaaagcaagagctgctcacaagcggtgataaagtgtgaggacccacatgcagacagacactaatatacccgtcggaacgagtaccgatagttaaacagcccacgcagcactatattagaaccgtggcgcgccccaataaattccccgcatataggattcaatcacagacatgcaggtgaggactaagatccccgaggagaacatacctacaacaccactgtggaaatgagctacggagagaaaaaaacacttactgcgacagaaatattcaatactatcattggaaatgttgcacccaagtggagttacatctttatgtgcgcccatgtttgagtaaataattacccaccactaaagaggcaaccatataatattgagaaacacacgccccacaacacatgttgtgcacaggcgatatgaagaaacaaccgattttgcggcaaacacaaggcggccacaaaacccacagatgcagcaaacgccacagataacgccgggatacatcnataattaccatacaaatagcagtaagtcaacgagtatttcgcgacatcaaatcaagaacaagcggaaatataccccaggcatctaaaagtcgacccggcaaagtaagcaacagtgagaaggtgggaccccaaaagaaagacccccgaggggactaatcggaggaacaccagattagacgacagattacccccagagggaagcccccaaacagtggcctcagtatatgtaaaataatacccaaagacacagtgatcataatgaaaaatcatatagcacacagacaagctatacaagtgggcagaacgaacacacaagtggcagccacaatcataaaagtcaacaaatatggaacaatacaacgacaaaaacgaccgacggtgaaagcagccaccatacacataccacgatgaacacagacactaataagtgctctgattagcaaatcgatggagcacacacactacgtcagtaaaccacactattcgtccaaaaaaacgccgctagttaggtacccccgcaacgtagaattgtgtcatctcagaccattatatagctgtaactaataatacatagatcaaaaatatagcgccgcagaagctaacaaaagagcatcacaccagacacacaagatagagagaccaatagacgaataacaagtatactgcaacacataaaccagcgacagaatatgagattactaaacaaaaagaataaaagacaatgcatacacgataagcaacaacatgacacacaatccgcataatcatatgaataatcagacgattcaacagaataaacacaagactaacaggactagatcaatgaaattaattatacaacaacaaa

SEQ ID NO: 521571 - DNA, 2229 bp, Homo sapiens
  misc_feature (378)..(378): n is a, c, g, or t
  misc_feature (1728)..(1728): n is a, c, g, or t
  misc_feature (1999)..(1999): n is a, c, g, or t
  misc_feature (2066)..(2066): n is a, c, g, or t
  misc_feature (2218)..(2218): n is a, c, g, or t
ggacgcggccggcggggcggacgggagcgggccgcgcgtggcggcggcgatgggcgagggcgggctgcccccggccttccagctgctgctgcgcgcgtgtgaccaggcgacacggagacggcgcggcggctgctggagccgggggcggcggagccagccgagcgcggcgcggagccggaggcgggcgcggagccggcgggggccgaggtggctgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactanggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacagatgaggagaaaaggcgacctgatattttccatgcattgaaaatgggaaacttccagctggtcaaagagattgccgatgaagaccccagccacgtgaacttggtcaatggggacggggcgacgccactgatgctagcagctgttacggggcagctggctctggtgcagctgctggtggagaggcacgcggatgttgacaagcaggacagcgtgcatggctggacggccctcatgcaggcaacctaccatgggaataaggaaattgtgaaatatctgctaaaccaaggggccgatgtcactcttcgtgcaaaaaatggatacacggcctttgacctggtgatgctgctgaatgatcccgacacggaacttgttcgactgctggcatctgtctgcatgcaggtgaataaagacaaaggccggccgagccaccagcctcccctgccccactcgaaggtccgacagccctggagcatcccagtgctgcccgatgacaagggtggactgaagtcctggtggaaccgaatgtccaatcggttccgaaagctcaaactgatgcagacgctgccccgtgggctgtccagcaaccagcctttgcctttctctgacgagcctgagccagctctggactccacaatgagggctgccccccaggacaagacaagccgctctgcactccctgatgcggcccctgtgaccaaagacaatggtcctgggagcacaagaggagaaaaggaagacacgttattgacaaccatgcttcgaaacggagctcccctcaccagactcccgagtgacaagctgaaagcagtcatccccccnattcctacccccttccagttttgagctgtggagctctgatcggtcccggacgcgtcacaacgggaaggcagaccccatgaagactgcgctgcccagagagccagcaggggcaccccgtgggcggcgggggcacagacactacacccgtcaggcctgttaaatttccaagcctccccagaagccagcctcttctgccaattctggaaacttcaaccactcgcctcattcatcgggcggctccagtgggataggtgtgagccggcacggtggnggagctgcttaaccgctcaggtggcagcatagacaatgtcttgtcccaaatcgctgcccagaggaanaaagcagccggattattggagcagaaacccagccatcggtcaagccctgtggggccagcaccggggtccagcccgtctgagcttccagcctcccctgcaggtggcagcgctcctgttggcaagcagaaattggagaccagcaaaagcctccntctggaacttc

SEQ ID NO: 521572 - DNA, 724 bp, Homo sapiens
cctacagccgcccgggaaaagatggccgcgcctgcagcgtccggactgtctcgacaggttcggagcttcagtacatctgtggtcaggccctttgccaagcttgtaaggccccctgttcaggtctacggcatcgaaggccgctatgcaaccgccctgtactctgctgcatctaaggagaagaagctggaccaggtggagaaggagctgctgcgcgtagggaactcctgaaggaccccaaagtgtctctggctgttctgaatccctacatcaagcgcaccgtcaaagtgaaaagcctaaatgacatcaccgaaaagggaaaagttctccccgctgacggccaacctcatgaatttacttgctgaaaatggtcgcctaggcaacacccagggtatcatctctgccttttccaccatcatgagtgtccaccgcggagaagtgccgtgcacagtgaccacagcatctcctctagatgacgctgttctctctgagttaaagacggtgctgaagagcttcctgagtccaaaccaaatactgaaactggagatcaagactgacccgtcaatcatgggcgggatgattgtccgaattggggaaaagtacgttgatatgtctgcaaagagcaagattcagaagctcagcaaggccatgcgggagatgctctgagagactgtcacctgtgtgagctcttgtccttggagcaacaataaaatgcttcctgaaaaaa

SEQ ID NO: 521573 - DNA, 275 bp, Homo sapiens
cagccatagtagccccataagcatcagccctgtagagtgaggagccatctcaagagggcccaattcctgtccatgtagcaatcactgtcctgggcttatggtgctatgcctgaatccctggactccagaaatgggcatgcagatcaactgttgccttcaagatccagataaacccggtcatgggttaaaactttattattattaaaattgttaaacgtcctgttcctgtaaatctccaaattttgtcccttgttttaaggtaatatatagccatt

SEQ ID NO: 521574 - DNA, 1489 bp, Homo sapiens
  misc_feature (378)..(378): n is a, c, g, or t
ggacgcggccggcggggcggacgggagcgggccgcgcgtggcggcggcgatgggcgagggcgggctgcccccggccttccagctgctgctgcgcgcgtgtgaccaggcgacacggagacggcgcggcggctgctggagccgggggcggcggagccagccgagcgcggcgcggagccggaggcgggcgcggagccggcgggggccgaggtggctgggcccggggccgcagcggcgggggcagtcggggctccggtgcccgtggattgctcggacgaggcgggcaacaccgcactgcagttcgccgcggccgggggccacgaaccgctggtgcgcttcctgctgcgccgcggtgcctcggtcaacagccgcaaccactanggctggagcgcgctcatgcaggcggccagatttgggcatgtgagtgtggcacacctcctgttggatcacggggctgatgtcaatgcccagaaccggctgggggccagtgtgctcactgtggcttctcggggcggccacctgggtgtggtgaagctgctcctggaagccggtgcctttgtggaccatcaccacccttcaggcgagcaactggggttgggcggcagcagggatgagcccttggacatcacagccctgatggctgccatccagcacgggcacgaggccgtggtgcgtctactgatggagtggggcgcggaccccaaccacgcagcccggaccgtgggctggagcccgctgatgctggccgcactcactgggcggcttggagtggcccagcagctggtggagaagggcgccaaccctgaccacctcagcgtgctggagaagaccgccttcgaggttgcactggactgcaagcacagggaccttgtagactacctggacccgctgaccaccgtcaggcccaaaacaggtcaggctgcatgccccccgtggcttcacagaggaccccaaattgtgtttatgtggcttaagctgaggattgctctactggaaggacacgcagaactcagagtccagccctgcagaccactgagactgaggaagtggtgtgcttaagtatcggggggattgcctgtgacatgcaggttctgggcccactctctgcagagtgatttggtagccctgggcaagagcctggaagcctctataacaaggctgctctccccaagcacatcattctgatgcaggtggttctggggtccttctacaacaaggtttggcaaactttttctgtaaaaggccaaatagactgtatggaccatacagtctctgttaaaactacagtagtcacttctgctagagtgaaagcagccttacatatgtaatgagtaaatgaatgggtgtggctatgcatataatatgtaaatgagtcaggtatggctaggttccaataaattataactacaaagacaagcagtgggatatatttgagccatgggctatagtttgccagcccttgttctacaatagtgtgcctgacctcatctgt

SEQ ID NO: 521575 - DNA, 768 bp, Homo sapiens
ttaactaagcacagtggcccttaacgtatagtatagcaattgtaccctaggaaacctatatcaaaacaataaaaagtcttactccaaacagaaaaaatggtacacacttaaacaaaagcaaaactaaattgtaagatctagtactagtaaagctacttgctatagcctatatattcagttagttcaacaatctcactcatgacagaaaaagtcagcaaataagacttgggacaaaataaatatttctatcagtctccacatggaaaagaccacagctttaatgaataatacaatccttaagattaatcctatggtcagtatagattaccgaatcaaaatctaagtcatgaactgtttacaaatagctatactacactaagatgctaaacataacaacattaaccaagtatgtcttcctaagaggggaaaaaaataagtggaaaataaacaatctatgagcctaatgagggaattatggacaaagcctaactaaaactacaacagtcgtacctactagcagaaaactaaaacaaataataaaagtacaaaaggataataaaaccaggaaaaaaccaaaactgatcctcaataaaagtactgtatccaaaaatctaattaaaacaagtaacatcatgtacaagaattccagaattagatcacggaaggaacagatgcaaatactatctatatccagctggaaactaatattacatcattctagtacctcaaaattcctgggtccaaaataaatggaatagcgtggctgcc

SEQ ID NO: 521576 - DNA, 137 bp, Homo sapiens
tgtagactctagagatcccgcctcgtctgtatagcaaacgcactccgagcagtatatgctaagacttcgccagtcaaagcgaactacgtatactcgattgatccaagtacttgaccaacgggataccgagctctaat

SEQ ID NO: 521577 - DNA, 617 bp, Homo sapiens
caggggcaacagccatattgtcttaccttccaaaacccctgggggttgggtattcaggggtctataaaacacagtcccgcaaaaaggtcccatagaaaaagtgtcccccacctattcattaagtgaagaagtaacaacaacacagtctcatctcgatagctcttgaacaaccctatattcgctatagcagtggggtactctccaccacgagatgaccaacccagcaatctagaagtcactgttcatggtacttccgttacataaaaatacatatgtcttattttcaaaagtgttattcgcatgcgtctcctcgtagaatagcacaggctagatgttccaacagatcatgtctgtattatatcacccaccgtctagcttcatacgtttccagtcaatcctgtagacggctaccaatacataagtaccgccgtatccacgacttacgtttctgtaattgaggtttccgttacctgtggtcaactgtggtcggataatgttaaatagaggcttgcaagaataaagcacagttttgaggcacggcacagtggcccccgtcagtaccacaggcattgtggaaggtaaatatgtgcagacccctcacggtcaaggttcaacac

SEQ ID NO: 521578 - DNA, 172 bp, Homo sapiens
ccccttatggaatcaagttatcttaaagcaaaagcagaaacacagcttctgtagaatacagaactttaatgtacttgaaataattttctcacatgttaataacataatttttctcctaataacaactagctacttctcactccaacatctaccacaattcctcaaattggtg

SEQ ID NO: 521579 - DNA, 185 bp, Homo sapiens
tctagcaggatcccttgcaggaagagagaactgtgcaggatctgagattttaccacatatataatgcaagctaacgacctagcctgttactgtttcatggatgctggcagaagacatgagactcctgggtcagagaaaaggggctttattaaggtcggtttccattttcatttagttctctatcc

SEQ ID NO: 521580 - DNA, 140 bp, Homo sapiens
aggttctgaggcttacagtgctcctcgatccagtactcagcctgccaagctgtgttctacacctttgtttttagacacaagcagcttttgagcggaaacctgaaagaaggtttgcagtatcttcagagtctgaattttga

SEQ ID NO: 521581 - DNA, 544 bp, Homo sapiens
tacattccacaggttgtcacagcaaactgagggacaaggtacacaggttaataaccaatggcactggcattgagttctatttggctaaaaataacaacatcctcgtgggtaaaataaaaatacattttacgatacaggtttcattaaacagaatggtcttcttttggtaagtggaaaatgtctacctgtatcaagtacctgtatgatttaagttcccttttattaccaataagactgaagtttaaaggtctacatggtttttttaataaattaaagatgtataaatcactcttccagcaaaccagacatacttaggaggcacagcaaaagacccaaggtgaggggcttccctcaccttcaccctggtcctcacgtggaggtggcgcatgtctatgagacacagtaccccactcagagatcctctgcagtccagcaaattctagcactggctgggaacacaaatcatgtggtaagaaatgtttttattcctttagctgtgtcaactgggatggtgctgggggccattcagctcatttccctgatg

SEQ ID NO: 521582 - DNA, 190 bp, Homo sapiens
tttttttttttcactctattcctgacctgcagggtttctgttgaaaaatctaatgatagccataatggagttctctcgtatgaagtttgcttcttttctcttgctgctttcaggatcctctctttgtcttaacgcttctgagagttttactaagtctaattgtagcattgtttcagctgaacataactgg

SEQ ID NO: 521583 - DNA, 125 bp, Homo sapiens
gcataactcgggaggtgcttgagatatcatccgctgagggtggaaggtgagtgagcagacactcggaaggtgtcttgcagattatcatccgctgagggtggaaagcggccccccgcaggacgctc

SEQ ID NO: 521584 - DNA, 280 bp, Homo sapiens
taattctgaagggttaatgtaaccatttttaaaaaagaaagagggggaaacaaagaaggaaaatcccaagaaggaaggctgacaaccctcttgcataccccgaagcccaaagagaaagatgtggctggcttgtgagaagacatgaggagttgggaaaaggaatgccacatttccctgaaccaagacaaatctgtatgcgactcagggctgccttatagagccagctacaggactttgccaccagcttgcagttctgctgaaacctaatccattcccaggc

SEQ ID NO: 521585 - DNA, 223 bp, Homo sapiens
atgaaataacactcatgacattaatgaataaatgagacttgcgttcagatgggggggcaggaaagctagacctgggagtcagaccccggtcatctttaattctctgcactttcccttataccgtgctgactttcacgtccaacatcttacattgcaaagcaggggcaccgttcttcacaaacaggtggggcattgcacctgcaggttgggcaaaagcacaggt

SEQ ID NO: 521586 - DNA, 147 bp, Homo sapiens
cccgactagccctgacagccaactagcccgacagccccgactagcccgacagcgacggcaccagtttcagacaatggaaattactcatgatgtcaaagctgtctgctcccaggaggcgatgacggggccctgtcgggctagtcgggg

SEQ ID NO: 521587 - DNA, 603 bp, Homo sapiens
  misc_feature (18)..(18): n is a, c, g, or t
  misc_feature (54)..(54): n is a, c, g, or t
  misc_feature (64)..(64): n is a, c, g, or t
  misc_feature (109)..(109): n is a, c, g, or t
  misc_feature (121)..(121): n is a, c, g, or t
  misc_feature (134)..(134): n is a, c, g, or t
ctataccccagggaattnaatggtgccaatcttaagctaatggaaacttgggcntccccaggtnaaagtaatcttctgccttaagcctccttaagtagctgggacccanaggtgcaaaccnacctagccgggcntaattttaaaatttttaagtagaagatgagggtttcacccatgttggccccagctggtctaaaactcctgaccttaagcgatctgcccacctcggcctccccaaagtgttgggattacaggcatgagcccactgcgccccagcccatggactcttgaagctctactagaagctcctactagaagagttcaggaaagggctggagggcaccctccacattttaacagaacacacggagggagaaatgcatgtgaagtgaaaaaaggagaccacctaggaattcgaggagtcccctacccttgggaaggcgcatggtgatgggtggaaggtgaggtgtgaccagataggcttggggccagtttgctgtgcatttgtggtacaagtgcatacatcaacagattgatattttgctttccctgaattatcttaccttactatcctgtctaaagtagcactctcccaagttcctt

SEQ ID NO: 521588 - DNA, 200 bp, Homo sapiens
tcctttaaaattgaaggtccttaccccgggtttgttttttggaaaaaaccccttttttaaaaaggttttttgggtctagaaaaatttccaaccattaaaataaaaaaaaatttttaccgggttttttttaaagaaaaaaaacccccccttggggttaacccagcccccgcccctttaaataaagttttcctgttccctta

SEQ ID NO: 521589 - DNA, 227 bp, Homo sapiens
ccgggagaacttgatcttggagtcgtggaattgcttatgagagccggccggctgaacacttgctggggcgtgatctcctccaccttcatgatcagaatggagtgggcatcagaggctgcagtgtgccagtgtaacccattgtctctgagtagcacttgagtgacatctgccttgatgtatggtcaatgtgtccctgataattccctgagtacattgttgttggtttg

SEQ ID NO: 521590 - DNA, 124 bp, Homo sapiens
catagtccatcaccatatacttggcattggaattctactggaaaaaaatacaataagcaaaacaaaaccctcagcactgatacaagaggccatataagtatcttgtgctacttcacttacccat

SEQ ID NO: 521591 - DNA, 425 bp, Homo sapiens
gcatatcatttatcctgactttcctggctgactgctcaccttcatttctttttcttctaggcatcatgatgttatacaaaaaaaaaaaaaaaaaaacatggactgaagtcaaaatacctaaccttttatttcaaatctctgccatggcctaccgacatgaccaccttgggcaggtcatataatcactctgggtctcaatatgttcacctgtaaaatgaggacagtacatcttacatgcttaagctgccttgaggattaaatggcctaatatatgtaaaacaactcgcaagtgcttaatccatagaagacacttggccaacttttctctcctataataaacatatacaactcaagcttattcctgaaaaagatattggtgatgttgcttaaagtatgagatagggcatggatctgtcacctatgta

SEQ ID NO: 521592 - DNA, 169 bp, Homo sapiens
ccacattactgtcctggtgccagaggctaccttcctatcagggctgaccatccatggtccagacacactacatagtgttatctgctcatcagttcatgggtgtaggagtccttctccctttgactgtaaggaatcctgccgctagaaccattcatgcacagatgtcttc

SEQ ID NO: 521593 - DNA, 290 bp, Homo sapiens
  misc_feature (46)..(46): n is a, c, g, or t
  misc_feature (116)..(116): n is a, c, g, or t
  misc_feature (181)..(181): n is a, c, g, or t
  misc_feature (191)..(191): n is a, c, g, or t
  misc_feature (235)..(235): n is a, c, g, or t
  misc_feature (267)..(267): n is a, c, g, or t
  misc_feature (278)..(278): n is a, c, g, or t
atcttggctcactgcaacctctgcctcctgggttcaactgattctnatgcctcagcctcctgagtatctggaattacaggtgcctgccaccatgcctggctgatttttgtattttnagtagagacagggtttcaccatgttgctcaggctggtcttgaactcctggcctcaggtgatccgnccgtctcagnctcccaaagtgctgggattatagatgtaaaccaccatgcccggnctccccgacagtagctatagaaagaaggcttnagtcttaaagntagtttccccta

SEQ ID NO: 521594 - DNA, 806 bp, Homo sapiens
taatagctccaatcgtaccttcagcgcattttgagggaacccgtcaattcggccattatggccgggattgaacaaaatcacaatatacatttgtggctgattaagatttctactatctgatgattctatctaatatatatggagtctggtttcttactgtcaagccttattcatacagaatttttgagagaagaaatacttaggactgttaactgtcgaataaaccttacaggcctagaaagaagcattaattatatgatatattagtaaaagatgcttatagttgttttacaggtagcagtatggtgacctaatacacagaaagtgctgtgccacataatgaggaatcagtagatgtgaatgaatggatgctgacattccttcaagacactgacttgtcttcatagttatcagtgagtgacaatctattgatccttaatatttgccagtggaaaattataaatattgaagaacaaaggaattaaagcatctgaagactttggttgagttctgcagtttagtagcgaacatcttaaagaaccaactattaaagcctgctttgaatctggaacacaatttgtgtttccttatggttaaacagaactttggtcatcccaccattagactttttgacattaaacaatgcacccacagtttcttacttaaagaatcttagaatgtggatttaaaacacctgtgtgtatcatgcctatgaataatacctgttcatgaatatactttccacttaaacaacaatacgttattctgggttttattaaataatctattttattgctgctgtcgcg

SEQ ID NO: 521595 - DNA, 343 bp, Homo sapiens
gttggctcactgcaacctctgcctcccaggttcaagcgattctcctgcctcagcctcccaaggaggtgggattagagaaggccgacactatgcctggctaattttttgtacttttagtagagtcggagtttcaccatgttggccaggctggtctcgaattcctgatgtcaggtgatccacccacctcggcctccaaatttatgggattacaggtgtgatccactgtgccagccatgatatgttcttaataaaggtttatttgattcaaatcaaaatctcagactatattcattttatagaaatgcagaatagagaattgttcattgatgcataggaacacagt

SEQ ID NO: 521596 - DNA, 701 bp, Homo sapiens
  misc_feature (47)..(47): n is a, c, g, or t
  misc_feature (64)..(64): n is a, c, g, or t
  misc_feature (118)..(118): n is a, c, g, or t
  misc_feature (250)..(250): n is a, c, g, or t
  misc_feature (347)..(347): n is a, c, g, or t
ccttgccccccttgggccccaaggtcagccccctgccaccagcccgnctagcagtttaagggcntgaggcttctgggtcctgtggaggggggtggcatgacccggggggtcgtccatnccagtccgcctcagtcgcagagggtccctcggcaagcgccctgttagtgggccattcggaacattggccagaagcccaaagagccaaattgtcacaattgtgggacccacattggcctgagatccaaaacgnttcgaggcaccccaaattacctgcccatttgtcaggacacccccccccccagtgttatattttgcctcgccggagtgggtgttcccgggggcccttnccgaccagccccttgggtccccaggtttgcagctttcccctgggcccctaaccatcctgggccggggtgcctgtttgacccccgggcctagttgtggctctccatcttgtttcccccccgtgtccccaatgttttcagtggggggcccccttttgggtcccctcctttgccatcccctgaagacccccccgccaaacattgaatgtcccctgggcctgccccctcggtcccccttggggcccgggtttgactcaactcagcccctttaacgctaatatttccggcaaaatcccatggttgggttttgtttttaaccttgtaacgcttgcaatcccaataaagccttaaaagtca

SEQ ID NO: 521597 - DNA, 291 bp, Homo sapiens
catgtggggcatcacggccacggagacacctcacacaatacggtccagctggacttcttcaatcaccaccaagaagaccatctcatacagtccttccagcttcacttcttcaatcacgaccaccgagagcccctcacacagtactcccagcttaacttcttggatcaccgccaccaagtccaccacacacaatcctccaagcttcacttctgcaatcaccaccacagggaacacctcacacagtactcccattttcacttcttcaatggccaccacggagagcacatcaca

SEQ ID NO: 521598 - DNA, 735 bp, Homo sapiens
ctgcgtggagctcggtgtatcacggctgaggatatgtagctgttgctcgtaatcaagccatgccgttcgcccatggacacgatgatcaagaccatgagggagagctatgtgttgtctctgcccatgatggactcagaccacatcgatgctttcgtgtcaccgtctgtcatgtgagcccatttgacgattatgtctgtacagattacgaagcctgatttcctgatagcaatgctcaagtgatctagtgcttaccggaactacgatgttcatagggtcttaaagccaaggatttaaaagttatcattgacatctattttagcagactatagcctggtcatgatatatatggacgagatactaagtaccattcgttcaacttagtaatgaatacattagtacacagttatgtgcaagactagtcatagatggtgaaaccacagctgatgaatcactattaggtcactgttatagttaacaacctctttacagtaaggatgacatagtttttcaggaccttgactgaaacattctgaagctggagtgctctgacagccttttaacttccacccgccaactttggtcaatttggtatagaacggtacatgtccacctgctccgcggcatactgaacatgaggccatcctatcataggggcttgccggctatgagcaaccttatttaccaccatgacttaagattggtcatcttcccgtcagttgctaatcctggcccgct

SEQ ID NO: 521599 - DNA, 336 bp, Homo sapiens
ttttggggaacccccctttttttttttgttttcccccccaccaggaaaaaaagaaacatcccttttttccccccccctctccccaagggacccaaaattttgtttttggaaaagtagatcggtgagcaggggaacagggttttttccccccccccaaacagttttttttggggggcctgttcccccctggaaattgccccctttgtgtgtgggggggggggggggggggggggggtatgttcatgaccccttggcggtcgggctttttgggcatgttttaaaaaaggaaaaattttaataaattaccctttttggggcccctgggccttactttta

SEQ ID NO: 521600 - DNA, 1092 bp, Homo sapiens
  misc_feature (1092)..(1092): n is a, c, g, or t
gtctctcattgcttggcgtttgtgtgctggggttaacctgcgaggcttcagtcacatgcgttttgcaaactgtctatcttctcgcttacgcgtggacctcgatctgatcgctcgagacagcagtggcaatggatgtctgcgttgccagcatagcggaacttgcagacggctgcttgcaaggatctctctaggcaaaaatactcattatatgctcgaattagatagaaaacttttaagggaacgagacgcagcagattcctcagctataagttagtggtagtgaaccagaatgacattcccggggacaaccgcatgcttgcgtaataagaagctttagcacgtgtgactaagtgtgcattgtgtgggacatttggaatagaagctgtacgacaattgatatcgctagtcagaagtacccatggcgatgaagcgtatggggcaaagtaaccaagcttactttgatttgcgacttgagacgaagatgttggaaagatagattctagataacacggacacgcagcgcatatgtctcacctactttgtgacgtggccttgagagcaagtaattgcgacaccgacacaagatgaggatacgtatgctgacttcggagaaagtggcagggaatattcaaccgaaaggttcctaagtccaaaatagggaattcacgaattctttttaatctcggggaggtcgcccgcgtacgtttggccgaggagtgccaaaagagggggtcacagcaccagccactggggacacaacacgaggaaagcaaacatggggattgagctcaggaacaaagttcttatcaaaggatgggtaatggttgcgcacccaattgtggggaagatgcaatgtggcctccccccttttaaagacagatagttccttccgtgggataagagcccaactctatccttgtcctttcaattgttgaccaattttttcgtacatagacatttcgtcccccttttgtgggaattacgcctttggcgacagacttgggccttgaacatagttttacatcttgtgacatttgcgcttcgttaaaccaactttaaaggggggttccaccttttcaaagcttggggaan

SEQ ID NO: 521601 - DNA, 641 bp, Homo sapiens
atctgacctaccgtgtttgactgtcgtaagatacccattccagagagggtcccaccccgtgcccagaaggaaggaatcctgcacagagaggccaagaagaatctagacaggccttgctggtttcccctctcagtctattactattagatcatacccttctgtgtccaatcatatttctacacagtccataatctggttgaacctaaacataaaaatggacaattcccctgtatctgtggggtcttcattctgagggctcacatacaattatgatcaaataaatttgttgctttttctcctggataaagaaagaaaataaaaaaaaaaaaaaaaaacagtgtgttggggcgcgccgtgggccccgtgggaagaagagtttttatgacaaccactccgttggggggggcggggggccccgactgggttacaggctgacaccacggggcccaagagcgttgtccccagagaaaaatcccgggccgaaggaaatacggggccggggtttccccccccaaattaaaaaagccgcccggggaaaaccgagcgtgtttctgaccaaatccagagggggtccggggggccatgagggggtccaccaaaggggctccagacgaggcgaataaatgcgccccgcgcgggga

SEQ ID NO: 521602 - DNA, 1699 bp, Homo sapiens
  misc_feature (1097)..(1097): n is a, c, g, or t
  misc_feature (1182)..(1182): n is a, c, g, or t
  misc_feature (1540)..(1540): n is a, c, g, or t
ttctgagcgtgtattctcccctctgttgtgtcgttgcttcgtaccgcctcgtgtggtggttggtgtctgcaacacaccccatgttgtcacatgtacctagctcttgcctctctgttgccacaggctttgccaacgaactggtgggtaatttggctcctgttctcccttgtgtgccaccggtggtgggagccctgtgtggttgtgcctccaaccccgccggctgattggggggagccacgcatagttgggcccacgcgtgtacaacgttgttccccctcgcgggagggttgaaaactctcttgttcggcgagtgttctcccccctactggaaacactttttgtgaggttggaagcagcttctttctccgctcgggggggaacccacatcatgggggcgttcaccgaaagatgtcccaaggaaaattggaggtccttgctccaaaaggaattttgtttctttctctgtggggcgaaaccaggtatggtgcctggtggtgggacgcacgcgccagaagattgtggaccgccccgccccacttggggaaaagccacagacctgtgggcgcgctttcccaaccgggcgttccaagaggtggtatttgttattctccgtgtggagaccgctcttctccgcgcgtcgccgcctaatttagtagtgccgccccccggcgggccgtttatgtagccgcccccccgcgttgttattgttgggggtagttgtgccccccacacacacaccggggcggctccagaccacaatgttgcacaaaatgccacaaggcttttttgcttcttggaagagccgcttgagactgggggaatataaggaagtttttggaatcctcgccgcgcggttttcttctcgcgtaagtaaaaaaagagccctgggaagacagaaagttgggcccccccctgacaaaagatttcttctgtcgagagggttcctctcgggtgggagtacccctccccccaacatatgggtttagagataaaatggggtttccccctgggcacaaagccgcccccaatgggtggtttgtcttgagagagagcgctgttctctccaggagcgctatatcgccacccccctcttgggngggtctcgcgttttggcgctggtgtctcggtgagatatatgagagcacccagcgagccacgtttcgcccggttggggtgttctanctctcaaaacgccccggtgtgacccccacagagaaggcgctgtcgtgtgagagcctgtggcacacagagctctcgcgcccacaggtctctgtccccaggagaaagcgctctacagaaaaggggcgtatatatatgagagatatattatttctccctataatatcctcgccacgccccgacacttcttataatccacgctggtgcgagagagaccggttctcacgagaactcggtttgttctcacacattgcgccactcttataggtttatgtatgtataaaagagactgggttatatgagtataccacaatggcacttcgttaaaccctctcacgaaaggaaaaggaggaaatgtttntgtggacccacctcttggttttctttttatgcgctgtggccacgcttttatacgttatttatcgttttttaaaatcacgtactttttatatggaaacccaccttgagcccaaaatttgtccccagaattttgagaccccctttaaaaagtttaatgaga

SEQ ID NO: 521603 - DNA, 246 bp, Homo sapiens
aaagatggtgtggtgggcgtgatacgtgtaaccccagatttgggagggcaggcggtggatcactgaggtaggattgagacagtagccaaatgtgaaacccattctaaaaatacaaaaattagtggtgtggtggagtgttgtaatccagtagtagggggccaagcaggagaatcggttgaagtccggaaggcagaggtggcagtgagttgagattgagcataatccagccggggggaaagagcaaga

SEQ ID NO: 521604 - DNA, 1970 bp, Homo sapiens
atgtgacatcttcatatggcgcttagcatcacacttttgttgtgtgtttggttatatggaaatgatgctggctgtggtctctggtaggtagtctttcttgttcgttgttccactctaatgggtgtggagatttgatgtatttcctctcgctatcgtggatactcgttttggtcacggtctcccttggttgaattataggctgtgttgattgctctcctgtgtcgcactaaacttcttggcgatatctccctatgcgtgatatattacgaatgtgtgtggctcaaatatatggtttgacttactgcacatgagcctttgtgttttcgaagtctcgctggtgtgcttctacgtgttttatatcactacagccattatataatgttctaacactgcgtagcctcgtgttgtctcctacaatggcgtagtgggcggaatatttcgtctctatgtggtgcggtcccattagttgattgtgtaggtgttagtattatctgtgtctacatcttttatcttactggccacttgagtgacatgtgctacttcatctcgactccgcgccgtttgtcccactttctgcaataatgtggtgggggtgttcttaataattctcaatactatggtgcaaatatactgccttctttgcttgtgtcgcgggcttttcggggatagtacgtgtccgcccatttttggagtaacttgtgtatttcgttattccgtatgtctcactagatctggttcccatatatggcgtattgtcgtcgtgcgtttataacacaactgtatcaatgtgtggtccgtcgtctgtatattgtatagtcgattgtggggaaatgtcttacgcgctaatctgtcctatcgcgtgataactggccaatttgtcgtctctggcagatcatattgcaccacctgtgtgggtcccttatttgtgccatttgtgccctgtcgtaatgcgatttaaacgtttggaacttgctagggcatcccgcactcataccggttatcccgatatctccgcctgtggtccatgctggtattcatatagggcctcctgcttcgtggatgtaatcgtaccctctgtgtcttatatatatgtgcgtggtattctgtagtggttcgttagttgtgtggccttctggatatatctcctcttttgaattgtcggctatgatcttcacgttccaattgttacgttcctaacatgtgtatcgatttggtattctcttcaattcggtcgcaacttggacggaccgtcctggtaatcttccctctcttggtggtcaaaactaagagtactgcgccttgtgagtatggcgtagtcctctccactctagagggggcacctcgtgtcgttagtccgattatgcagtaccgttatgtgacggattagtctcccatggtgttatcattagagacagccactgtgtatgatgttcgctcagagactgtgctgtgacttagtgaaaatgtcttgggggctctctgcgagttgtgacagagtttttttctggtcgattgatcctgttgtctcagttccctcccgttttccacttttcgctccatcatgttggtgagatatacagacagtgaaggcgtgaggattctcgttcgagcgatgtcacgtcaaacgtgactccgtgatacgtggatgaatgccatgtggcgcatgacgataggccgtctatcatctcttaatattttattacaataatccctcggggatagacactagagacctcgtacctgcagctgttttgtgccgctcgcttgccatctgggccctgcccatgcacacgcactggtctcgttcaccgactgccctcgagttccatcgatctctttcccctgacacctagttgctgtctcagagctggtctcccatagttggtttcttttagtatttgggagcagtgggcatgcttatggggaggggacgggggttcattccagcataacgtccgcaggctgtctag

SEQ ID NO: 521605 - DNA, 147 bp, Homo sapiens
tacttgaggcggcatctgtccgttacatgtgtacagtttctcccttcagctgatcacttacctctcagtaccggcagatacctcatctcggtgcttcagtactggcaggtggtagctttttgcccatcctgttgtcctcaatgcccg

SEQ ID NO: 521606 - DNA, 968 bp, Homo sapiens
agcgggtgtgatcctccttgtgcggtctgaagatagatcgccatcgatgaacgacaccgcgaactatccgcgagctatacagagtgtcatgaccaagggagtactggcagaggacagcaaatggctcgatgtgatgctccgttctaccccgtgggaaggcgacaggtgacctaagacagagattgcgggaacaaactagacatatatggacagagagcacagccggagtgtcactccttgatacttggacttgcatgaaactcactttagggcattgggtggcgaatgacaaaacatgagtcgtgtcgtgtgatggaatttattgcattttcgcgctgagaatttagtggcatgtatgtaatggacagtggaagacctgaataccataggaactttgtcggggtacgaatggtcggttgtcagtgacgcataggaaaagaaagaggcttcgaagcaagaggcaaaggagaagggagacgtacgagataccgggggagatgtgtagtgtgaagaaattgtacaggggagtggagaccaggtgcaaaaggtctctttggaaagaggaaaagatctcgaaatgcaaaatacaagttatacgatcgaattataagcaagttaaagtgagttccaatggatggctggaagtgtgaggaagatgatagcgaaaaccaaggaaatgataaactagtatgtgggcgtgggtgggtccaatgtgaggtgggaggactggcttcggtctatgggaaaagtcgcaagaaattgcagagcgaatataaaattctgccaggtacaggcaaggtattgcaactttgatcttcgcacacggaaccgatagcgtaatcgcagtcgcctaatatacaggtctaccggttgtttctcatcgaatggatggggtgtggttcagccggttgtcgtggttgggtccaatgggtgcgttcatttttcctgttgccttatagagaggcctg

SEQ ID NO: 521607 - DNA, 248 bp, Homo sapiens
aacgggtgatgcggtcgactctgaggagatgaccctgaacatttctggagacctgcgccagctgagcgcgatgttgatagtcatgcgcataatcattgtgctgaagagccttgagctgtatgtctgagctggcagaagacacggagaagtacaagagattctatgaggcacactctaacaaactgaggctaggaactcacgaagactccagtaaccgtcgccgactgtctgagctgctgcgctatcat

SEQ ID NO: 521608 - DNA, 452 bp, Homo sapiens
gactaatccagtagcatgactgctctggcaagggagcacatccaacgacctaggtctgagtgatctggctggaatgcagacatgtcatacactttaatccctctggctggaatacagacatgcccttagtatacatgttatttgaaagtgacatttaactgaggagcaggcaaagtgacaaatcagagaaagatctgacagaataagtcggaggtaggatatgctcagctctctccagaacagcataggaagagcagctatttaagagcggttgttctgtgagagagtcagttatttggagtcagtacagtgagggcagtgcattcatgccctgggcagtggagctgagttcattcacgagctcacacagttcagggcaggtcagcagaggccattgaagccagagaataaaaagaagcaagacgatgtcgagcgatcgcgcgcgtcgacgc

SEQ ID NO: 521609 - DNA, 130 bp, Homo sapiens
cttgatctagaggatcccgtgtggttaattccacacaacgggatttagggaggagtttccttgtgccactgtttgacctcaatggatgggtttcgacttaaaaaactctataaaataacttcatcagccc

SEQ ID NO: 521610 - DNA, 127 bp, Homo sapiens
atggtttgactggcaaattcgctttggactcgtgtattctcgtttgtcataccgcatcacactaccactgctttttgaaaaatggtcatggggcaatgcagaataaaagaaataccatgatttagtg

SEQ ID NO: 521611 - DNA, 172 bp, Homo sapiens
  misc_feature (1)..(1): n is a, c, g, or t
ngtttgtttttttgaaatggggtctcgtgttcaggctagcagtgtgtggcacaatctcagctcattgcaacctccgcctcccaggttcgagcaattctcctgctcagcttctcaagcagctgggattatagacgcgcacccacatgcctggctaatttttctatttttagta

SEQ ID NO: 521612 - DNA, 382 bp, Homo sapiens
tgattttaaaacaacaagtgttacctgggcttctaaaagggctctgtaaagaggtctgatttaataaattgaagatgtctaattagatcttgacttgttctgagaatttttataatgaggaaaaaaaatgttattaactcagaaccccattttagtaaatgatgaatgcaagaactgtcatgagaaatgaagaactgcttgcaaatatacaaataaaacacataataagtaactctcccagtgatattaaattatttaatcactcataccctacaggttatatcacagtaattacaatgaccggaagcagttgggtcctaaccaatgagaagactgatttttccacatttaggaccatttagaggactataggacattcaag

SEQ ID NO: 521613 - DNA, 226 bp, Homo sapiens
tatgatattaactgaacatctcatttgattccattttattctccttcttaatatatcaattatacttctctaaaaatattttaatggctgttctagagtttgcaatatacatttttaactattataggttcacctttaaaaagtactgtacaacttctcatgtaatgtccgtacctgattacctgataacagagtacacccaattcctcacccccaccgtcgacgc

SEQ ID NO: 521614 - DNA, 117 bp, Homo sapiens
ctgggagaagtttattctgttttcacatcttttttgttggggagagtgatagacaaagttctgggttctgggcatcgtcggcgcatgcttgtaatcctacttgggaggctgaggcag

SEQ ID NO: 521615 - DNA, 240 bp, Homo sapiens
gattggaaataggttattataaatatatcttttgctattttcttgctctctgaaggaatgtgtacaacaggatatgggccgggtgtggtggtgcatgcctgtagtttcagctactggggaggctgaggcgggagtatttcttaagtccacgaatttgaaactgcagtatgctgtgattgtgcctgtgagtaaccactgcacaccagcctgggaaacatagtaagatcctatctctaattg

SEQ ID NO: 521616 - DNA, 663 bp, Homo sapiens
tacgtacacaccgttcgttaacccacggatgcccaggtggcccggctggggttaccacagccacccctagtatgccgcaggcctgcctacccaccttcaggcagtctatgggacgcagggccccatctcgtccctcgagtcgcctgtgtggccatgtgttgggtccggtcgtccccaatcactcgttgctcgactacagacacgtttggcatggactgtcttggtgcctcaaccaggcaggacgcgcgtagcaagcgcggggcaggcggatccacctaagaaccacacagctcccttgtgcgagcacgtagggcgaaggtgagctcgctgtggttgctacccgggtaagcgtgggaccaaataacaacctaatctaaaaaaatctcactaaggtgcctacaaaggaacctaccgatcatataaagcatgggtcgggtgccagaaacggacatgaaaagtcctaccatagaaaggtgagccaacgaaacaatgaccaaacaaacaagcatcccccacaaaagtgacggcgagaaaccaaataaaagaaggtgaagatccaacataaagatgagcatgcatgcaatcaaacgaagaaaacagggcgtcaaacaacaacattcatcacgagaaacccatgaagaaaaacaaaaacaaaactacaac

SEQ ID NO: 521617 - DNA, 411 bp, Homo sapiens
tctagaggatcccatgcagattgattataatccaagtttattgtgacacaggagccttggacaagaagaccaaagacccaggaaaactgtctatttttatgctcaggttcagtgaagaatggacaggcatgtaaaaaggtatcggacaaaaagggaatgacctgatgtcatagactgagggggacacccagaaaggcctgtccagccagattcttcctggcctctccgtgctgcatttcttcctccagggtatagggcagaacccctccggaatgagggtcttatgaccccacagtcagataaggtaggtcagagactttctttatggccagcgcttacacagaaaggctggggaaagttcgagtactagttctggattttatgattggctttgggaaagagcggttctta

SEQ ID NO: 521618 - DNA, 229 bp, Homo sapiens
ttgacatgataaatcgagctctggtacctgaacattcgtgtcctagtccgctttcagttccatcctgtatacctggctctgccttttagatagcaggagcaaattagtgaaagtactaaatgtctgatatgcagaaataatggcataagctgtctctctctcttctctctctctctgcctctgctgccaggcagggaagggccccctgtccagtggacacgaatgttca

SEQ ID NO: 521619 - DNA, 1842 bp, Homo sapiens
tacagcaagtctccctaatcaggagttcactgaccgacctcgatcaagacccacaccagtagtctccgtgcagcaggagctcaggctccagctgtggctaccaaccatcagcggatacactcatcaccacagcacaacacatcaacagtagcacattcacagcagccgacacacacagacacacgaaacaccaacagagaacacaaccacacaccgacagttggcggcaacgaaacgcaggacgcgccacccaaccggagagaaagagaaaaaaaagaaacaaaaaaaataagacgaagagaggagagaagtggggcagatcacacacacgacaaacgggaaaacacagaacacaaaaagtagaacgaacgataccaacgtgaagaccacaacagaacaaacaaagacaacgaccaggcagaaagaacagaacgaaaaacaggaagggaaaaagaggcacaaaaaacacaccaacgacagaagtagaaaacaacagacagcgacagacaacgagagagaaaacaaagacaggcgagacagagagaaagagggagacacaaaccaacaaccgcgcagaaaagagactgagagaaacgaccccaaaaaaaccacaaaagagaactacaataacaccagggagaaatcaatacaacaacacgacaaacaacaagggagaaagtaaagacacgaacaaatgacgaaaaaacgccgcacacccaacgcaagagaaagcaacgaacagacaaaatgacaaagaaccaccaaccaacaaaaggaaagacgcggcagaacacacacactggacaaacacaagacgaagaacagaaaagcaagaagaagaagacaaagacaacacagcaaaaagaacaaaaaacgaagaaaacaagacaacaacaaaaaacacaaaaccaaaaaagaagaacaaaaaagacgaacacacaacaaacagaaggcaagaacgaccaaagcaaagcaaacagccagaaaaagaagaagacaaagacaacaagacaacacaacacacacaccacagaaacaacagaagaaacaagacacaccagagacaacaaggcacaaccacagagaaaaaggcgaacgcaacggtaggatacacaacagccagccaggagaagcaacagcgtaaggcggccagaaaaccaaaaagacgagaggggaacaacgaaacagcagcagcaacaaccgagaccgcacgcagaagcacagcgacacaagacaaagcaagaacgcagccaggaaaacgctgagaacacacgcagacatcaaagcagaccggcaacgccaaagacgagaagcaagagatacgaagagtaaagcacaaagagacacaagaccaaacacacagcaacgcgcgaaacatagcaaacgaacgtagacacgaacacagaaagacaacaggaactaaacataacgaagcacaacagaaacacgagaacaaagggcacgacacaatcgaagacgaacaatcacacagcagaaacaaccacagcagaccaaagcaagagagccacacagagaccgagagacatcacaagcagaaaaacagaaaacgcaggagtgcagcaaaacagcgagaagcacaaaacaggaagcgagaaagacaacctccgaaacagacacgacaaagaaccagcgggagccgagacaacaagcaacgagcgacaggagaacggagagacagccgaacaagcgagcacacaaaaaagacaacaaacgcaagggacaagagaccaccacgcagagacgcagagaagacacagagagacacacatgagcaagagctaaagacacacccgaccacaacaagacaagaaaccagcagca

SEQ ID NO: 521620 - DNA, 353 bp, Homo sapiens
gcgattatagaggatcccctcagggtctcaggtaagttacttagtcccggtctcgtatgcaagtggagctaatgatcatgcttaatgccgaaggtggtgtggctgtggagaccccctcactgtcactgacaaataggagctgtcagcagcccaggtgccacacaatgatggtgattgtgaggaggccccccacagccctttcctttgctattgtctgtggacattaaagccactctgccagaattgtagatgctctcagatttctgtagggtggaagccgaggacctacacacctcatacctggagtagggagcccccaaagtttgccatccatttcttctcccctgtctctg

SEQ ID NO: 521621 - DNA, 350 bp, Homo sapiens
agggcacaacgaagcttggacagtgatgataggccccgtcatatgtgcagtgtgccaactccttgtgatcaacttaacacccagatcagtgtggccactgtccctgattgcgctaatcaaacgccttgaacctggttgttctggccggtgcaggtctgcttctgcactggcacgtcttcaaaacctccttcttgagagaggccccaggaaaaagtcaatgatcacagactccttgatgggcagagagaagagatagatctactccagggacttaatcttcatgtccttgaccaggcagcccagcttggtgacaaccatctactccttgtccttggccttgccatatgcaa

SEQ ID NO: 521622 - DNA, 82 bp, Homo sapiens
  misc_feature (46)..(46): n is a, c, g, or t
ggatttgctggtgcagtacaactaggcttaataagaggacatgttntgtctacatagaagatcctaagaaatctattaagga

SEQ ID NO: 521623 - DNA, 178 bp, Homo sapiens
cctatagactagaaacatacttaggcaacacatacaatataaccggtagatgtatgcacaaagcagcccacacaagtatggattcattcacaactgcgacatgtagatcacttgttaccacatacaatggcatacttcttgccccccatccccaatactcatcatctttccctgtaat

SEQ ID NO: 521624 - DNA, 301 bp, Homo sapiens
tgcatgctgtagtgggcacagtatgagacagtcctcggtgggtgttatctccatgtgggagtgggcacgtgtgaggccttggtcccacctgttgactcagggtctctttcacggactgcggggaaggcagtgggagcagcaggaatggatggtgaaaggacacagtgtccggcccccgagctgtccgagggtagagctgggacagggtcacagtccacccaaagccgctccctccttgcctatccccagctgaaccagcaccactcaggcagtcgccgccactggggtgggtggagagcgg

SEQ ID NO: 521625 - DNA, 301 bp, Homo sapiens
tggatgggatgaaatcaacgttaatctaagctgctaccgaaagtctgtctttgttgttgctgttacgctgggggcgtggatctgaaagtcgtgttgtcaaaactcctgaaaccctgtcctgctactggtggcaacccctggtggctttcaagcccaacaagccaggtggagggaaaaaattaaaattaaaggaggtgagtggccaggaaccgaaaaccaaaagtcccaatgcttaagcagcttacgggtcccaactcccgcggtcagggcttttcaaggaaaagcttttggttttttgggg

SEQ ID NO: 521626 - DNA, 446 bp, Homo sapiens
tggtcatgtatattctgcatcaccacgtcgtcaaacactaccttcaccttttcaatctaacactatctcagcactctaaccgccagccaccaacacaaaatctatctatagcatcccacttaaccactgcctaaatattccatctggatgaagattcaattttcttcctcctctccaagctaacgaacgcgtaggcggcccaggggaatctcactggccacctcagcaccctgtcacatctatcaatcacgtgaagagaggtgcagatgagccagacagcacatgggagacgtgcccttgcccaccggaattatattcaggtgaaacgtgattgatttacgctagaactgcccgaattccccaataaaggccgtctacttcatttagaaacccaagctaacactacatctgtcggaagctacactacagtcggtttcactacacta

SEQ ID NO: 521627 - DNA, 186 bp, Homo sapiens
tatctccggagccttacctccggagccttaaccctccggagccatatcctccggagccttaccctccggagccttaccctccggagccttacctctggagccttaaccctttcgatcggcgaggcacggaggccatcgcccgtccttcgtacggcgctcagggtaagggctcccgggggtacccga

SEQ ID NO: 521628 - DNA, 222 bp, Homo sapiens
ccagctatgttgtcatcctatttccgaagccagcagaattgtcacaaactgctactgctgtcgctggttgtagccaattatcctcaatgtaagtgctgacttccttaacaatttcctcatatctcttctgcctgtatggtggcccacatgaaatcccgggtcatcctcatacagtctcatcctgcaagcctgcagaagcttgcaactggccgtctctctatc

SEQ ID NO: 521629 - DNA, 409 bp, Homo sapiens
gaagacaatgacatgagaagaagaacagagaagagaaagagggagtataagagatcgaggtagagggggggagacagatgtgagatgcagggagaagtcaatgggcaaaggagcaagattggctgaggagagagaaagtggataaaaggattagagaagagtggaggctgaagaaaatgtgtcgcaaaaaagagtatgaagaggaatgaatgagtaaagagaagaaaggtcagcaaggtatgcaaatagaaattaagttaataaggagagagagagagacagaaaaggcagaggaaggaggacagaagacaaggagcagagggaactatatatcagtgagtatgactctctctctctatctctctctctctctctctctctctctctctctctctctctctctctctct

SEQ ID NO: 521630 - DNA, 230 bp, Homo sapiens
  misc_feature (149)..(149): n is a, c, g, or t
tcggcaagtgtgcagatagtccggagtccatcaaggccatgggctcgatgacagtgcgtaccatatcatctcggtctttattcttgaatggcacggcttcccctttccggtccaggattcgattacactgtgcgcaagagtgatctcangaggcgcccttgctggtacattacggaagccaccgtggggtattcctagatgacggtgctcatgtgactgtgcgcactgag

SEQ ID NO: 521631 - DNA, 276 bp, Homo sapiens
cgctgggttggttaactccacctcaactgcctgctatgactggactaacgatcgagagagtgaggagaacggcttacgtttagtgacgggacgacgactttggtatatgattcgagactgggggctagtttttgtcatgtgagaagaagcaggccggatgtcagaggggtgccttgggaaaccctctgggacctcagacagtgacacacgggcggctattcctacgttttacttgctatagcccattatgacttacttacctgactgacgtattga

SEQ ID NO: 521632 - DNA, 702 bp, Homo sapiens
actgataaatcactaggcgtcataccgaagcagcatggaactggtacaaaacagacataaagaccaatgaaggtgaacatagaccctcagaaatacaccacacgtctacaaccacctgatctttgacaaaaacaagcaatgggaaaggatcccatattcaataataatgtgggaaatctggctagccatatacaggaaactgaaacttgaccccttccttacaccttatacaaaaattaactcaagatggattaaagacttaaatgtaaaaacccaaaccataaaaaccctagaagaaaacctaggcaacaacattcaggacataggcatggtgggcaaagacttcatgacaaaaatgccaaaagcaattgcaacaaaagccaaaattgacaatgggatctaatttaactaaagagcttctgcacagcaaaaaaacaacaaaaaaaaaaacaaatttttctccaggtggaccagacacctcagaaggggggaaaaattttgggcctcctccccttgtgacgtggtccattttcccaaatttacaggggtctaccttgttcccccaaagagaagaagcgcctcaagggggcccaggttttacgcgcccttcacaaagactttcggccaaacacttgcaggctccatctgtcccggaatgcgtcaccgtgatgctcgccatgtagatttagccgccgtgggtca

SEQ ID NO: 521633 - DNA, 218 bp, Homo sapiens
  misc_feature (54)..(54): n is a, c, g, or t
ggggctctggacaaaccagactcttctctggttgttcttcagaccacgaggtgnacccatctcttcaaaggagccctgccaccacaccaaagctcacaccagaaaaaaccgcatttacacaacaaagtgaacctgaaaaaggaacggaacatggtgcttccggctgtgaacaaaacatcagcacagtgaatcctgttttcctattcccggggcgtgtt

SEQ ID NO: 521634 - DNA, 115 bp, Homo sapiens
atccagagtgagctgatcagtgtagataactttggtcacgaccataggttcactgtgtctgtctcactgtgaatgatcccctgctgaggactcccagcgtactggtcatcatcgg

SEQ ID NO: 521635 - DNA, 364 bp, Homo sapiens
ttcggaagtgcaatggctggggaagcctgaggtaacttcctattatcattattttttgagacagtctcactctgttacacaggctgtagtgcagtggcacaatcttggctcactgtaacctccatctgtcaggttcaatcgattctcctacctcagcttcccgaacagctgagattacaggtgtgcgccacccgcccggctaatttttgttttttcagtagagacaggtttcgccatgttggccagactggtcttgaactcctgacctcaagtgatctgcccgcgttggtctctcaaagtgctgggattacaggtgtgagccattgcactccggccagccattgcactccggccagccattgca

SEQ ID NO: 521636 - DNA, 324 bp, Homo sapiens
ggattgagataagcacggtggtagggatacacagcgagatgacgggaaagacacaggcagagtctggaaaaatccatgtgcaggcttccttatgctttctccgtcccatgaagtgctacagtacacacacttcccccagcaacaaaaatgcagcaacatgtacacagtatttctgcccaggagagccaattagagactcagcacccaaggtatttattgggcacactctacctagcatgtaccaaaattccagactccccaaaagagagcacacattcatgtttgtacaaataggctaggcatagtaaatcaccattactattt

SEQ ID NO: 521637 - DNA, 656 bp, Homo sapiens
cacccgctttaggacttactcaagtgatcccgcccaccttgtagctccaaagtgctgggattacaagtgtgagccaccgtgcttggcctatctttctatttgtttgtttgctttttaaacaggtctctctctgtcgcctgggctggagtgcagtggtacggtctcagcttactgcaacctctgcctcctgggttcaagcgattcttgtgtctcagcctcccaagtagctgggactacaagcgtgtgctaccatgctgagctaatttttgtatttttagtagagatggggttttgctatgttggccaggttggcatcaaactcctggcctcaagtgacccacccacttggcctcccaaagtgctgggattacaggcgtgagctgccacgcccgaccaagtatgtgagtaattatggagaccagaagaaagtggagctgctgaacgacaaaccacgcatagaattctgtattctctacgaactcacattacatgaccatatctccagaaaaaggaaaactgataaaatctgtcaccatcaaattgtgctaccggacatgctgacgatagtatatactacagtgaaactcagatctttaagaatgaatgatgaaatcaaaattagtacgtattggggaaaattaaacatctctgggtta

SEQ ID NO: 521638 - DNA, 480 bp, Homo sapiens
gggaccagagcagtccccatcagccttacccccatttcctgagaggaggttctgtgtggtgtcaggaggatggggtccggggcaggtcgacagagccttgaagtttgaatctgccactgactctcctgtgcccttggtcaagtcacctgacctctctctacctctatgtacatatagataaaaatgaagatgattgtggtaagagtcatgctaagcatttcatttacatgatctcatatcaccatcataacaatcccatagggcttgcctatttaatcaccattttatttatttatttatttatttatttttatttatttatttttttgacatagagtctcactgtgtctcccagacaggagaatcacctgaacccgggaggcggaggttgcggtgagccgagattgtgccactggactccagcctgggtgacagagccagactccgtctcaaacaaacaaacaaacaaacaaacaaaac

SEQ ID NO: 521639 - DNA, 263 bp, Homo sapiens
  misc_feature (5)..(5): n is a, c, g, or t
  misc_feature (11)..(11): n is a, c, g, or t
  misc_feature (88)..(88): n is a, c, g, or t
  misc_feature (116)..(116): n is a, c, g, or t
  misc_feature (185)..(185): n is a, c, g, or t
  misc_feature (188)..(188): n is a, c, g, or t
  misc_feature (227)..(227): n is a, c, g, or t
cagtnactgantgtgactgggccaggcctgctgcctgctttagaagtcctggcctgccatccagagaccccctgctcctctgcctcanatgctgagggttccataggcagaacaanaccaagcctttttttccacacattcagtgaactcccctctaaaaaagacttaatgtgcagacttctgtnttntacagaccttcgcagcctgacagtggtttattgtctgtnacagacagcactagtgaaagatctttcttaacctgg

SEQ ID NO: 521640 - DNA, 242 bp, Homo sapiens
  misc_feature (50)..(50): n is a, c, g, or t
  misc_feature (57)..(57): n is a, c, g, or t
agggagcaagagaaataatcgccaacgcttctccttcaactttagtgganggagggnggacgaaaaccaggcccccccaaggctcaagagcgagcgccttgtgggggtgaggaaaagattcaaacaaacactccctctttcttttgcagccaagggacctacgaggggggctgaaatctaccccagggggtgagaaaagaaaccaggccaccggggaatgcttctgcaactaaacacgttag

SEQ ID NO: 521641 - DNA, 119 bp, Homo sapiens
gtgacaaagtgaatacccaaggggctaagtttcatatctaaagcttgtcactaagaattttcatttttaggggtcaaaatagtgttgtgtgaatgctgtaagtgttgtacatgtctctg

SEQ ID NO: 521642 - DNA, 964 bp, Homo sapiens
  misc_feature (157)..(157): n is a, c, g, or t
atcacggggtggatatataactaagtggtgtttgtaaacacagtggttggtagtgataccggacgccttcgttgtaccacctgttttgtgctgcgcctctctgttgtggaaaaaggtgtgtctcgcacggttgtgatctaatgtgggggtcgcaagnagggaggaggaatgtgttgcaacaacctggttgggagaagaaagggggggccaacacactcttttgtgtgggtggagacctatactaatagccgccccggctcgggcgttctttatttcgcccgacccggctcggcgcgcacgtgttagccggcggggacccactgacccagcgcccaaatggttgggtttatagggaaacgttgctgctcacaggtttcccccctgtgggggaaaataaaccacagacacattggccgcctttgtgggggatgtaacccacgtggctcctgttgctcctaatgtggcaagaatgtgtagaaattctatctcgctaatttggcgggatttttggggcgggggccacacatgagcttggggctcaacacacacaagaccggggcccgcgaaaatcctcgcgtatgtccccctcaatagagaatgtttttccatgaatagcggaggggtagaaaccacaaacattggctatctccgcctctcttagacgcctcggattcatctgcgtccctcccctcgccgcacacgcttggtgaaagaacacacacatttttttgagggcagtgtctatgcaaacaagatgcggagcattcctagatgatttactacttctcaccgtgcccgctgtaattcgcaccgagcagttgcacagactcttttgagtgtaaaccctgggcacctgttatattaatggtctaagaacaaacagcacgatgcttaaaagtcggccccacaacccttattaaccccttttgggtctacataaaattttaacaaactcttcataaca

SEQ ID NO: 521643 - DNA, 665 bp, Homo sapiens
ggtccgaccaagggatggcgatggcgtacttggcttggagactggctcggcgtatcgtgtccgatgtcactacttgcccggtagtacagctggcacttgaatacaacagcaatgagagccagtcagaaggactttgatgaattcattgaatcagaggtgacatgtctgtggattaacggatccatggtaaacgagagatgtacacgctacagagctctacgctgctatataagcacggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccgtgccaaaaagacaaatgccataaacactgagatgtatcatgaaattatgcgtgcacttaaagctgacagcaatgatgactcaatcatcactgtcttacaggaaatggtgactattaacagtagtgggaatgatctgactaacttcatgatattcccctggtggagtaacga

SEQ ID NO: 521644 - DNA, 637 bp, Homo sapiens
tgatggtgcctaccagtttcaggggtgtcctctgcttttagaaaggggagagaagagtgggaaggactgtgtcttatggtttgagtgccagctcagccacaatacaataaaataccaggtagacttctaaggtttttcagtctagttcctgactcctggatggcacttctgggcccacccggggcctggaaaatcttgctgccctgaagggaagaacacaggcctggctggctttgccacctgcagattgcagagccccagggccttgagcaaacatagacagtagtcatggagtggttatagcaggccttgggtgagacccggcactgtggcctcattatgagtttagtcataatggttgtggtcacaggggtactcgtgttactccaccccccagctttaggtggctcagaacagagagactctgtatgtttgggagtaagtaaggggaaagaacaagagtctctgcctggtaatccagataattcttctggatcttgtccaagactatcaaggcagtatctctacgagactgcaagaccacagcattactgcgcttggggtgccccttaaagcgcagtttagatcacaacacccaagtcctttcaaatatttgggccttgctaccggacagttt

SEQ ID NO: 521645 - DNA, 403 bp, Homo sapiens
  misc_feature (34)..(34): n is a, c, g, or t
  misc_feature (117)..(117): n is a, c, g, or t
accctagaccaaacctcgccaaaaatccatttcnctatcatattcatcgggggaaatttaacttttttcccccaacactttttcggcctatccggaaagccccgacgttactcgggntaccccgatgcaaaccccacatgaaacatcctatcatttggagggtcattcatttttttaacagcaggaaaattaaaaattttcatgatttgaaaagccttcgctttgaaaggaaaagtcctaaaagtaaaaaaaccccccataaacctggaggggctatatggatgcccccccccctcccccccatttgaaaaacccgtatacataaaatttagacaaaaaaggaaggaatcgaaccccccaaaactggtttcaaaccaaccccatggcccccatgactttttta

SEQ ID NO: 521646 - DNA, 260 bp, Homo sapiens
cgtcgtactgtgataactgtgtagaacaaaactgcctctaagctcattgatagtaatttgtctcttatgaccccatggaggaagagaacaaacccataaatggcctttggaaagcattcctaaaaagtagattaaggctgacatagtggttcatgactgtagtctcagtactttgggaggctaaggatggtggatagcttaagcccaggaatttgagaccaggctgggcaacatgacaatacctcaccatgtagtgacct

SEQ ID NO: 521647 - DNA, 549 bp, Homo sapiens
cggacaacgtgtgcctcttaacaggctggtataacatccatcagggatctagtgttgggcctcatgtgcatctgctgattgaaccctacatgctgtaaggatcggggcatctgttacataaactccagccttcctgtatagacactaactcgttttcaaaagtgtggacctagttgctggtggatgtgaaccacagaagacatgtggagcagttgtggggatattaagggaaactttcctctgccttgacccctttgttaaataaaatgactttgggagccattcattgtacagttgcaggaatgagagtgattttatgatgtggtacattgggaccatgttctaaaaccttgggtttctgagtctgctttttgagtaggtgattttgaggttgaaaaaccaggggccttcatctaggaaatacagcattttccagaagcttctttgaaagggaatcctggttttgttgccaaaatgaaacgcccggggttggcgctgaatcccacaactgtgtgatttgcttgttgagttttttgttgtccggggttg

SEQ ID NO: 521648 - DNA, 799 bp, Homo sapiens
  misc_feature (609)..(609): n is a, c, g, or t
  misc_feature (612)..(612): n is a, c, g, or t
  misc_feature (616)..(616): n is a, c, g, or t
ctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgggccgcctttgtgctgcccgagtttgccgcgcaagggccctgaatgatgttgagctgagccccaggcgccaccactgatgccacccaggacctcggaccttggagcctgcgggggtgcctcggcccctccagccccgggccggacctccttgctggttctcgcccaaccaaccaaggtgttacaagccccagaaatgctgccgggctgccctgttgggcgggacttgtctgtgtgtcttgtctctctggcgttccaccctccaagcctataccagctggtgtacagggcccatctctctgcctttctgttgcccctcactcaccaaaacacgtgtatttatagacacaaaaacacaaacancanaacnacaacacttgttctggcgctgtcggccctgaaaaactctttaaaccaatcgctgggcgcgcggccccaggatatcgagacctggcaagtcgctcaggaggactgggatagacacgggggcttcccattaaaccgggggccgggttgaactcaggcttgcgatacgggctacggacgggccaaa

SEQ ID NO: 521649 - DNA, 350 bp, Homo sapiens
  misc_feature (144)..(144): n is a, c, g, or t
ccgacggcaaagcccaatcgattggtcgcttataaacaggctgtctattgagcaagaccctagaagaaagcgggacaaggctctactgtcagaaatgacagtcctgaccagcggtcatcgtcgttcaacgctggcctcgcagangtccgacggctatcagcagcaccgacagcagcacgaataccaacaccaccagcccggcattgataaacatccggggataacccagctcccccacatcgatgaagtcataagggtaggcaccaatcaggtatccgcgcaccagaaggtaaacgcagtagaccagcagatagatcagccacggcagcgcatcccgccataacaagcgt

SEQ ID NO: 521650 - DNA, 860 bp, Homo sapiens
  misc_feature (670)..(670): n is a, c, g, or t
  misc_feature (673)..(673): n is a, c, g, or t
  misc_feature (677)..(677): n is a, c, g, or t
cgcggtggctcacgcctgtgatcccagctctcagggaggctaagaggcgggaggatagcttgagcccaggagttcgagacctgcctgggcaatatagcgagaccccgtcctcacactaaaacaaaagaacaaaacagagcataacaatgacaagtgtgagcgggcaacccggagcacgaaaaaacagtgagaacagacaggcagggctggtggacgcggaggcgcgccaggtggcggcaaggatgccagcgggaagtacctaccgatactcccgaggaaagcaccggggccgacatagtggctgggcccgatctcagccacggaaaggaccccgccgtggatgtagagctgagctccaggacgccattcacgtgagtggccatctccgagggagcctcggaggcgttgttatgtcctgcgggggtgcctcggcccctccagccccgggccggacctccttgctggttctcgcccaaccaaccaaggtgttacaagccccagaaatgctgccgggctgccctgttgggcgggacttgtctgtgtgtcttgtctctctggcgttccaccctccaagcctataccagctggtgtacagggcccatctctctgcctttctgttgcccctcactcaccaaaacacgtgtatttatagacacaaaaacacaaacancanaacnacaacacttgttctggcgctgtcggccctgaaaaactctttaaaccaatcgctgggcgcgcggccccaggatatcgagacctggcaagtcgctcaggaggactgggatagacacgggggcttcccattaaaccgggggccgggttgaactcaggcttgcgatacgggctacggacgggccaaa

SEQ ID NO: 521651 - DNA, 1855 bp, Homo sapiens
  misc_feature (616)..(616): n is a, c, g, or t
  misc_feature (840)..(840): n is a, c, g, or t
  misc_feature (945)..(945): n is a, c, g, or t
  misc_feature (1685)..(1685): n is a, c, g, or t
  misc_feature (1730)..(1730): n is a, c, g, or t
cgtgttgcgttctcgtgctgtggtgttgttttttcgggtcctgcgctctgtctgtacatttgtgtgggggtgtcgctcgcgcacgctccgctcgtcttgtctgtcgtcagggggggcagccaacctctcgggtgggtggccgtaagtagtgaacctgtcgtgggggggacgcctggttatttgttaggggtggacgcccctcttctctcggtcgcgctcttggtttccgcccgccggttcttttggggggaagaattgttcggtagaagagtgaccccttttctcgagcggggtggcgtgtctggctcggtgttggtgtgcacggccgcgcgcgtgctttggggtctgtggttgggcaccaccccggggggggccggtttggtgttgtcgcatgctagctgctccacgtccctcgtgtggtcgctgtggttgactccgctaaatgtgtggaggccggtctgcccgaggatgtgccagctagtgggcccgacacaatagtgtgatgggtgtgccaccgcgtcgcgtggatcgtggccccatgttgggggggtacactgtgtgagggcgcagaacacgccggtgggacgcccgcaagtggggccggcaaagatagggnacgcccccacagcaagagcggctgcgcccgagccgcgtcgtttatgggcgcaccgagagcgccccctttggtgggagagcacccacaaaggcccatagacgcgtcaaaataggagggggggaaggactcaccacgagaagagggtctctcggtggggttgtctcgtcccctccacggggaggtatattatgttagagggtgttttgtggtggtcgctctccccncagagaattattggggggcacaccacgggagaggccccacccgcgtttgggccgcaccaagaccctctccttgtggagcgcacaccatggtcgtctcaccgaggngttctcgtcacaccactagtaggtcgcctctgttgtggtgtttgtcgcccttgtgtgttgtcacacaacaagaggccgctggggggtctgcgtgagaaagtccttcgggcgtcttgttcgctcaggaggacgtcttgtgtgacttgttcgcaccactacagggggccgcacacctcctcgccccttcgctacagagagggtcacaccctttgtggcggcacaagagaggagcgcccctccgactttctatcgatgatacctctctagagccggcgcctcttctttgggtgtcgtctcaaagagagatatgcgagagaggtctctcgcgctcgtgcgctcgtgtcgccgcactgttcgtcgtcgcttcgtgtccacacgaggcgcgcacacgacagcgcgtgtggccctctaagcgcctctcgcccttctctctccgcgcggagatgttaagaacaccgggggaccactctcgccacaggggtttggggcgtcgcgggggctctgattaactcctctctcggcccctcgtccctcagaccctctgcccactctgtttgttgtgtagggctctttgtgtgtgcgccctgtccacacagtggggcccactgttggctcttgtgtcggccccaacataaaagggactggtgaattgctccctcctggtccctctggacaggtgatctttcctcccgcgagccccctgtcccccacaggtggagagtgagaccccctcgggtggnccacgctgtaccacagggtgttttcccgagacaccactaagaaanagggttgtttcctcgaagagattcggggtcaattgggacattttttgtaaagaacttctgttttccaaggtgattttatgacccggaaaatgaaagaattagttttcgcccaaaaaacccaaaca

SEQ ID NO: 521652 - DNA, 448 bp, Homo sapiens
ctggaattggtcttacattggggtgcttgcatgtcctcgcagctattctgagcacggctgagcgtggaatgtgaccacttgagcccggtgaacggggaggccgcattgagctgagattgcaccactgcaccccagcctgggtgatagagtgggaccctttctcaaaataaattatgtacagcgaaatgcacagatcttaactgtatagttggatcagatttgacacatgcatacacctgtgtaactcacaccccctcaagatatagaatattctcatcaccctagaaagttctctcatgtccctttctggtgaatcccccagaggccagtagtgatctgatttctgtcaccatggattagttttgccaattctggaacatcatctaaatagagttatacagtattagctcatgtgtttgacttcttttactcaatgtaatgtctgaga

SEQ ID NO: 521653 - DNA, 331 bp, Homo sapiens
gatgcaagcgatacaagatctaaagcttatctggtatttaacttttctttctctgcttgtcaatatagagttagattttatttttacatttgctatgtgtcctgatctgctctttaccatccttctatgggggacgctgtggggcagattcctttagctaccctttgtgacaactcttatcaggaaggagcgaactgttcatttctgcctactctctttcccttctgctccatgtgtactactaaataatccttgcatgcaatggtcaggcccgcaatttgggaaaagaagctctggaagcccactttgccatctctacactgttccaggt

SEQ ID NO: 521654 - DNA, 432 bp, Homo sapiens
  misc_feature (86)..(86): n is a, c, g, or t
tcttgcaaaacagaaagtgtccccattaaacactcacttcccgctggctcccccgaccccgggccccaccgtctgctttttctgcntatgaaccggcccactctggggacctcgtgtgtggggagtcacacagtgtttgtccttttgtggcttgtgcccctcggtgtgacgtcctcgaggttcctccacgctgcggcggggtgtgggagcccttccttcctgaggtgactccctctgtgcggaatcaccgtgctgtccgttccttcctccggcggtggacacggagctgctgcttccacatggccgctgattgtgaattgcgctgctgggaatggggtgcactgacttccatctttttaaggctgaatactcctccatgtatgtaataacttggttttgcaggttgaattgagataaaaactgaagacccca

SEQ ID NO: 521655 - DNA, 271 bp, Homo sapiens
  misc_feature (258)..(258): n is a, c, g, or t
gacgaatactcggcatcactaccttaccttaagctgatcaagcctagttatcattccttccggaacactctgtgccacacttctgaaactcagcgagattgaatttcactgcattctgaagtagcatttgtgctgtggctctgcatattttatctgcactcaattcaaaataaacttcacctaaggaaaaggtatcagacagtttcacattggcttctgacaattaattacactactgtttccttgtctccgagtatngcggtcgggtacc

SEQ ID NO: 521656 - DNA, 372 bp, Homo sapiens
  misc_feature (44)..(44): n is a, c, g, or t
gaattcccccccccccccccccccctttttttggggatggagtncactctgttgcccaggctgaagtgaagtggaacaatctcagttcaccacaactgttgcctcccgggtccaagcgattctcctgcctcagcctccctagtatctgagactacaggggcacgaaaccatgcctggttaattttggtttttttagtagagacagggtttcactatgttggccaggttggtcttgaactcttgacctggtgatccacccacctcggcctcccaaagttcggggattaacaggtgtgagccactgtgcccagacaattattttccttatggtattagaggtgtttttgttttatgggacacagcctcgctctg

SEQ ID NO: 521657 - DNA, 645 bp, Homo sapiens
agcggagcgaagagaaccggtcgcggcaatcctagcgcgcagcagcagcagcagcagcagcacccgcatccgctgcgggagtccgagccggaaccacacccaagtagctgccctttcctcttctgtcatctcaccgccccagcacagtaccgcgttcccagaggaaaccggcacgaccacgcccggagacatccatcacccatgatatgagcgggcgctgacggaccacggaaggcaatgatgcggctgcagaggcctcggggatgctgcgggaccctgctcctgcagtcgccccgacggagtgagcgcgactctgacggcgggcacagcaccattggacacaccatgtgaccggcgtcaccgaggcgagggagacggcacggacgagggcccggcatgacagccgagacgatccaaccgtggtgggggcgaaggagcggctaggaaccggcgagaagacaacccaaccggctagcaggggaccatgtacacaaacatccaacccaaacggaagaatactagccaaggaaactaggggcaaagggggcagacaccgccagtccagaaagcaccggggaggtcagacccaccgagactaccccggagagagcccaggacaccaaaggaacgagacccggggaagaa

SEQ ID NO: 521658 - DNA, 222 bp, Homo sapiens
accatcagcgtatgcgctgccttcctctaggtccttgagtgaggtgatagtcatctgctgtccgaggtgtcatacaccagtgttgtatggcgaacatactcctgaggaaccgcacgggctccagccacgactcgatgagcagcagggagatgcggagcagctctagattggatttctgttacgttacctccatgtcggcgggtgttggaatagagtctgaga

SEQ ID NO: 521659 - DNA, 1199 bp, Homo sapiens
  misc_feature (771)..(772): n is a, c, g, or t
  misc_feature (777)..(777): n is a, c, g, or t
  misc_feature (786)..(786): n is a, c, g, or t
  misc_feature (840)..(840): n is a, c, g, or t
gggtgcgcgcaggccgtgagtgtgcgctttgagagtcgcggggaaggagcccggcgcgcccgccgggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttgtgatgacaacgtctgcatggcctttgcaggcctcaccgccgatgcaaggatagtcatcaacagggcccgggtggagtgccagagccaccggctgactgtggaggacccggtcactgtggagtacatcacccgctaacatcgccagtctgaagcagcgttatacgcagagcaatgggcgcaggccgtttggcatctctgccctcatcgtggggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaannagaanaagaagaanacgaaaagaagaaacaaaagaaagcatcatgatgaataaaatgtctttgcttgnaatctctttcacacacttcagtattcaactcatgggatgagtctcgatgtgtaggccttttccattccatttattcacactgagtgtcctactataaacttccgtattgttagactgcttcagcgacccagtttcccctggggggcgggaggcccaaggaaccccccaggggggccataccttgcgggctgcccgggtttgcgtttaccgaggcgggccccctatgggagtgcgcatcttataccgcatgggtatggcgaccgcgcttttaccaggtccggtgacggtgtaacctccctggcccgggacctgtgtgaggggccgcttatccgtgcctgcacttgttggcacatgccttg

SEQ ID NO: 521660 - DNA, 118 bp, Homo sapiens
tcgagctcggtacctgccctgcaggctgaaaacacatctgctctaggcggatggtacctgcccctggcacaagcctggtgagtcctccaattgcccatcctgccgagtccgctgcatt

SEQ ID NO: 521661 - DNA, 1293 bp, Homo sapiens
gggtgcgcgcaggccgtgagtgtgcgctttgagagtcgcggggaaggagcccggcgcgcccgccgggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttgtgatgacaacgtctgcatggcctttgcaggcctcaccgccgatgcaaggatagtcatcaacagggcccgggtggagtgccagagccaccggctgactgtggaggacccggtcactgtggagtacatcacccgctaacatcgccagtctgaagcagcgttatacgcagagcaatgggcgcaggccgtttggcatctctgccctcatcgtggggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaaggtaatcaccaagtttgtctgctttctttacctgtcagttttctcccatgatcagggctgagcagtaccagtttcgaaggaaacatcatagggccattctgtggttttaacattaggtgtctttctgaggcttcccatacgtcaaagagaagattcccatcttcctctgattagatggcccacgcgtgttctctgcgcatgctgagcggctgccagccagatctgctactgctgctgcttaatacttgcctaggtcaggccagcatcctctcgtttttcttggggctccttttccaagaggcctgatgagcagcagcgcccaaagcctggccggtccttccccagaagagggcagttggctccttcggcacctctgtcgcgccttaaggtaactactgaacgttttctcctcctcgacttctaccacctcgcagccacttgcgcacgcatctctcctctgtaattcccacgcgcctccatgctcactcctctccgcacgacttccgcccgacagcactcttcctctctcacactaccgcctcctccttggtaacttcctctccacctct

SEQ ID NO: 521662 - DNA, 1122 bp, Homo sapiens
  misc_feature (546)..(546): n is a, c, g, or t
  misc_feature (1122)..(1122): n is a, c, g, or t
ctcatggccgttagaatggcgattattaaaacgtcaggaaacaacagatgctggagaggatgtggagaataggaatgcttttacactgttggtgggagtgtaaattagttcaaccattgtggaagacagtgtggcgattcctcaaggatctagaaccagaaataccatttgacccagcaagcccattactgggtatatacccaaaggattataaataattctaatataaagacacatgcacacatatgcttattgcagcagtatttacaatagcaaagacttggaacccacccaaatgcgcatcaatgatagacaggataaagaaaatgtggcacatatataccatcgaatactatgcagccatgaacaaggatgagttcatgtcctttgcagggacatggatgaagctggaaaccatcactttcagcaaactaacacaggaacagaaaaccaaacaccgcatgttctcactcataagtgggaactgaacaatgagaacacatggacacagggaggggaacatcacacatcggggcctgtcggggntgggggttagaggagggatagcattaagagaaatacttaacatagatgatgggttgatgggtgcagcaaagcacatggcacgtgtatacctatgtaacaaacctgcgacgttctgcacatgtattcccaatacttaaagtataatacttttaaaacaatggtgaaagacgagcctttttttaggactgttgccataatgacctgtagactgattcgaatatagtgtatcagcttggcaaccataaggggagaaccctgtgctccattaagaaacttctagacattcaccacaaaacaaacagaatatcaagataaaaagaaaagacacaacaagcacaacccagaacagccagaaaaaaaaaaccacaaaaagcgagaaagaacacagagacaagagacgaagaacaaaagaagacagaagagacagcaaagaagagacaccaaacagcgacaccacaaaagaacgaaacaaagagagagaccacaaacacaagcgaaagaaagcacaaaacagagaccaactcagactagaaacaacgaacaacagagcaccacaaaattgactatgcaggacan

SEQ ID NO: 521663 - DNA, 666 bp, Homo sapiens
  misc_feature (7)..(7): n is a, c, g, or t
  misc_feature (335)..(335): n is a, c, g, or t
  misc_feature (356)..(356): n is a, c, g, or t
  misc_feature (412)..(412): n is a, c, g, or t
  misc_feature (432)..(432): n is a, c, g, or t
  misc_feature (436)..(436): n is a, c, g, or t
  misc_feature (447)..(447): n is a, c, g, or t
  misc_feature (465)..(465): n is a, c, g, or t
  misc_feature (493)..(493): n is a, c, g, or t
  misc_feature (514)..(514): n is a, c, g, or t
  misc_feature (536)..(536): n is a, c, g, or t
  misc_feature (554)..(554): n is a, c, g, or t
  misc_feature (588)..(588): n is a, c, g, or t
  misc_feature (634)..(634): n is a, c, g, or t
cagagtnaaactcaacattttcatcttttacccatcgacctcgtccatctgggatccatccagagcttcgaagggtgagaaaatggtccagggctcgtcttcttgtggggctcatgggttcaggggctgagaaagttgcggactcctcggcctgtgggccagccgcaggttcaggttccctactgatcttcccactttggagtttgacctctgagggtggcaaaggggaaagggagaaagaaggaccaggggcttctggtctgtacttccggcggcagcgactgtaatagtggggagctctgttcagagccactctgggtgaaaagtcgtgtctnagttagccagaggagccttanctttggtttcttccccttcctccaattgcattctgatgttttggatttctgccttnctttccctttccccggctgncttncttgcccaaanaaaagcctgccaagcggnaccagatgtttcttgccttccccggtgnggcagttagcatggccagggntgtccagttcccggtcgatggngggcagaaggcacaagcnaagcgtccatcccgaagcatcacccccttacccnctggaatgtaacttgctaggaggtccccgactctcctttttttgancccattgagttgactccaatcgtctccttccc

SEQ ID NO: 521664 - DNA, 118 bp, Homo sapiens
cacccagagtccaacagtgccttcagatatcaagagggaatcttggttgctttttttttaagctattctgatgcttttcaatatggttttgacattgataataaagttttctaagggc

SEQ ID NO: 521665 - DNA, 113 bp, Homo sapiens
aggggtccccattttcccctcccccgaggccatgacatttccagtttgggcaacaaagggagactccctttcaaaaaaaaaacccccctttttaataaacatgtgatatttga

SEQ ID NO: 521666 - DNA, 103 bp, Homo sapiens
acaggtgatgtctcggggacaaagggtggcgcactactcatatcgccgttcacaaaacggaagatgggcttgctgattttcgtggtttcccactaaaggtcca

SEQ ID NO: 521667 - DNA, 325 bp, Homo sapiens
ctggtgtctaactctactagtatctgctgctcagctccaagtgctgagactcaggcgtagcaggctctgcagagtgattcttaaaagagagatatagacacagctcaaaatctattgggctatgcagatgttggcttagctgagaaataaaatgatgagcgcatgtagcagaggatacttgacaggttttgaaacgaatgtcagcattgaggtactgaggcatctggatatgctggtctggcccctgggagccgcaggagataatggagatagagattctatgggctgagaccattggtaggtatcatggtgttgaggaatactt

SEQ ID NO: 521668 - DNA, 599 bp, Homo sapiens
ctttgaggctgccagtgacaggagcgggctcagatgatctatgccttgagcgaagaactgtcccactcggtgtcgcatgatcgacggcatcgtctcggcgcgggtgcatgtggtgttgacggacaatgacctgctcaagcgggtgatttcgccgtcgtcagcctcggtgctggtgcgctacgacccgtggcaccgatatcaatacgttgatcccgcagatcaagaccctgtgtggccaacggtatttccagggctgagctatgacggcgtgtcggtgacggcgatcaaggccgccgtgtccatcagccagaacccggcgcaaccgcgattgacgcgcttcatgggcctgtggctgttggaagacaacctcaatcaggcgcggttgctgttcggcggttagctgctggtcgccatcggcgcgtgcggtgtgttggaccgccagcaatgggcgcggcgccagacccaggcgttgtatgtgctcaaggagggtaaatgagcctggtggagcgttggcaggggctgatcgcccagccgttgaagttagtgcgcgaagcaaagcctcggggaatgtataggcgacggcctgcctgcgaggtgct

SEQ ID NO: 521669 - DNA, 235 bp, Homo sapiens
ggtacaggtatgttcatggagttggcccgctctacacagaccctcatctcccagacttggcagactcagttcctctcacattgctttcagtcacagctttccgtggcacccattactggattctcctatcttcatggtaacacccgtgtccacagtggtcctatgttccctaggttgctcaactattaaccccctatactctactgggtcttcattttctatgcttctcccacac

SEQ ID NO: 521670 - DNA, 280 bp, Homo sapiens
  misc_feature (78)..(78): n is a, c, g, or t
ccccccccccctttttttatttttaacccccagggttttgggccccaaataaaaaaggaaaaaccccgtttaatgttncggtttgggtttttttatttcccccggggggaaacgggtttccccggaacccattcctttgaagccaaattgttttattttttccctttttttttacccccccccaacccaaattttttttttccttttgggaaaaaaggaaaaagccttttttttttttcggtttttggtttgttttccaaaaaaaaattttttttcccca

SEQ ID NO: 521671 - DNA, 964 bp, Homo sapiens
agcgtggctgaggaggtgcagcagccggagatggcggcggtgcttgaacgcatgagcgactcgaggtgtccgtcgacggcctcacgctcagcccggacccggaggagcggcctgtgggcggagggcgccccgctgcttgccgccacctgctgccaccgccctctgccacctggatcctggtctgcggccctgtggcgcctcaatgtggatgcatgccctgagcccggggaggcggcggctggtgggcgcggcggaggaggcgcggcggctggagcagccgctggggtttcgcgcctggacggagttgtaccggccttggcactgcgcttcttcaaagaaaaacgatggcacaaagccatttcaattccaactttattgaccgaacacaattgacagctttgtggcacgtgccatcacgcaagttcttattgggcccatactaatcccagacacttgctcctgaggttcggacttctttgactgtgtcggggacctgacccggcaggaccagcactgggcagcccttgggaaacatgtctaaacgaggatgccatgctggacgtttgtcaagctcttaacattaggtgttgccatctcttttcaacatatgttgcgtccacaaactagcacgccggcagagcaagacacacccacaggaccggcggcaccaccgagccgcaccgcggccctgaccacgcgcacgccaccgacacccggtcttgcccccgcgccgccccccaccgtacccgccaccccccaccccccacaggcttccgcaccgggccccgccagcccgtcccacggcacaccgcgcttaggaccgcacacaaacggggcttcacgcatgtgcacgcaacgcacaacagcgcgccacaataacattggccacctattaacacagccccacaactctgccccgttcacgttccccggcagtcgttgccatccccatagccgtactccg

SEQ ID NO: 521672 - DNA, 891 bp, Homo sapiens
agatcaggaagaaagaagatggaacaaaaggactcagcagatgcttcatggtcttcagcgtgctcttgctaaaactggagctgaatctatcagttgcttgagttatgtcgaaatacgaacagaaaacaagctgccgcaaagttctacagcttctgggttcttaaaaagcagcaagctattgagctgacacaggaagaaccgtacagtgacatcatcgcaacacctggaccaaggttccatattattcttagggggctagaaccctattataagcatagtgtggattcactagtgcttacaaattgcccccatgtgtaggggacacagaacgccttgagaaaacttagattttgtctgtacaaagtctttgcctttgtccttcttcatttttgttccagtacattgaaattcgtcaattgcatctttgagggaaaggtgattagatgggtgtgtaagtgttctgatggagaaaaacagcaccggagggactcagaagatgatgtgaacagttcagaacagatgtgtgcatattggtgcatgtaaataatgttgaggtggagtcaaaagtcatgattttatcttagtgttcattactgatgacaacggaaacctgtgtgagaagaatgctgagcgtgtagttaaaactcaggtgtcagtccttgaccacgaaggaacaagcgaacaacattctgtccaagcaagcaccatggaaactgcgttacacctctggggggaatcgaacacaggggcctcggaatgtggacggatgcgacgccagggtagcatggtctactgaccagcaaagagggagcggcaggccatgaaaccagatgaagcgatagaggatggacaggacgggagaggaacacgcgcgagaagggagcgatccaa

SEQ ID NO: 521673 - DNA, 98 bp, Homo sapiens
gttatttgttagcattaaacaaaattttttttgcaaattgggttcattctcttgatgaagctgagcaactgtcccacaaggtttagtttgtacttgaa

SEQ ID NO: 521674 - DNA, 111 bp, Homo sapiens
ccttaatttcaattgtttaccctgaagtgacaggctcacttcatcatgttttgagaagacacggttgctgcctctcaactgaaacaactgaaccagtctagcattaaccac

SEQ ID NO: 521675 - DNA, 416 bp, Homo sapiens
cacgaggggtggcgccgatccgcgtcgcgcaacctgctcgcgaacatctcgaatccccaatcccgaatcccaaatctcgctcctttccttccatcgcgatgaagcgatagactgccggcaccccgcacccggccggtctcatggtccccatcagcttcgagttctatccgcccaagaccgacgagcaacgcgcgcagctcgacaagaccgcggcgaaactgaagaccaaggcgccggagtacgtcagcgtgaccttcggcgccggcggctccacgctcagccacacgccggaagcggtgcagcgcctgcgcagcgagttcgggctggaagcggcgccgcacatcacctgcatgggcggctcgcgcgaggagatccgcaacctgctcaagctctaccgcgcgctcggcgcccggcgg

SEQ ID NO: 521676 - DNA, 463 bp, Homo sapiens
ttctacttcagcgtgaaccactgcgtatagaatcttcaggtgtatagagtctctagcttgaagcctcgctagcaccgcaggtccctagttcgagcacaggtctgtcatagggaagatcctttggcaatggttcaagcggaaatcacacagtttgcactcacgataatggcgtatcatcgcaaggatcacactggtcctaactagcgcaaatcatggcggtctccagtacgtcctggacccattccagaagctccgtgatcagtcataaagtcggataaccctatcatgtctgaaccgtagcagaacactaagcctgcgcgagcagaagcagtatgatagatgacttcatcatttatcgcgtgcactttcataatcatcacacctgacaacatccttgtaaaggtccaacacgatattgttcatgtgcactaactgcagtatctcatacaggcgcacgtgttcg

SEQ ID NO: 521677 - DNA, 461 bp, Homo sapiens
  misc_feature (37)..(37): n is a, c, g, or t
  misc_feature (43)..(43): n is a, c, g, or t
  misc_feature (46)..(46): n is a, c, g, or t
  misc_feature (58)..(58): n is a, c, g, or t
  misc_feature (88)..(88): n is a, c, g, or t
  misc_feature (172)..(172): n is a, c, g, or t
  misc_feature (211)..(211): n is a, c, g, or t
  misc_feature (231)..(231): n is a, c, g, or t
  misc_feature (233)..(233): n is a, c, g, or t
  misc_feature (288)..(288): n is a, c, g, or t
  misc_feature (312)..(312): n is a, c, g, or t
  misc_feature (395)..(395): n is a, c, g, or t
  misc_feature (423)..(423): n is a, c, g, or t
  misc_feature (436)..(436): n is a, c, g, or t
gcacgaggggtcatccatcatcagtgttgcactagtntgaccncanagtttgggaagntagtgtccaggtggtgtgaggatatggatntgacatggctgtgcccagagggaggaatatgtaaaacaagttgatggtttgatattttgccagagatcagtcctggtattcccncaagatcatatggcttgcttcatacctctcttttaattnttcccgtaggtcatgagtgncnctgaatatgcagagtggctgaggaatcattttttagctgaaaccagcattgacancagggaagaattactacttgaatntgccatgaggttggagaacaaacttacattacttggtaggtgaattatgtttgtattgcctgaatggaggattttgaaaaacnctggatattttgaataagggttattttnttccattgttatntaataaacaaatatggttttgccta

SEQ ID NO: 521678 - DNA, 426 bp, Homo sapiens
gaaacgcatccgccatacgtcatgaaaaaggaattttctatgagttgaggagacttgatcgatggctacgccatggctagctttgccaccctccaggccttgctgaaggatgcatctattcagcccccagagcgactggaacatcgtctgaagcattctcgggaagcagcaaaggtgtggctccagtggcgccaccggccagccaggggacagctctgatcgagagcctgcccggccccctggagatctggcccgaaaatggcccaataagcgtataagaaaagaggtgacggtgcaccttaaaactctttaggcagaatgtatttcccacagccccgtttttcatcagcaacgccactgccccttgtaaacagagaccccagtttctaaggacacagaggcatgcagggccaaatttgagccctt

SEQ ID NO: 521679 - DNA, 364 bp, Homo sapiens
gtacaggcaagacaggagctcagttttgtacatgatgactttgaggcacctattagcatccacatagaaatgttggataaactagtctggagttcaggaaaagtctgagttgaagatataatttttttttttttttgggtataatttccccaaagtttccagacatatgtcccgggggtgtctgaggaacagaaggaaggccatgtaatctgagaatgcgggagccaattcacagtgaccggggggcccgtgaagaatggggcataggaataccatatttacagaatcctatcatggtaatgtatgtccagactataagaagggaaacaagtaaggaggcctcatccggtaatccaagggggac

SEQ ID NO: 521680 - DNA, 721 bp, Homo sapiens
  misc_feature (256)..(256): n is a, c, g, or t
cccacgcgtccgattgatacacctgtatttgaactaaaggaagcactgatgggaaagtatggggaagactccaagtcttgatctatgacctgagtggaccaggcggggagctcctgatcccttcagcattatgacctcacggtgtccttattgctcggtatttggcaagtgaataaactgaccaagattaaacgctaccacatagcaaaggtatatcggcgggataacccagccatgacccagaggtccgataccnggagaatgtctaaccagatgtgattttgacattgctgggaactgtgatccctatgatccctgatgcagagtgccgtgaagatcatgtgcgagatccttgagttcactttcgagataggcgactttcctggtccaaggtaaacgatcgactgcattgctagatgggatgtttgctgatcgtgatggtgtgtatctgacagcaagttgccgataccatctgctcctcagtagacaagctggacaaggtgtcctagggaagaggtggaagactgagattggtgggagagacgggcctgtgctacctgaggtggctagactcgcataggaggactatggtccagcaagatggtggggtatccctggtggcacagctgctccaaggatcctaaatctatcccaatagtcattagctaggcttggatgggccttgggagacctgaagttgctcgatatgagtaactgacca

SEQ ID NO: 521681 - DNA, 306 bp, Homo sapiens
attttgctcctttgttgcttatatgctttattcagacagtccatggaatatttcttgagcgtctactgtgtgccagtcagtgtttgtaggagctggagtatagtgtactgaggtgggatcgatagactgtatggtctcaaggaatttatagttttaatgggagggcgtagagggtgaagtcagacctgtaggagatgcagatatacagacatggggcgtttagatggtggaaggtgccttgaggatgatacccatgggatatgtgaagtggtgtcatacctatcaggtctgagttaggaggagcag

SEQ ID NO: 521682 - DNA, 313 bp, Homo sapiens
cggatccttacagctcacagcacacccggctaaaatttttgtttatgttgagacggattctctatgttgcccaggctgatctcaggctcctgggctcagatggtcctcctgcctcagcttccaaaggcacaggccaagttgtagctttgtcccttgccatcatgcccaacaaagaggttctatacccttttaatgaattgactttcataaacttggttatgtttggtgggccaagttctttaacgctggaataagctgctgtaggttgcttggaactaagctgctgtagttgggtacccgagctcccaattcc

SEQ ID NO: 521683 - DNA, 2429 bp, Homo sapiens
  misc_feature (1602)..(1602): n is a, c, g, or t
  misc_feature (1687)..(1687): n is a, c, g, or t
  misc_feature (1725)..(1725): n is a, c, g, or t
  misc_feature (1731)..(1731): n is a, c, g, or t
  misc_feature (1736)..(1736): n is a, c, g, or t
ggcgggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcggcctgtgcctacctgcacccagcactgagccgcaccaacctcaaggccgaggccgagacgcttgtgagcagggtgctatttgagggcacccgtgcagtgggcgtggagtatgttaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggagggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttngggaaatgagacaagtactgggcagtgaatccagctccttttccccagcctttccctgtgggccatttggggaaggccagcattncagcctgagatgttcctccctgcctcctgggggggcanaagggntaggntggttaactcctgccgcatccttccctgcctcctggagggacagaaggggaggatggttaactcctgccgcatcctttttcttgtgttcacgtggcattctctaacccagggcagtggttccttcccaggccatgcacagaggctgggtgcctgccagacccacggagggttcgcgaaggaaggggcatcctccttcttgagctgcaagctttagctgaggcagtaagtcacacagtagttagttcagcctgggctggcacataagtccccagtgtccctgttgagaggggaaagttgcctgctggttgaaaaactggcttttcctttctcgctgcctaatttcactctcagagtgaggcaggtaactggggctccactgggtcactctgagagggttgtggctctggttcttattaaaccagggccaggtgcagggctcacacctgtaatcccagcactttgggaaggtcacttgagctcaggagttcaagaccagcctgggcaacatagtgagaccttgtctctggaaaacaattagctgggcatggtggtacacacctgtagtcccagctacttgggaggctgaggcgggaggatggctttagcccaggaggttgaggctcctgtgaaccctgatggcaccactgcactccagcctgggtgacagggtgagaccctgtctcaaaaaaaaa

SEQ ID NO: 521684 - DNA, 561 bp, Homo sapiens
attcgcggccgcgtcgacaaaaagcaggcattgctattttaattccagacaaaacagactttaaaccaacaaagttcaaaaaagacaaagaagcgtattacataatggtagaggaatcaattcaacagaagacctaattatcctgaatatatatacacccaacacaggcacactcagattcataaagcaagtgctttgagacctatgaagagagtgagatagctacacaataacaggaggagggttcaacgccccacagagcacattagggagatcatcgaagcagaaaactaacgaagatattcaggacctgaactcaaccaaatggacctaatagacacctacagaactctccacccaaaaacaacagaatatacattcttttcacgtgcacacgggtatactctgaaattgactgcataattgtccataaaacaattatcaggaaaatctaaaaaagcaaaatcacactaaccacagaatcagaccacagcactataagaaattaagtcaatactaagaagaaaactcaaaaccatgttattacatggaaaataaaca

SEQ ID NO: 521685 - DNA, 1117 bp, Homo sapiens
  misc_feature (54)..(54): n is a, c, g, or t
  misc_feature (203)..(203): n is a, c, g, or t
  misc_feature (212)..(212): n is a, c, g, or t
  misc_feature (377)..(377): n is a, c, g, or t
  misc_feature (392)..(392): n is a, c, g, or t
  misc_feature (404)..(404): n is a, c, g, or t
  misc_feature (413)..(413): n is a, c, g, or t
  misc_feature (426)..(426): n is a, c, g, or t
  misc_feature (477)..(477): n is a, c, g, or t
  misc_feature (491)..(491): n is a, c, g, or t
  misc_feature (495)..(495): n is a, c, g, or t
  misc_feature (507)..(507): n is a, c, g, or t
  misc_feature (547)..(547): n is a, c, g, or t
  misc_feature (550)..(550): n is a, c, g, or t
  misc_feature (555)..(555): n is a, c, g, or t
  misc_feature (559)..(559): n is a, c, g, or t
  misc_feature (572)..(572): n is a, c, g, or t
  misc_feature (574)..(574): n is a, c, g, or t
  misc_feature (589)..(589): n is a, c, g, or t
  misc_feature (609)..(609): n is a, c, g, or t
  misc_feature (615)..(615): n is a, c, g, or t
  misc_feature (625)..(626): n is a, c, g, or t
  misc_feature (630)..(630): n is a, c, g, or t
  misc_feature (702)..(703): n is a, c, g, or t
  misc_feature (707)..(707): n is a, c, g, or t
  misc_feature (712)..(713): n is a, c, g, or t
  misc_feature (717)..(718): n is a, c, g, or t
  misc_feature (720)..(720): n is a, c, g, or t
  misc_feature (722)..(722): n is a, c, g, or t
  misc_feature (728)..(728): n is a, c, g, or t
  misc_feature (1116)..(1117): n is a, c, g, or t
gcggcagcgaaagcaaaatccgatctctctcccgggggagcaaaatggacgaanggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttangagcgcagngcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacncccgctcgggccacncgggttctgccntcaaagctngtagctgccccanacttgggggtggggggaggggaaggggcgaggctggcgccccctcccgctntgggctcccgcgtncgtngcagcagctgtngccaaatgaaccccggaatgcggacgtgcaaaccctccanccnaaccncagncacacacgtcgcngncggagaactgagaanggggcgctgggtccgaggtnctgganaagcaagaanntcanctgcaaacaggcagtcctcagctctggacttctggatcacgacgtcgatatccttctgaattcggtcttgcnntgancacannccannanantaatcntgggaacagaagcagacgctatgtcacgccagaagaggcaagagaaagacagacaagcaacaagaagaaaggagagaacacagaagagaagagaaaaagggggggcggaaaacagaggagggacgacacgaggacgaacacgaggataagagaggaccgaaggagggggcaaaaaagacgggaggggcgagagaagaggccgagcggacaagcggcggcacggtggaggagcaacacggagggggacaagtgaacacacacagaaagagggcgagcacaagggaagaacgcagagacacgggaagacgggacaaaaaggagaggaaagacgaagagagcggcggaggcgagacggacgacggagaagcgagcgaccggcccagcgtcnn

SEQ ID NO: 521686 - DNA, 146 bp, Homo sapiens
gcccagcaaacatgcaatcatgtcgtgccagctccagcaatcatgcgttccaagctgctggcatctccattgccccggggccggcacattgggtcaccggcagctcgcacattcgtcacatccatggtccattcagctggtttccc

SEQ ID NO: 521687 - DNA, 131 bp, Homo sapiens
aatgaaggtaatggagggtgatggtggctatgatggtggggatgatgaggctatgttgttttttgtgtgaattcttcgataatgggcccatttgtgggcaaaaatgcctggttacgcgggggcaggcctcc

SEQ ID NO: 521688 - DNA, 108 bp, Homo sapiens
tgatatcatcaagagaaaaaaaagaccgacaaatctcttgtgcgctaacttttcaaggtggccttgtgaaggaaataatataccctctattactataatatataagac

SEQ ID NO: 521689 - DNA, 759 bp, Homo sapiens
  misc_feature (49)..(49): n is a, c, g, or t
  misc_feature (280)..(280): n is a, c, g, or t
tttcactccacgtagtccctaccctcaggactggtgggagaagaggctngctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcatgtgaggaggagagagagactcccgtcggtcccacccacctggangagcatcacagccctcattgacggtgcgggctcagttggcccctcggccccccgaatggcccctgaaggtccctaagaatacccatcataggctactgtacctgtgtcctggcccgccctctaactgtgacccttctgcgggacgagggcacaagtaagttggtgaatatacctgactgattaagggactacaatgaagatcctccgatcaatgcgcgcaagactatgctgaaggatgtcatcagagaatatgatgaaccatttccctgagatcacttgaacgagcaacgtacaccctggacaaacgaagttacgggactccaccctgacaggagatcgacacaggacacgaacacgctgttatcttcttgttctgcacacgggacttcctcagtctcgacctccttgcgaaaacatccaaggatcgcgtcccaggctgagtctcctcttgctgattctgggcgtcatcttcattgaat

SEQ ID NO: 521690 - DNA, 122 bp, Homo sapiens
ttatcagagttgtgcacagcagtctacttctcctatattttcccagtcctagctgctgtgattaggaacgggatcagaacgaagaaaggggcgttttgggtatatgggtatatggcaggggg

SEQ ID NO: 521691 - DNA, 131 bp, Homo sapiens
tatacctggcccgtattcatagtagggttctgaaaccctattacgcatgagtggctgtgtttccccataacctcaaagattgaggaagtcaggttttggcaaatatttgtcaacctactagataaaaatgg

SEQ ID NO: 521692 - DNA, 366 bp, Homo sapiens
tgggcttctggagctgtgcagtagaaactgcagctgtcttcatagcgttaggaattatccgagtttctatgatgaaaggaaggcaaaagaagccacttattaccccactggtgtcattaagggtgccttctctcttctttagcaagaatctaatgttgcctctaaaggaaatggcaattctcaccatgaagcctcgtttcgattactcctgtaattttgcatgaatgtgaccaaatgttttctgtcaaacctcacctcgtgctggtttctaaatcctaattcattgtgaacagaacccaccatgaactagctagctcctcactggaaaagtcaccaaacccacagtgctgaaaaggagtcattatc

SEQ ID NO: 521693 - DNA, 148 bp, Homo sapiens
aagagggggtttcattttttcccacagggtggagggcaggggggcgtttttggttccctgcaccctcaccctcccaggttcaaaaaattttcctgcctcaccctccccagtagttgtttttaaaggggcctgcccccatggttggtta

SEQ ID NO: 521694 - DNA, 553 bp, Homo sapiens
  misc_feature (92)..(92): n is a, c, g, or t
  misc_feature (193)..(193): n is a, c, g, or t
  misc_feature (196)..(196): n is a, c, g, or t
  misc_feature (256)..(256): n is a, c, g, or t
  misc_feature (260)..(260): n is a, c, g, or t
  misc_feature (265)..(266): n is a, c, g, or t
  misc_feature (304)..(304): n is a, c, g, or t
  misc_feature (306)..(306): n is a, c, g, or t
  misc_feature (312)..(312): n is a, c, g, or t
  misc_feature (331)..(331): n is a, c, g, or t
  misc_feature (358)..(358): n is a, c, g, or t
  misc_feature (390)..(390): n is a, c, g, or t
  misc_feature (495)..(495): n is a, c, g, or t
  misc_feature (497)..(497): n is a, c, g, or t
tctctcgcccctgggtcctgaaccgtaatcctatgcccccactggaagaatttctacgtagtgaaccccctggcattttaaagtaaccctangcagaaggctctggtgattggtggagaggcttgtatgtggggagaatatgtggccaacacaaacctggtccccaggctttggcccaaagcaggggctgttnccnaaaggctgtggagcaccaagttgacatctgacctgacatttgcctatgaacgtttgtccncctnccccnntgagttgttaaggcaaggtgtccaggcccccccccccnangtaggnttttgtgagcaggagtttnaacaaccctgagccccaggccccaagnagggtgctggctgtaggtgaatggtagtgganccaggcttcccctgcatcctggccaggggacggagccccttgcctttgtgccccttgcctgggggcccctgtgcttggaaaaaaaggggccggggctggcgctcncnttcaataaaaagtaatggggcctttttttataataaacatggattccctgtgttta

SEQ ID NO: 521695 - DNA, 370 bp, Homo sapiens
acctcatagcggttttgagaacaccagtctccactcggccaacaggaacaggtaccaataccaccaatttcgtagacaccctggatacgcaggcgcaatggctagtcagttggcatgagttggtggtatgatgcagtccatatcctcaagcagcgtggattccaccggcattgacatccttagcgggtgactttccatccctgtaaccaagacatgtcatctctcggctccagcatgttgtcaccattcccatcagacataggcacaaatgctactgtgtcgcggttgtatccgattttcttacagtaagtgctgacttcctttacaatttcctcatatctcttctggctgtagggtggcccagtgaaat

SEQ ID NO: 521696 - DNA, 242 bp, Homo sapiens
  misc_feature (61)..(61): n is a, c, g, or t
  misc_feature (149)..(149): n is a, c, g, or t
tgcctaggctggtctcaaactcctggccttaaacgatccttctgcctcggactcccaaaangttaggattacaggtatgagccactgcgcccggccctcctgtcccttatctgggtctcccaaaactggattaagattaggtggcactnccatttgctcttgtagtcctctggtgcttcacctactagatcttcgtcaaattctctgaattcaccactagcatgaactcctccagagcagga

SEQ ID NO: 521697 - DNA, 375 bp, Homo sapiens
  misc_feature (359)..(359): n is a, c, g, or t
cataactgcatttgctaaaggaagacgttagcacgatacggtaaatacagttacagagactacattacgaggacgaacccaaacgccctcatttgtctgctgtcaagtcagtgcgattgccctggatgcttctcccggtcatccaggcctaatgtatgaatcagtactcagccagccgacccagaatgcatctgtgtgcaatgtttacatgctctcagcttgggagagaagggttgttttcaaaacacaggaaccataattgagttaattagggcatgaaaggaaagacgaccctagagctcaggcatcgcgttagagccacactgttatattaataacagtgatgataataataatantaataataataataat

SEQ ID NO: 521698 - DNA, 704 bp, Homo sapiens
  misc_feature (45)..(45): n is a, c, g, or t
  misc_feature (102)..(102): n is a, c, g, or t
  misc_feature (117)..(117): n is a, c, g, or t
  misc_feature (123)..(123): n is a, c, g, or t
  misc_feature (148)..(148): n is a, c, g, or t
  misc_feature (157)..(157): n is a, c, g, or t
  misc_feature (168)..(168): n is a, c, g, or t
  misc_feature (170)..(170): n is a, c, g, or t
  misc_feature (200)..(200): n is a, c, g, or t
  misc_feature (205)..(205): n is a, c, g, or t
  misc_feature (258)..(258): n is a, c, g, or t
  misc_feature (263)..(263): n is a, c, g, or t
  misc_feature (269)..(269): n is a, c, g, or t
  misc_feature (304)..(304): n is a, c, g, or t
  misc_feature (335)..(336): n is a, c, g, or t
  misc_feature (351)..(351): n is a, c, g, or t
  misc_feature (353)..(353): n is a, c, g, or t
  misc_feature (393)..(394): n is a, c, g, or t
  misc_feature (514)..(515): n is a, c, g, or t
  misc_feature (537)..(537): n is a, c, g, or t
  misc_feature (556)..(556): n is a, c, g, or t
  misc_feature (572)..(572): n is a, c, g, or t
  misc_feature (594)..(594): n is a, c, g, or t
  misc_feature (683)..(683): n is a, c, g, or t
gccgccgccgctgctgccgctgctgccgctgctgctgctgcaacngggcgcgagtagcggcggcggcggggcgcgcgcggaggtgctgtaccgcagcccgcnctgcacacccgagcncctggncgcctgcaggcccccgccggtagcnccgcccgcngcggaggccgnanaggccggaggcccgcatgcaaagcgcgganacgtncgggagcagggctgcggctgcagcacggtgtgcgcacggctggagggcgaggngtgcngcgtcnacaccccgcgctgcgccaggggctgcgctgcaatncccacccgggcaccgagcagccccagcaggnncaggtcatgggcgangncactagtagagaagcgccgggacgccgagtatggcgccannggagcaggtagcagacaatggcgaagaccacacagaaggaggcctggaggagaaccacgtggacagcaccatgaacatgttgggcgggggaggcagttctggccggaagccccttaagtnngggtatgaaggagctggccgtnttccgggagaaggtcactnagcagcaccggcagangggcaagggtggcaagcatcancttggcctggaggagcccaagaagctgcgaccaccccctgccaggacttcctgccaacaggaactggaccaggtcctggagcggatttncaccatgcgccttccggatga

SEQ ID NO: 521699 - DNA, 424 bp, Homo sapiens
attgtgtctcaccaaccgggtctactatccgtcgctctggggacacacgtgatatcccccccatctcccaggctctccaccctgggccaaggagtcagagcatcgggccgggtgtggtggctcacgcctgtaatcccaacactttgggaggccgaggtgggcagatcacctgacgtcaggagttggagaccatcctggccaacatggtgaaaccccgtctctattaaaaatacaaaaattagccaggcatggtggtatgcgcctgtagtccccagctagtttaggaggcttgaggcaggagaattcggcttgaacccgggaggcggaggttgcggcaagccgagactgcaccactgcaatccggcctgggcgacagggcaagcctctgtctcaaaagaaaaaaaaatctacacatccctcacca

SEQ ID NO: 521700 - DNA, 400 bp, Homo sapiens
cgcacccccaccgcaggatcctggacaggttatgctgtttcatgctttttaaaaaaaaaaaattgttgtaaaaaacagctggtccatggtggctcacgcctgtgatctcagcactttgggaggccgaggctggaggatcacttgaggtcaggagttagagaccagcctggccaacatggtgaaacccccatgtctactaaaaatacaaaaattagccaggcatggtggtgggcgcctctagtcccagctactcaggaggctgaggcaggagaatctcttgaactggggaagcagaggttgcagtgattcgagattgcaccactacactccagcctgggcaaaaacagtgagactttgtctcaaaaaaaaataataaaaataaaattgtggtaaaaaaaac

SEQ ID NO: 521701 - DNA, 163 bp, Homo sapiens
tcagtagatcacgggcattctgctgggagtggttaccacagatgtcccagtgaaagaacttctgaagaccatccccaaatacaagtctagggatctcacggttatcgccttctgcaatcacaagatatatgggcatatgcctgacgtcatcctggacctcagc

SEQ ID NO: 521702 - DNA, 861 bp, Homo sapiens
  misc_feature (12)..(12): n is a, c, g, or t
aacatttataanctcgccttcccgtgtgggtccactcagcacttttcacttgctttaaccgcgtgtggcgcctatttttccagagcccttacgacgataaaacttctctgcgcctcataaatcaattcgtggtcaacccccggtatttttcgttatagtccatactcgcgagtttcctgtaccatatgcaggatctctgggtcacaacggttcccatttggaaagcgccctacgccccctctgataatcaaccatgccacaaaatctggcgccggcagtaccataaccacaatctttcggcccccgaaagcggcccccgtgatcttataaaagggggggaccccagacggacttccacatcgttgaagcgcccggccagcaaaatatttattgtctacaaatctcgccctttagggaatatatgctcttctacataacgagcataattggcccttctctgtgcagcccaatcaaatactgtggaactgtccatagcctcgtgcgctgaccaccttgaaaaaagcaattctagagattccttgggaagtcgaaactcgaatttatttctcttctccgggcggcacccacccgcctttgaaggtactcgcccttggggcaaaataacccggccgacagattgcagatttcctgagatatagaacgcgacctatgacatttgtagacgccccgccattctgtacaacgccgcgagtcgctcccggcccgcttctattaaaacctgtgaaccaggatatacttgttacaaaagaacccgccattacagggaaacaaaaaccatggggaacacgcatgttccctcattggacaaaaaacaaaacccatttaacaacccacaaaaca

SEQ ID NO: 521703 - DNA, 787 bp, Homo sapiens
ggagagagacagagagagagagagagagagagagagagagagagagagagagagaggtggctctccctgacagaggcgtgtgtctccgtgtgtgtcctctgtgtgcagcaaccggagctggatcgatcgggtatcccgaagctgcacctctcgccccaagtggactcgggcccctcgtgacgactcctagctagtaagccgggcgatgtcgccagagggcagggcaggccccacccaaccagcaacatacgcggggcgctcttctccagcagccggcgaggagcctatcgcagcgtggctcatacggtgcacgctctctccgtgctcagtcgtgcgagcgtgcgtacgctcctaatctttcttaggcggggccgcctcctggcagccctcgctagctagcgggcgttgccgccggcaggcggagcatagatagatagctcgcttatcgaagaactaggtcgctcgatagaggaatcatacatcaaccgagggcgcgggagagaagtcgcgcccgcccgcgagtcttctcccacctatatctacgtacgcacagcgagagcgctgacaacaatcattcgtgtgtggggcgtccttcattacctccttcgttattctgatccatagattattattttacttccccgcagagagggaggacttacctaaatcaatacgctccactacgcgtggtgcgttgcctgccctgaatgattattgtgtgcgatgtccgagatggcgcgtgggagaatatgtctgcgttgggcccacccttggatcccaccaaaca

SEQ ID NO: 521704 - DNA, 929 bp, Homo sapiens
ggctgtaggtggcttcgtcttcggttatacctcttccttcgctaatcgcctcccggcatctcgtacagctcatcccgtcggccgtcattacttaacactcgaactaccatgcacttcaatataagctcgcagatgttctgatggagcagatacttcgtaagttgactgtggacacattgccaacacaatctgtgatctgattaagaccgtgttggaagatttgggaatgggatgatgaaggagatgatgacccagttcctctaccaaatgtgaatgcagcatatattaaacaaggtcattcagtggtgcactcacaccgacaaggatgagcctcctcctcctgaccgactgatgtcgaacacaagaacatcgcgaacagatgatatccctgtgttgggaccaagaattcctgaaggttgattcaaggaacactttttgaactcgttctggctgcaaactacttagacatcaaccggtttgcttgatgtacatgcaagactgttgccaatatgcatcaaggggacacactcctgaggagattcgcaaggacttcaatatcaaacccatgattttctgaagaggaggaagtccaggtaccgcatagagagagcaggtgtgtgaagagcacgtgcactgtgcgcctgacatggtatacactgtaggtatcgtccaggttactcgtgcccggtctgcataactggtactaatggaaccaccagtcgacaatggcacacagccatgggttagccgaacatggacaccttgggtgactggcacagatccaagtacggacggcttcaaacgaggacacctttacggcgcaccagaagcggcccaaaaggcggggcccccatcggacgtcggcgttgtcgcaccatgccgacggcgggaagcaaaaaaaaggcgcgacacaaacgacgcacaaacgc

SEQ ID NO: 521705 - DNA, 350 bp, Homo sapiens
gggagtgctgcgacggaatgtctaaaatgaaaatgggagcctctggtccccgtttgcagctacaactcaagatgtctacagaatgtggtcagtgtgacatgtgcaggagtgaggggcagagggacaagacgggcagcaaggagctcctggcgacagtatcctccccgccgaccttcacttcttggccttgccctgcgcagccacagcttccatggcttagcgcaccggctatgcatcccacagaaaccgcatgggcttgacaggcatcaagatcttgaccaattcatagacaatgacaataccagacggcaggttcagctccatgatagcctcttcagagagaccctcca

SEQ ID NO: 521706 - DNA, 1043 bp, Homo sapiens
agcggcccgaagcgtcccagacggcggagaaggcgcctgcgtcgtacccagggtggctgggcgtaggcatgcctggcgggcggcgcggagagagagggcgcaggggtccttctggtccgtcttccgctccccctcccggacctttatcttctgtctagggccccagcctggtcgccagtgtcgcctgtcgatggctcgtgtttatccttccacctgggccgtgcgtcggtgggctgcgtgcgcatgggggccccttacatggataatcgccatgtcctccagggactccgccgctccaggactcgtgcggcgagtagggaactgtactgagactgacgtaccatagggcagggggtgatgttggtacctcgtaaattgcttggtgtggacaactgtgcagcgaatgatgagcccgcgccgggagccttaagacccgaggatcgatgagcaggccgccagcactggcccgggagatcggcccgctactatctcgcccctacgctgactgtcggtcgcggcgccagagaccgcggtggttatttcctgtccccttgcctgtcgggaagcaagtattgagcgaacgcaaccttagatacgctttggacttttgagggggtcgcgacctgcctttccaggcgtctctccggcggcttctgtcccgcgtgtaccaggtggagcctgggttgacggctgcctgtggcctggaggagggggagcatgttcgggggtccctggccaggcatgaatcagcgttaaccgtcccgtcaccctcggggacacccaaacttgtttcaagaactggtttgacagcgcgtggtgactcggcaggtaacggttaagcttctaggaaccaagatgaagcctgtggctttccctggcatgggaacggggagtggggggtccctcagtttaagtgaagggcaggtctcgttacacaaggggtcacgggaatgaaccttgagccccggctgggttccgtttatccggttgtattgaacccaaagcgagttgctcatagtgttgggaactcagataatgcctct

SEQ ID NO: 521707 - DNA, 270 bp, Homo sapiens
cggatacgcctgatctctatgagggctatacccttcctaactatataaagcactaaaattcactttattaattttttttattttgagatagagactcactctgtcacccaagctggaatgcagtggtgcaatcttggctcactgcgacatccacctccggggttcaagtgattctcctgtctcagcctcctgagtagctgggattacaggcatgtcgcaccacacccagctaatttggtatttttagtagagatggggtttctccatgtt

SEQ ID NO: 521708 - DNA, 795 bp, Homo sapiens
ggtgtggcttggctgggccctgcactcggagcagccggctggacccgccgcggccgagcaatgaggagtacaccctccgggccagcgactgtggagggtgtactgggtaccccagcagtgacagcccaccggcgctgcgttcgatttctcgctgggccttagctgccttccctcagggcagggctcgggacctgcagccctgccatgcctgagcctcccaacccctccgttggctcctgtgctgccgagcctcccggatgagcgccgacccctgctccagagcgcccagtcccatcgagcacccaagggctgaggagtgcgggcgcgcggcagcgggactggcaggcagctccacctgacagaccccggttgagggatccactgggtgaagccagctgggctcctgagtctggtgaggacatggagaaccttgatgtccagctcaagttgcaagtccgataggcacttgactttaaccgtgaagaattaccttcagtacattcaggttcaggtgatcctcccggctcagctccctgagtagctgggactacagacaccataccagcgaaacctgctacgtttccgcatatgctctggcgagatgtggtttcaccatgtatgaccaggcctgatcattgaaatccatggggtcaagcaaagctgacagttctcagatctagtaggacagtaccggaaatacagatggaagaggcctcagaaaagttacaatcatggtgggaagatgactgggcagaaagggcatagacatagaatggagataaaagagagacagaa

SEQ ID NO: 521709 - DNA, 1792 bp, Homo sapiens
tattatatatttaatattaatttgaatatattataattatattattattatttattatatattatatatattattatattatattttttttatattattatattaatatatatctcatctttcttattactttatattttatatttatcatatattctcacttccctcttcccctcttctctccaaccaacccacaaacacaaccacacacacaaagacaccgcacacagcccgcaccccacccaccagacaaacacaaaacaacaaacaacacacaaagacaaaaacacacacaacacaccacacaacacaaaacaaaaacaaaacacacaacaacacaaaccacaacgaacgcgagcaccgacccacccccaaccaaacacagacaccgcacgccgccgcgcgccacccccaccccacaacaaaaacacacacacccagcacaagaaagaacgcacaccacacagagactaaaggaccccgaacgccacagaacaaggagagagcagacagaagaggaacgagcaaccaaaccagaagaaacaccccacaaacaacacccgcgaccccaaccaacgcacccccacccactgaagacgacaagagacaaccgaaggcaccacccagcaagacacaccacaacagcagacacagaaagacacacacgacagccacgagcacgccacacagagtgcagaggagggctcccacagcaacgagagagaaacaaacgacaccacacccgagcacgccaccacgaaccagacacccccatacacgcccgacaccaaccacacgccccgccacgcacactcacctcccagccacaaccagcaacaaaccaccacaaaaacccacaaaaccacaacgaacacacaagacacagacaacacaagacaaaaacacaagcgaacgacaccaccgcacccacaccaacaccgaccacaaaccacaacccaaaccacacacacccaccaacaaccacaccacacgacaacaacccacccacccgaccacacaccaccacaccacccacagacacaaccccacacaaccaaacagcccacaaccccaccaccacacacaaccacaccacacacagcacgaccacgcaaacaccgaccacccgcaacccaccaccacacacctaccaccagagccaaccacgaaacaaccccagcaaccacgcacacaaccacaaagcaccacacaacccaaacacaccacgacctactgccccaagccaaaccacacacaccacgaaaacccaccacgcacacaacacgccacacaaccacgacaccaccaaacccaagacaacaacaacagcacacaaacacacaccaacacgcaccacaccacagcacacaaacacaccaaaccacgcccccccaccaccacacccgacaccgcacaacaaaccgaaacaccacaagaacgccaccacccaaccacacacagcgaaccaacacaacccgcacaccacgaccaccacgaacgacacacacgtagcccaccgccacccccaaacaccacatcaacggacatcagcaaacgacacacacgccaccacaacaccacacacacagcaccacaacacaccaacacccacaccacaccgaccaccacacccgcaaccacaccaccccaacgagagagcaaccaacgccagcgaccaaggccacacaccgcacacacaacatcaccccaacacccacaccccaccacccacaccaccacacacaacacacaccgaccaccaaccacacaccccacaccccacaccagcacc

SEQ ID NO: 521710 - DNA, 170 bp, Homo sapiens
tggggtgcatgtcctgacaaccggggtcgcattcaggattatatgaatagcgaggtgctggcccatatggggatcaaagcctgtaggggtttcaaaactcttacaggagatgtaaaacccagaaactgccttgtaaagcacgtagtcaatgcggacaccaaagggaaatg

SEQ ID NO: 521711 - DNA, 768 bp, Homo sapiens
cggtaggtagcgaggctgggtgttaatcggccgaggcgagccgctggccccggagtagcagcgtgggaggccgggagcccgcgggccggagtctggccggccgaggcgtgggggctgcggggcctggcccttccgtgggggcgagttgagcgttgtgggcgcgcgggggggcgaggcaccaggttcagccagcagcaggagcagcagcatccgagctaaccagccagcgagcgagcgtccgatgctagttacagctagcgagcgagctccatgctagcagcaaattgcaaggagcagcagttactagcatgcgtccagcgagctgctccagcgagtcccctagcagaggccccgttgcgcgcatggctgtcagccggggggctcccgcgcgcggcagcagcacacagcgaggccgcttctagagatcgtcacgagggccacctaactcgagtctcccatcctcgaacggcgtccgatgcttgcgagagacgcttttgcttttaccagcgagttagcaaggtaacctccgaggctatggcatggcatcctccagggctcgtaggccccatgcctcagtagcccccacagattggcgcactccaccagttctgcacacagttgctttccgccaggcgcactcgcctagtccttgactggtgagctcctcctgttggtggtcccatgaagccttccgagttccacctttctggactggaaccccagaaggagggcggactgctcttacagccccatcgcgggtcgtcgccg

SEQ ID NO: 521712 - DNA, 323 bp, Homo sapiens
  misc_feature (113)..(113): n is a, c, g, or t
  misc_feature (224)..(224): n is a, c, g, or t
  misc_feature (250)..(250): n is a, c, g, or t
  misc_feature (293)..(293): n is a, c, g, or t
aaaaaggccaacagagcccagctaaaaacataagtccccaggcctaagtcaggccccttaaaactgcacctaaatcagatccttcttagaaattcctaaggctcaatgttgtntggaagattctgagaaagaaaatagtttccgatctttgggattcccctgagatggtccaatctgcaaaaagttcattgccatttccatcaaggacactgagaacaagagtnttatccgggttggttcctgggaattnagaagcttcagcagggcttccgctgggaacttaggattcaggntgtggacaaccccaacctgggaccatctgg

SEQ ID NO: 521713 - DNA, 432 bp, Homo sapiens
ttgttcctgcatcgcgacacccagtaatgtgccatgtgccatggtgtcggttgagaaagacatgcggcgccatagcatcaagacagcctagtggctgcaggttaaaaagaccagaagcgtgcccataatccatgcaggcaacagcagttgtaaccattccatcatgacttaagcttccggttcagggtgaatgtgtgggcgagcgtcatgctgacaaggcgttgcactatcaccatgtgcgcagtgatcatgatgatgttgatagaacacgcggttagtacccaaaaatggcttgatactcagggtgttgttgcacactttcaggcccgccactacaacaaatgtgtatatgcaaacacaccacacgatgagttccttgcatgacccactgtatatcatgtgaaagcatgagcacagcagaaccatatgtgg

SEQ ID NO: 521714 - DNA, 1107 bp, Homo sapiens
gggagcgccgcacctacaccagaccaagaccagatccctgaggtcctgacagcgcccggccagatccccacgcctgccaggagcaatgccgagagccatgccggcctggcgcactcctgactccgagcagtctctgtccttcgaccctgagcccctgctgccctttcctgggacccctgctccctgcgggcagctgcttgtcaaccatgcctggccatggcagacccctgtcccagctgtgctgctgcctaccctgcatgctgtgggccgcatggcctagctccactccagcatgtcgcccaccgcgcttcacccgtgcatgcagtgacgaaggtgacggaccatgcaggagcctcaaatgatccgcttgcgcgggtctacagatcagacacgtgttgcagctacgcctggacaaacctggacgaactgcatgtggctttgcgaccattcagcatcaacccgagtcttgacagagcgtggtcaagcctgcggagagtgtccaggacatcaaaggcacgcactaacgaggcacgacgctcgagggatgcctgcaagaaccgcttcgaactcaggtaagaccaacggaagcagcagccccgaccatgcaaggctgcgagactgagtcaaaaacgttgcggttgcacggagttccaagggacgcttcgaaacgcggcagcaaataaccaaaggcacaggacggggttagaccctgcatagagacggactccaacggactcagggcatggcacagggaccccttgagtagggactactgcattgatacgttcgcacagggcaggtcccggcaacgtgaagacaactgcctcatcaagatgcacgaacgacgacacgccttgtgagagcgcgtagcgtgcaatcgaattccttgaatcgaggtgacacaagcgatgggaacacaaagccctattgaacgagccagcacacattagagcgtgaaatggccaacagtaaagccgaaactcttccacggcgactctgagaatggcctggacggtcagaggtttgcgaaatgcatggacaaaccagtgacgtgaccagcaacacaatacacgagcgcgtcgacaccctggacacgttatccgcaga

SEQ ID NO: 521715 - DNA, 170 bp, Homo sapiens
ctgatgccgtgaggtgacctagaggatcccttccaccacgaggaatcagtccctcagctcctggctctagtctccaccgacaaaagttcagtcgtctctgttcgttggagggcactgtctggccccctcaggttgaagttcaacactcctcaatgagcagctgtacctca

SEQ ID NO: 521716 - DNA, 121 bp, Homo sapiens
cactcctggtcctgcatgctgtgcctgggtaatgtgtcacagtgcgccctgtgtgctggactgtccacacggttcacaccttgtcacccatcaggcctttctggctcctgatagggtggcg

SEQ ID NO: 521717 - DNA, 408 bp, Homo sapiens
  misc_feature (12)..(12): n is a, c, g, or t
  misc_feature (120)..(120): n is a, c, g, or t
  misc_feature (166)..(166): n is a, c, g, or t
  misc_feature (261)..(261): n is a, c, g, or t
  misc_feature (293)..(293): n is a, c, g, or t
  misc_feature (363)..(364): n is a, c, g, or t
attcgcggccgntacgacacggctgacgagaagacgacagaaggggaaccatcacctgcagaaacaagtttcacaaaagaagcctacaagaatacatcaagattactgaaatcaatcaanggaaactgaagaacagagaccagaaagagtaaaaccttttatgacngggctgcagaacaaatcaagcacatcctgctatttcaaaaactaccgttcttattggtgacatgatccagatggctggttgctctattggactancgtgaggatggtgtgaccccatatatgttttnttaggatggttagaatggtgtacaatgggcattatttggatctatcacctgtctcatctggctctgctgnntccacacacaccggactaggccatgggctgtgtctctggccctc

SEQ ID NO: 521718 - DNA, 847 bp, Homo sapiens
agcggtgtgtgccaccaagcccggcgaggtcttcccaattctgatggcaaggttgtataaatattcaccactatcttattcttgtacttttattatttctttctaaacagttaaatctgtgatctggctgggcgtgttggctcttgcctgtaatcccaacactttgggaggccaaggtggatggatcgcctgagatcaggagttcgagaccagcctggacaacatggcgaaaccccatctctactaaaaatacaaaaaaaaaaaaaaaaaaaaaaattagctgggctgtggtgggtgataggacccgtggtggctcctcagctactggggaaggctgaggcagggggcccgggaaggcagaggtttgcaggtgagcgtgagaatagcaccagccggggcaacggagcgaagactcgtgtctcaaaaaaccaaaaaacaaaccaaaaaaaaacctcttcccaaagagaaagttgggagactatttctcgtgtttagaaaaatttcgaaattgggttggggttaacattttcctttttttacccaagaaggactaacatctcttttattaatttttataccccttttcagataacttcttgttgtttcagtgtttctctcgaaccatatctttccaagcaaagagggagaagtcttacatggtggtgggtcaccatattggctacacgtggaacactcctaattaacttttaacacacgtgacaccatcttaactccataccgacttatatactgacctttctaaaaaccttttagaccttttgtggctcgctgtaaccccttttcttttcagacacctttattggtttaaaaacatttatgttcgccc

SEQ ID NO: 521719 - DNA, 281 bp, Homo sapiens
gagtactataacggtctaaggtacgtactgatgataatcggagaggcatgactttgttgcaagggcgcggaagcagaggctgagaataaggcggcagcttgactgcataaatgaatcgagatgggctggtggaaggaacaagaaccgttaacacgcacatgtataacctggctctttgcgtgagctggtgagacccagcgccgaccatgcaccatccaggtgacccgacccatccgtccgcagatagagaccttcctagaaccattacccgtgtggagaaa

SEQ ID NO: 521720 - DNA, 1747 bp, Homo sapiens
gctgctgtactacccaactattatgcaagactcctggtggctggcagccaccattaatacacacagtgtccctggctcagcagccctctaagcactcagtgcccaaaacacgttactggcacgatgggcgccaaatcgttacgcctctgactcccctgacgccctcaataactacctctcaccaaaacgctctgacacactgtacagcaccgactgcccatgcacacactgaaccacccagcaccaggaatcagcgcaacgcgtggctccatcacatggtccccctctcgacgcgccgcctgccgcacggcacgctcctgcccctacacaagagcaacgccctgacaggtaccccgagtaccccaagggctacaagcaagagccagtccagcaagcagaccgtcaagcgctgcaacccttcacgccagacctgcaccacgctggcacatgtaggcaaggaaccccctgcatcatacaggccactgcagcggcacttgtgcgctagccccagcacggcacgcccatacacggaggcaccacgggagacacgctgacctctcccctgcgcggacccaccgagcgagccaggacagcaaaaagcggacaagcgcgacccctagcaagactccttagaatccgaaccagcgaactggacccagtagagcctatgaacgcaccaatgccggtcagcctaggccacccatgaggcacacaacccccaattgtgccctggacaacctagggaccaggggaaagacccagagcgaacgaggcccaaacgcaaaccggctgcgacactccacaaagaaccaatcggctagcacgagacagacagcagacgactcgcgcaccaagcagcagtgcccacagactgcgacccaacaggcaccagggcaccatcgcagccacccatcgacgccactcactttacaagccgagcgcaatccagcctgaccacgcggccctccacaccctggccctctgcacccaccactaggccagcacccacacactgacacgccctcacaccacgaacactcccacccacacgggaacatcctcgcaaccaggcaccggcaccaggaccacgtcaacgcaccctacaccggactagcgcactaaccagcccgtcccccgcccccccaacgacgacacatagcaagacggaccacgtctcccgcttcaccacgcacccagtagagcgcacgatacaatctacatgccacgcgcacactacaagcaacacacagaacaacaagcacgtgacgcacgaccacaaatagcaccgcaacagaacggctagaaacacgcacccaacatacaccatagcacgcgcgcgccaccgcacaccacccccaccacatccaaaccacacaccccctataaacaacaacctaaccatactacacaacaacataatatgatacacacataacatcaaccactccacccacacaccacactaaacacactcaccaacacactacaacacaacacagcacacaacacctcatactacgtcactataccacccagcaccaaaccctatccacgacactacactcatacacataccacacaaacaaacaaaccacaacaccacacccaccacaccagcaccacacaacaccacatcccaagcccacacacacactacaacacaacagtacacacatcaccaaaaccagaacgacactacatacattaccactacaccaacgatacacaacacacacaccaacccaca

SEQ ID NO: 521721 - DNA, 943 bp, Homo sapiens
tggggggtagggctgaaggtgacgtggttccaatgtacaggagggattggctctatatcctcaaatatcaccttccctgcatcttcctggacattgcagctatggaacgtcccctggggtcgaaaggagcccagggaacccttcactcttccctgaatcagctctagcagtcatagggatgctcctggctcagcttgccactagtagaaactatgggtagggcaatttcctctgatccttgctgtggccatgaatacattagcacatttacttatatcattgactgaattgacaacgagaactgttcccttgtcggatcttactaagaaatccccttgaggattcggctaagtttactcccttggcttagcctttgcttttactatcgttgacgaattgatctacaactgctgttcaacccctagtgccttgaaaccctggcatactggactggtagagatcatgcggcgtacacgttgctaaggacatttgaaccatcttgtagggatcaatgacgaatccatccccaaaccctttagaccctcattggtgtatcctggggcactgtataggtcgttagtgaacacatccgatatgcctcatgattacagtaattgtcagcaacgtgtattgcccgcaagacttgggcagaagtaaaaagttggggatacacacacctttgtctatggtcccaaggcttgggtcctcataattacactaggtgctcaagacgaattacctacccttgtttatcgaagatctcccccaaaagggtggctaggcactccactacggggtaggtgaaaagcatgtccaccaaccttgtgccctccgtgctgtggcctaatatttgattaatggaaccaagaaacaaaaccccaacaggaatttggcctcacctgggtacaggggcataggtcagcaaacacacaacggcccttga

SEQ ID NO: 521722 - DNA, 191 bp, Homo sapiens
tgccggatgaggcccggagcctgcccccgcccaatgctgaccgacccgcggctcctctacatcggcggcttgggctactgctccggccggatagataacgtgatccggcggagtgcgatcgcgacggctggtaagcactcgccagccttctatatattacggccttaggcgtatggctgctgctatgggga

SEQ ID NO: 521723 - DNA, 673 bp, Homo sapiens
  misc_feature (32)..(32): n is a, c, g, or t
acgtcctcgtcaaaggccggttggataattancgggcaccgagtaccggcgtgccctcagatgcccctgttccagggtccccacacataggccgccccacagagactgataccaaacactgccacggtgtggccactgagacatagataatccacacctcacagatattaggaaagagatttttctgcatatgctaagtcagagttgcggtcaagaaatgccaatgtactcgtgcacaacatgttgtccgcccatcgacagatacttgtagttcaccccattacaacttctacagataggacagcttcattctttcagacaacaggcgtcgccatgtttacccttagtaacaacgtgtaagagaatctgcgatcggtatgtgctagggtaaggccgggtctagctaacataatgctagcactgactacgtgcttggtttaacgacagctgtaggcagtatgccaagcgtaagatttactctgaggaatcttggggtttccctgggaaaatgcactttaagcaaaggccaactgtttcaagcattccgctcgttcactgtgtctttttacccgggcatatagcgaacgccggcggttctgtgtaaaaaagtataatgccctcgtgggcacgaaaacgtaatttccgtataacctccttgcttgaggataaagcc

SEQ ID NO: 521724 - DNA, 269 bp, Homo sapiens
aaaaaggggttttttccccccctttttggtctttccgaaagggttttttataaaaaaaatttttattttttggggcccttttcccccccgggggttttttttggtttttttgggcccgggatttggcccaaagggggggttttgggggccccccccacccccccccctttttttttttttgggggccaggcccgggtcctggtttgcccctttttcccccccccgtttttttccaggggcttccataaagggggggggtttttgggtta

SEQ ID NO: 521725 - DNA, 522 bp, Homo sapiens
gttaacaacacaaagacatggagaggctgaatggataaaaatgcaggcaaatgagctggtgcctaaaagaaacacacttcatttataaagatacaaatagactgaaaataaatgaatggaaaaagatatttcatgccaatgaaaacaaaaaaagagcaggagtagctatacttatatcagatgaaataggtttcaagagaaaaactgtaagaaaacacatataacgtcactatataatgatgaaggggtccattcagcaagaggatgtaacacccagatataaaggaaatattattaagagctaaagaaagaggctgggcgcggtggctcacgcctggtggctccgcatttgggaggccaatgcgggcagatcacgaggtcaggagatcaagacaatcctggctaatacggtgaaacccgtctctactaaaaatacaataaattagccaggcgtggtggcaggtgcctgtagtcccagctactcaggaggctgaggcaggagaatggcgtgaacccaggaga

SEQ ID NO: 521726 - DNA, 177 bp, Homo sapiens
  misc_feature (124)..(124): n is a, c, g, or t
ttttggatccgaatctcattctctaaaactgcttcttgaacatgtacttccttagtataatcaatgatactcccttactaggctgaaacgttgtatagctacttatacagatactgaagatcantggactgaaaaaaatgacaaacattagctattttatgctgcaagaaccaggac

SEQ ID NO: 521727 - DNA, 395 bp, Homo sapiens
aaagaatattaaggtttttttccttagtgtttaaataatcaagtttaatagccaaccatttaaaatatcctttgaaatactataacaaatattataattgttaaaaattatctaatacaaaaacttgttttatttaaaaacagtaggcacatatattgcagatattttttcagttttacaccataaatttttgccacttttccccttttacttaatcatttcactttctcctttttaaataatgattcatatggtcccaactacttactcctttctcttttctttttttttttttttttttttgattcatgcaaaatatccagatagtgtctgttttatccgtaaagctttgtggccatgtttagtgttttaataaagtgttttaatgatgaaaa

SEQ ID NO: 521728 - DNA, 807 bp, Homo sapiens
tgttaagaaaaaactttactcactgattggaacaacagtgattgaagggtcctaaaaagggaaaatatataaagatgatttcatgatagggtagtgaaaactattcagctagtcaagctcaaagtcgtttgtagtcttgccgccatctggccacgtaaatagagaaaccccagaaagtagtctgcttgtgcttgttcgtgtgtttcacattcatagcaactgcagctaacaggctgattttctgggcctttggagaagtgattcatgtatagggtagatggttctgcgatagatccgcgattggtgtacggaattgaatgggatggcataggtaagcaaaagtagaagcccattgagttgtacatttgattccacaattggttctcaggtaggctggtgaatagactagtactaaagcagatttgccctatgcttgattttggcatatggctgttcctcctgtaagtttgcagaggattttggaaatcacagaatcactactaaacctgatatgtagcctatcaaaatgtccagaagtcccacaccagcagttcctgactcaaatgtgaggggtgctgagacaggagggtaagattacgtaggtgagtgtagttaaaggcttaccctaagtaagagtaatgagacttattcggcaataatggaagtgctcactgttcttgggactcctcactctactgtttgaagaggcacaaagctgtggggcttcgcaaccgggtggttaaaagcctttaaccacatcccgttctaggtggaaacgttttatgaaagccccttgcgttttgggtg

SEQ ID NO: 521729 - DNA, 518 bp, Homo sapiens
  misc_feature (14)..(14): n is a, c, g, or t
  misc_feature (48)..(48): n is a, c, g, or t
  misc_feature (51)..(51): n is a, c, g, or t
  misc_feature (67)..(67): n is a, c, g, or t
  misc_feature (71)..(71): n is a, c, g, or t
  misc_feature (105)..(105): n is a, c, g, or t
  misc_feature (109)..(109): n is a, c, g, or t
  misc_feature (147)..(147): n is a, c, g, or t
  misc_feature (183)..(183): n is a, c, g, or t
  misc_feature (252)..(252): n is a, c, g, or t
  misc_feature (261)..(261): n is a, c, g, or t
  misc_feature (314)..(314): n is a, c, g, or t
  misc_feature (321)..(321): n is a, c, g, or t
  misc_feature (345)..(345): n is a, c, g, or t
  misc_feature (381)..(381): n is a, c, g, or t
  misc_feature (399)..(399): n is a, c, g, or t
  misc_feature (403)..(403): n is a, c, g, or t
  misc_feature (407)..(409): n is a, c, g, or t
  misc_feature (453)..(453): n is a, c, g, or t
  misc_feature (495)..(495): n is a, c, g, or t
tgcgtccttcggcncccagagcggagaagcgcgcaaggcaccggtggnagnggcgacggcagctgcnacanaacccctgctgggccgaaactgggcagagcgganagangtctgaagcagcgcagttaggcgcgagggtagagcccncgcccgggaagacccctcggcgcgaaccggcagacncagccccgggtcccggttcccaaggccccgcctctagggcctggggactaatcggattgagagcgcgcnggcccgggncgcgaactcgccaattgcggagggcggtggccaccgcccaatccggagcaganaggtgcnaggtccggaaggcggaggccaatnggcggcggttgcgacctgctggggcaggtctcggcnaataaggaggctcgagtnaaancttnnngcaccaatcgggagttaaggagcattcgtgcccgctcgcccttncggccagacctctatttaccaggggcgtgcaacccgcttgcnaattagagcgcggctgatcggcc

SEQ ID NO: 521730 - DNA, 379 bp, Homo sapiens
ttggttatggagggagagtagaataagagggagaggctctagatcgcttgtgtatcttatgctcaggtgacctcagagaacgacagtatgccttctacctctatcgtgaaaagtgcatacaggtgttggtctgtgaatatataaatatctctatgcacgcatatatacatatataagaaatgtgcaataacaaagacagtaagcaaggagtcctctcctagtcactatttaagcagagactgagaggaggaaaagacaagttctacccctcaaatttgccttctcacttgcagaaccacttcctggaccaattcctgctcaaagaaaacatttaagacgcacctgtcggctgggagtgctagctcacacctgtcatccc

SEQ ID NO: 521731 - DNA, 1081 bp, Homo sapiens
agcggaaaagcaacatagagcatacaagaacatttgggatagagttgtgatttgtgaagaatttgtactttgatattgtggcggaaagtctggactgagtgtgtatgctggtaaactgtagacttttttttttttttggagtctccggcgggtctccaattcacagtagctgtgatggcttctcagccctcgtcctctcactgtgatcagtgtgtctcaacagaattcagctgtgacattaattgtgaccacagtttatatgcggggtgtataagctccggcctcatatgagggattaggtgcactactttttttttttgtgtttttttttttgtggcgcctctttcttctccttctctcccctttgtcttttattgggggggtttaaattttcaacacctataagagggtggtttcttatagagagggggttaatatggggggggctttaaacctgtgtggagaggttgcggaataaaccttctgtgtgggtggtcctcacaattccattaatatcccgggggaggaaactctttgaagctccccctattatatttgtaacccggggggataacccctatattgttttttaacaaaggggcgctgttaaaaaaaaagggggggggcaaaaaacagcgagctgtgttggggggccaccccttaatataggaaacaggggggtgaggtagcttctagaacaatatttttttcccagggggatttttaacaagagctgtcccttcgggggggccaaaagaaaaaacccccgtgtggatctgtacaactggggggtgtgtttgaacccccaatatttcgtgggccgacggttaaaaaacacgggggaaattctgtagttccgagaagaagaaattgtgaaaacacccctgttgcgttgcagaggggggtatcatcaaaacaggtgaccttctctcacatttcacgacaagggttgggaagggccacactttttccacaacatctccactgttgaacagagaccacacgaacacgacgggttttctcaaaaaagggggattctcccacaaattgtaatttcccccccttaggggggcagaaatac

SEQ ID NO: 521732 - DNA, 332 bp, Homo sapiens
gggtggctcatgcctgtaatcctagcacgtgggaggtcaaggcgtgtggatcacctgaggtcaggagtttgagaccagcctgaccaacatggtgcaaccctgtgtctactaaatacaaaagattagccaggcatggtggtacatgcctgtagtcccagctacttgggagggtgaggcaagagaatccttgaacctgggaggcggaggttgcagtgagccgagactgcaccactgcactccagcctgggcaacaagtgtaaaaaccgtctcaaaaacaaaaccaaaaaactctgccaacgtgttcgctttttaaaccttaatgtaccaacccc

SEQ ID NO: 521733 - DNA, 98 bp, Homo sapiens
  misc_feature (8)..(8): n is a, c, g, or t
aaaatacnttagaacttaacagccttccatccaaagaagacatgcgagaatagattggattggaaagagcaggagtcacctaaactttttgattgggc

SEQ ID NO: 521734 - DNA, 178 bp, Homo sapiens
  misc_feature (40)..(40): n is a, c, g, or t
tctaagatcgcgggagcttacctgtagaaagcttgaaganagtcgccacagagcagcaacaagactgtgtgtggtagaggtgtcaggcctgaggcattgctctgccatagatgctttgttgacttgatacaggtgcgaagtatcctccctggctctggtcccgggggtacgagctcga

SEQ ID NO: 521735 - DNA, 215 bp, Homo sapiens
ttttttgccccccgggtccccccccgggtccccaaaaattttttatttccaacaacaagggaaacccccccccgggcccccccctggcctgttttttttatgccccactttttttttttggttccccggcccccctggtgggggtttggcgggttccccttggcccccccttaaattttttggcagggtttttccatttaaaaaaaaattggcca

SEQ ID NO: 521736 - DNA, 203 bp, Homo sapiens
agtgactccgaggattccggtcgctcggacatcccacttcctctctgcaggcggtatggagtggctacgggccaattagctttgcggaacatattctacgtgaattcagtgtggcgatattcacatgggtcccagtcacttttggaagctagttgggctactgcgtgcttggtcgtccgacgcggacgcgggtaccgatgctc

SEQ ID NO: 521737 - DNA, 291 bp, Homo sapiens
cacgagggggagagggagaacagataaacgacacgcaatccatcgttcagatccaactgccatgacctctgcccaacatcccaccgtcgaaatcaagatcctggacccgcgcctgcaccagtggggcctgcccagctatcatagcgacatggccgccgcgatcgacctgcatgcctgcctggacgcgccgctgacgatcgagccgggcacgccggcgcagctggtgccggccgggatcccggtgcatatgggcaacccgtacatggccgcgacgatcgcgccgcgatcggg

SEQ ID NO: 521738 - DNA, 535 bp, Homo sapiens
gcacgaggccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaataaggtgacatagatatacacacccacacccacacaccacacccacacacccacacacacccacacactctcttacatctacctctactctcgctgtcataccttacccggctttctgaccgaaattaaaaaaaaaatgaaaatgaaaccctgttctttagccctacagcacttctacatagccctaaatagccctaaatagccctcatgtacgtctcctccaagccctattgactcttacccggatgttcaaccaaaacctacttactacctttattttatgtttactttttatagactggctctttatcccac

SEQ ID NO: 521739 - DNA, 109 bp, Homo sapiens
tatgtaactttgtctcaagagggaaataatgttctcaacagtcgataattaataactattgtcttcccttgtcatgaaggaacttgtataataaatggacgtgtaagga

SEQ ID NO: 521740 - DNA, 1255 bp, Homo sapiens
ggcctttagctgccatcttgcagtccccgtgtgtgtgcgcctaatcatcaggtggtccagccgagacccgctttgagcaccgaaccctagtcccccgacgctggcccattattcagctccgacacaggtacaacaacaggctctggcacggcggcagtggtcaggcaggcacgggacagcggggcgcgggcaagttccctgcaaggagccgagcacagggcagggccaagggcagcaggcaggagcaggaaggcagatgcgaccggaccacggcgcacccgctcaaggcctgacctctcgcgagggacgaaggtcgagccaggggcccgggctggccctggcggacagaaggccgacgccttgtctacaaacgctccaacctcgcgggcgtgacacccggaggacaccggacgcctcagatgcacagcaccacccaactccagtgacccccagggaacaacactcgcccaaaacctggcacgcgccaccacagtgccgccattcggcgcgccgccacacagcgcaatgggcctcggccagcacacaccgcaccgacaaggcggagtcccatcacgataccaggcccaaccacgccccaacgggcacgaacacaacacaccttcccagaccccacccctacacccgcgcaccgccacacgggcgcgcaccaccactactctactccctcactgggcccacttgcgcacacaagggctggcccatacctcgtttcgtaccaaacacccccaacgggacaaccacgtattgacttcccacttttcacccaacccctttaaaagcgtccccaggcgcatacatcttgccgccagccgcaaaccaacttgtcacccaatttacccagcgcccaattcggcgcgagacacaccacgcgccacggcctgtcaacacaggacaacacgtgcccacccccagggcaatctcttaaaaccccccggccctgcaggcggaccgaaataaggccgcgcacacaagctctaacacgccgacagcagtcgcccccacaccccgctcggccacccaacccccccatccgcggtcgccctgccaacaacagcgaccccaccgggccccacccgggccccacgccacaccgcacgcacacaacacatcccacaacctcggcgcgcgccaccagcggccgacacgcccccacaacagcagcaggaccccaccgcccgcaccacacacggcaaacacacccccgcacgaccacgcgccgcgccacatatccgcg

SEQ ID NO: 521741 - DNA, 229 bp, Homo sapiens
tcaccacgcaacttgggatcaactgcaagctctgactccccaggttcacgccattcttcctgcctcagcctcctgagtagctgggaatacaggcatccggcaccacgcctggttaatcttgttaaaagtatatttttgtagagactgggtttcaccgtgttagccaggatggtcttgatctcctgacctcatgatccgcccgcctcagcctcacaggggttccgagctc

SEQ ID NO: 521742 - DNA, 833 bp, Homo sapiens
ctcgtccgccggcagcactcggcgccgcgtgtccatggaccggaacctcgtggccgacggtgctgaacccgggccgcgatctgacgtctccccgcctcaggctcctcctcctcgctctccgacgactccgtcggactcccgcaggccctgcacctgccggcggcaggctagcggagcttgccccgtgaatgctgggtgacgggttcgcggctgctgccgtactgcgtgtcgtactcctgccgcctctcagtgctattgtccctggtgcctggccttgatgcggtgtccactggcggaatgccgtgtgcgccgtgctccgccgtcaagatgccgtgaccaagtcccctagcagcaagatgcgtgtacagacagttgcgtgagctatcgtctcgcatacctgagtgaagcattgatagacacaggctgaaatgggctgagaaccatgccaggtgcagaggactctaccaaaatggggtacagccaggcctgtcttacaactgctgggtggatgagaaaggccaaagaggaaacaggtacagcccagcagtgagcatgttcctcacgtgcaactgcgtagaataccgtaataagtatatccaaacattgggcgtccagatgagctaacgtcgttggatcttgccagatagactgatctcacaaagcctgtccaatcgctgcagcgaggcattaattggtcgggtctaatctataggacagcttgtgactaattgcaccagtgacagtgatgccaggatgtagggtcatacatgacaggtctggatgtgatggacgaagcagtgatcctttaaatccctatcaattgggacgttcca

SEQ ID NO: 521743 - DNA, 1240 bp, Homo sapiens
ggaatgtccggatcgttcgggcagattgacaatagcccgtcttgcagatgatgacttcagagtcaaggtatgagacagagccatggctcgagtgtcgaccagtctgtggagaacgacaatccaattggtgctcctgcgaaggtcgattgcatgacgaccaaatattcatcacgactggcgagcttgtgagactagagatctgaggacatcctcaaggaatgagcgtgctcattcactgagaagaacgaacccacagaacgcacggaagctagaatggccttacgaatgctccacatgattttgccgagctccttgggttgatgcgtgagggaaggtatagtgctccccaaaagtcatctacgaacctccggccacacgactcattgcatagtacattccggaggacctcaattatgcatcggaagcctggactcggaaaagaagccgagatggaggcatagaacgaaggtacgtggctcgtacaacagatcgagcgagatgcaccacatgtcgtcacacacacaagtctgtctgaggttggaagctggctgagaacgatgctcacagaatctgaggactgctacaggtactcagtaccttgtgatgatcgaccctgagaactctcatgaagaaaatctcgaatggccacgtctgtggataatcacgagcgtgaggggaacgttggaggtccgttttttgcccttatagaatggagtcgattgtcaacggtgagtccgtgctttgtacacttgaagtcatgaagtctggtcacagatcgccgcgtgcatgagtggcacatccgccaggacccaaggagctatgagggccctggcgtgaatgattacggtcaaagcgtggacagtctcgagactcggctaactaaccggcagtactggcctggagggatggccgagacgtaaaaggcttcggatgaatgcctttgggaacgagcattaacctccatgcaaagcgatccaaaagtactacaacctgtcggaatagttgcatgcgaaacaattgctggcttggacacaccagtgacatgcaggggattcctgaggccattaagcccagagctgaaagccggggaacgcctatggggatgcgggaggcccctgaggaagttcagaccttcacaaccaacttctctgaacctgggggcattctcgggggcccgcaaagtggttctgagaggcccggtggacaccgttcatgacatctttgggacagggagtgtctg

SEQ ID NO: 521744 - DNA, 131 bp, Homo sapiens
aattcaagcttctaacgatgtacggggacatgggcctctgatggtgttccttttttcagacttatttatttgttgagtcagggtctaactccagcctgggcgacagagcgagactccatctcacaaaaaaa

SEQ ID NO: 521745 - DNA, 214 bp, Homo sapiens
agagactgacgtgagtgttgtaatattggctcactgcaacttccgcctccccgtaatcaaacgattctcctagctcagcctcgtaagtagctgggattacaggtgcctgccactatccctggtttactgtcactgcaacttctgcctcccaggttcaagtgattctcctgtctcagcctcccgagtagctgggaatacaggcgtgcaccaccat

SEQ ID NO: 521746 - DNA, 773 bp, Homo sapiens
tggcttctctttccacctggagcagcctgcagagtccaggagtatggaagacttcgcccgaggggcggtctcccacaggcccctcccggcctgggcctggttcccgtcagcatcatcggggctgaggatgaggattcggagaagcgagctggagactagaactcagaatggagcaatgaagagccagttccgagagcctggagcaggtgaagcggtgcccaggccacctcatggccctccgtgctagtctacgtggcccgtgcagtttgagccgaggacccctgcttttgctgtcgtgcatgccgacagtgctgggctcagtgtgggccccaaggaggccaagaaggccttcctggacttctacgcgagagcttcctggagagagacacgcggttctccgggtgccgggtccctcccagacgtcgcccgtttgaagcttgaccgcgactagggctgacctcactcgtccgacggatgtccagcggcggcttcgtgccggaggtggttgcaacaagccagcatggtggccgtgggccggcaggctggaggacttccgttccaagcggctcatgggcatgacgccctgggagccgtgagctgggcccagctgggaggcctgggggttgggcgggaccgagctgctacgagggccgggagcggcacgtggggggagcggtgtcatgcccctgggtgtgatgccgattaccatctgttaccgcgaggacagagtgctggcggggtcagcctttggtctgtaattgcgcccttggggg

SEQ ID NO: 521747 - DNA, 659 bp, Homo sapiens
  misc_feature (153)..(153): n is a, c, g, or t
  misc_feature (158)..(159): n is a, c, g, or t
  misc_feature (196)..(197): n is a, c, g, or t
  misc_feature (212)..(212): n is a, c, g, or t
  misc_feature (261)..(262): n is a, c, g, or t
ggacgcgtgggtcgacccacgcgatcgctgtgggccggatcgaggcggctgggggccgcgggattgggggctccccgctgagcctgagaggagcgcgacaaaggatgcgtcccgccggggtcacagtctccgcggcccaactttgcgcgcggngcccnngcccctggggagcccgcccgctgcgctgagaacccanngcgtcctgggctggngagaggggccgggagcgtcctgcaggtggcgctggcccggatctcccgnncccaggaagggatcccggagcttcctggaggctggcgggcggccgtgtcgctccagtgcaaccggcggctgcccgcggaaactccgcgcgcctccggggattgcccctcgccctagccccccaggcgcgcgggggtccggggccctgcgagggtccccccgttcccccgcggtgattcccaagctgggctaacggccgggcttctcttcctcccgtccatctgtcgcctccttttccatccgacctcgttcaccttttccttccctcttatccatccagaggccccgcgcaaatgggcgcacgctgatacgtttcgtcatcgcttccctgaatcttcccgtatcatctcccagctcgtcctccttccattgggagaaaagcgggccccggaacacag

SEQ ID NO: 521748 - DNA, 132 bp, Homo sapiens
aatggtgctgacagacagggaagtaatatttgaaaaacctgtccatcagaagggaaatgaaacccataataaatggatgcagtatttcaaggatgaatggcagttcgggatggtgtttattttatgggtaat

SEQ ID NO: 521749 - DNA, 156 bp, Homo sapiens
tgggaaaaggaagggactgagggcagagtctctgggtttcaggcagccattatgttattttccattcactattacttaagaagtttgtgtgtaaacagggctcatttctgaggtttcaggaccccttgcccccacccccttttttttattaaaaaa

SEQ ID NO: 521750 - DNA, 103 bp, Homo sapiens
agacacactgctgagttccttggggttcatgttttccttgttcctcccatgcctagctggatgcagagttaagtttatgattatgaaataaaaactaaataac

SEQ ID NO: 521751 - DNA, 748 bp, Homo sapiens
  misc_feature (740)..(740): n is a, c, g, or t
aagaaagatcaaaagagacaaagaaggccattacatgatggtaaagggatcatttcaacaagaagagctaactatcctaaatatatatgcacccaatacaggagcacccagattcataaaacaagtccttagagacctacaaagagacttagactcccacacaataataatgggagactttaacaccccactgtcaacattagacagatcaacgagacagaaagttaacaaggatatccaggaattgaattcagctctgcaccaagcggacctaatagatatctacagaactctccagcccaaatcaacagaatatacattcttctcagcacatcacacttattccaaaattgaccacacagttggaagtaaagcactcctcagcaaatgtaaaagaacagaaattataacaaactgtctctcagaccacagtgcaatcaaattagaactcaggattaagaaactcactcaaaaccactcaactacatggaaactgaacaactgctcctgaatgactactgggtacataacaaaatgaaggcagaaataaagatgttctttaaaaccaatgagaacaaagatacaacataccagaatctctgggacacattttaaaacagtgtgtagaggcgaaatttatagcactaaatgccacaagagaaagcaggaaagatctaaaattgacacctaaatcacattcaaagaatagagatgagagcaaaaattcaaagtagcagaangaagaatt

SEQ ID NO: 521752 - DNA, 260 bp, Homo sapiens
cccaccattttttaaaaaaaaaggggggaaaaaaggggagggtttttaagggcagacattgcccaccctttcaggatggggggggtttaaaggggaaataaacccagtttcataaactaggggaagatttgttgcaaaaaataggatgagggaaatttcttgggggatccaaccaaaggaagaagggggccttaaaccctgagggggcccaaaaaaaacatgcggcctttttccaagaacatggcccccaaaaaaaaatg

SEQ ID NO: 521753 - DNA, 492 bp, Homo sapiens
  misc_feature (1)..(1): n is a, c, g, or t
  misc_feature (11)..(11): n is a, c, g, or t
  misc_feature (39)..(39): n is a, c, g, or t
  misc_feature (49)..(49): n is a, c, g, or t
  misc_feature (66)..(66): n is a, c, g, or t
  misc_feature (82)..(82): n is a, c, g, or t
naacctggttntggtggcctcaaaccctgtggtccccancctacttggnaggctgaggtgggaggnatcacctgaacccccnggaggtcaaggctgccagtgagccctgatcactcccactacaccctgggcaacagagcaagaccttgtctcaaaaaagaggagggaaacaaaagaagaggaaaaaaaagagtggctgtactcctgtctggaattagcacagctgactggaaaaacccaagtccctagagcttacaacactgaccgctatgtcggaagaaaacagacttatgagaatgtgtgttcttgtttaaaaagcaggtcctgcatgtcacaagtaattctgaatcccttcccccttgatcgagttgatgccctgggctgccaaatcctgcaagctcactgcctttcagtcaaccagaaccaaagaatgaggccaaggaactctgtcctgtttgttttctgatgtgttgaaaaatgagaaaaaaaaaa

SEQ ID NO: 521754 - DNA, 363 bp, Homo sapiens
  misc_feature (103)..(105): n is a, c, g, or t
  misc_feature (107)..(107): n is a, c, g, or t
  misc_feature (112)..(112): n is a, c, g, or t
  misc_feature (114)..(114): n is a, c, g, or t
  misc_feature (120)..(120): n is a, c, g, or t
  misc_feature (123)..(123): n is a, c, g, or t
  misc_feature (156)..(156): n is a, c, g, or t
  misc_feature (185)..(185): n is a, c, g, or t
ggcctctggttgcagctgtggctctcagtgtacggggccctctcctctcattgtaggagttctcggcttacttgggttttccctctgctgtagaacattggtnnncntcccngncttggntantggactcacaccagctgtgcgatgcccgctttnacaattaaaggaaaactgtggtgttcagngtcaccttgtcagcaacactgtgtcccttcgcccggcggttcttctctgcggctttgggaccactcagccaacattggaccccaatcaaatataacggtgtctgacactgactttggttttacctcaatacaactgtctacgactttcggtatggatgcaaaaaaaaaaacaacaaac

SEQ ID NO: 521755 - DNA, 104 bp, Homo sapiens
tgaacccgaccctgggtggactccctgctctctgccagcccctgtcttacccctgggtccccacggccccttgctctcttcccctctgctagaatctcgctgag

SEQ ID NO: 521756 - DNA, 432 bp, Homo sapiens
tatgctgtctcactaggtcgccaggtagtcaactcctaacttcaagtgatcttccaccttggcttggtgtcccaagcgagttagaaaaacgccacactttgagacaaattaagagtcttttattagccggcgacctagagacggctaatgctcaaaattctctcggccccaaggaaggggcttgattaacttttataccttggtttaggaaggggagggggggtctagttaaaacaattttacggaagtaaagtagtcaaaaagttaaaaggacaaatggttacaggaaagtaaacagttccaggtgcaggggctttaagactattacaaggtgatagatccggggctttgggcgtttatcaatcggacgaattcctgggaactgcggatatagcttgccacagtatcttatcagttaattgcattcttgga

SEQ ID NO: 521757 - DNA, 623 bp, Homo sapiens
tgggggagggcccccccaccccccccttcccccggggggcggatcttttatgcaagagcgcgccggtgtttcccccctaccgggcggggggcgccccctttttgtggggtggtgcctcttttgggcccccccgctttcccatttttttcgcgcggtttggttgtgggggtgtttgtggggcggcccccttttcccccccccgcgcccggcccgtgtttttgtgtggtttttggccccccattaggggtttgcgccccccgcccccgaactcccctttgatatttttaggggctccccctaggggggtggggggggggggtccccccctcccttgggttgttttttgttttttaaaaagggggcgaggggccccccctccccggggttttttttaggtttcccccccccgcccctcccccccccccccccccgggcccctgggggttttgggggggggcttggggaccccccccccccccccccccgggggccctggggggttttggttttttttttttccacaaaccccctcccccgccttttttttctggggccctttttttttttttttaagaaaaaaaacaatcccggaaattaaaattaagggcccttttttttaaaga

SEQ ID NO: 521758 - DNA, 366 bp, Homo sapiens
  misc_feature (224)..(224): n is a, c, g, or t
ggcccaggagggggtcgatgggcactcacagaaggggactgacagtgggcaacactcacatcccactggctgctgttctgaaaccatctgatttgctttctgaggtttggctggcgtggtggactgctcatttgagccactctgcatatttggacttgcctcgcgttcctgaatgcgctctcagagccgttctgtaagatacctggttgctaacatcccatgcncgctccctcgctcacgcatgcacccacgcgacctgcagggccctgtcctcaggaatgagatgtgtgggatggtcgctattgtaatgtgcgtggttctctgttttatttctcttccccttctgatggccctataagactttca

SEQ ID NO: 521759 - DNA, 1404 bp, Homo sapiens
  misc_feature (31)..(31): n is a, c, g, or t
  misc_feature (872)..(872): n is a, c, g, or t
  misc_feature (875)..(875): n is a, c, g, or t
  misc_feature (887)..(887): n is a, c, g, or t
  misc_feature (900)..(900): n is a, c, g, or t
  misc_feature (903)..(903): n is a, c, g, or t
  misc_feature (914)..(914): n is a, c, g, or t
  misc_feature (919)..(919): n is a, c, g, or t
  misc_feature (981)..(981): n is a, c, g, or t
  misc_feature (1000)..(1000): n is a, c, g, or t
  misc_feature (1083)..(1083): n is a, c, g, or t
agatgggtccatgccatactcccctgggccnaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagcccccctttcacttctgagtcccagaggttacccaaggcaacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccttactactatctcgcacctgaaacaagctaacatgactaacacccttaattccatccaccctcctctccctaggaggcctgcccccgctaaccgggtttttgcccaaatgggccattatcgaagaattcacaaaaaacaatagcctcatcatccccaccatcatagccaccatnacnccttaactctantctactagctaantantcacctcatanactantcccatatttaacacgtaaaataaaatgacgttgacatacaaaaaccacccattctcccaantcatggccttacacgctanttctactatctcccttttatactaatatcttaccaaacaaaaaaaacaaaaaaaaaaaaaactatcggcccgctttgcccagncgatataacttggcaagctttacatgcggccgaattgggctattgggcacatgcctcaagggaggtatacaataatggcgcggttaaaaccgggcttggaaaaacgtggtaccactatagccctttgaaaacactttttcgcgggtggaaaaaaaaagcccccacggggtttttcaaaagggccctctaggggaaaaaatggcccgtatatttaaaaacccctatttttaaaccctttttaaaacggcgggggggacctcttaaaccggcgaaaactaacaatggggggtgcggggcgcccccaaatatttgtgggggagc

SEQ ID NO: 521760 - DNA, 336 bp, Homo sapiens
gggaggacggtgctccaggtctcgtccgcgatgtgacgagcggccttagggagagtctatcattgcaactcggactcaacataagggcttttagaagggtaggttttggggaatccctttccaagagtggtccacaaaagccccgagacccaaacccccctttacgggaattggcacatatattagatttttcgctcggtatattcagtgacagatactctctccactaaatatctcacattttgtctatagggatatatggcacgcactctctactacaacaccctaccactatatacacacacggggaagagtattacagcagagagaagtttt

SEQ ID NO: 521761 - DNA, 1420 bp, Homo sapiens
  misc_feature (31)..(31): n is a, c, g, or t
  misc_feature (997)..(997): n is a, c, g, or t
  misc_feature (1016)..(1016): n is a, c, g, or t
  misc_feature (1099)..(1099): n is a, c, g, or t
agatgggtccatgccatactcccctgggccnaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagcccccctttcacttctgagtcccagaggttacccaaggcaacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccttactactatctcgcacctgaaacaagctaacatgactaacacccttaattccatccaccctcctctccctaggaggcctgcccccgctaaccgggtttttgcccaaatgggccattatcgaagaattcacaaaaaacaatagcctcatcatccccaccatcatagccaccatcaccctccttaacctctacttctacctacgcctaatctactccactcaatcacactactccccatatctaacaacgtcaaaaatacaatgaccagtttgaacattaaaaccacccattctcccaantcatggccttacacgctanttctactatctcccttttatactaatatcttaccaaacaaaaaaaacaaaaaaaaaaaaaactatcggcccgctttgcccagncgatataacttggcaagctttacatgcggccgaattgggctattgggcacatgcctcaagggaggtatacaataatggcgcggttaaaaccgggcttggaaaaacgtggtaccactatagccctttgaaaacactttttcgcgggtggaaaaaaaaagcccccacggggtttttcaaaagggccctctaggggaaaaaatggcccgtatatttaaaaacccctatttttaaaccctttttaaaacggcgggggggacctcttaaaccggcgaaaactaacaatggggggtgcggggcgcccccaaatatttgtgggggagc

SEQ ID NO: 521762 - DNA, 353 bp, Homo sapiens
tattgccgtagtaataaacaccagtcattcaacttgaatgtaccagaacttaacagtatgaatatgtcaagatcacagtaagttaataacttcaccagtaatgaagtagacatgtaaacagatcactactacaatggagttggagaaacttcattcaatggattgctaaatggtagctctaaacatgaccacgaaatggaatattgtgacaccgtggaagttgattcaagtcagatgagacgccagttgtgtgtaggaagtcaggccgccatagtaagaatgatccactttgtacgagagctgcaagcaatgagtgaacagcttaggagagactgtggcaagcactgcgcacg

SEQ ID NO: 521763 - DNA, 377 bp, Homo sapiens
ggggggcccccccccccttttttttttcataaacgggcttttaaaggggggggccccatgtaagttcttccctccccgggctttagaggggggccccggggttggggcccccgggggtgtgttctttccccccccccccctgcccccttccaaacaatgcaaatttgattttgggggggtggggccctttgcctttcttaaatggtgggaagcccgtgggcccccctttaggcccttgggggttttccctagtggggcccaatcaacctcattttttgggggggcaactttttttggctttggagtttggggggggccaaccccccaagaactgttccctccttcgggtggggcaattaatttgtggggggggggga

SEQ ID NO: 521764 - DNA, 1248 bp, Homo sapiens
  misc_feature (31)..(31): n is a, c, g, or t
  misc_feature (1248)..(1248): n is a, c, g, or t
agatgggtccatgccatactcccctgggccnaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagcccccctttcacttctgagtcccagaggttacccaaggcaacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccttactactatctcgcacctgaaacaagctaacatgactaacacccttaattccatccaccctcctctccctaggaggcctgcccccgctaaccgggtttttgcccaaatgggccattatcgaagaattcacaaaaaacaatagcctcatcatccccaccatcatagccaccatcaccctccttaacctctacttctacctacgcctaatctactccactcaatcacactactccccatatctaacaacgtcaaaaatacaatgaccagtttgaacattggcaaaagccacgccattcctccccacactcatcggccttaccacgctagtcctacctatctccgcctgtatagtaataatctggcgaagaaacaacgaaacaacaagaaggcggggggcggccgggccccggaaaggggagaacacaggggggcgcggggccccgggtgggtccaccggccaggggcccgaaaccgggcaccacggggcgttgcccaaaaacccgggggcggggtccaccccgggcgggcaggcaaggcagcgacccggan

SEQ ID NO: 521765 - DNA, 408 bp, Homo sapiens
tggagacgatcgaccgcaagacagactctgcaatcagagactagttcgaagattgccgacgactcgatcctgccttcggacgctggtgttcggcggcgcgcctccaccagtttgcgcatcgtcgcatggtgatcgacccgagagttgcgcgacgacgtcgtcgatctcgccgaggacctcgctgagggtctgctcttcgcgcgttgctcccctgttgcgtggctcgaccgccctcagctcctcaaagagttgagcgacatctagcagggtcgtacggcgtgaatttccgacgaactggtaccccccgccgacgccgcgaaccgagcggacaaaggccaggcgcgcaccatgaatgtgcatcacctttgccaagtgatgactggatacgccgtacttcttgccgatctc

SEQ ID NO: 521766 - DNA, 168 bp, Homo sapiens
aaaaacccggtgggaaaaaccaaaccggggggcccccaaaatttttggaaatttttttttgggccgaaaggggggggcccaaaaaaaaaatttttttaatttttacccggggccccaaaaaaaagtcccggccttcccttgggccaataaaagggggggtttttttta

SEQ ID NO: 521767 - DNA, 1127 bp, Homo sapiens
  misc_feature (704)..(704): n is a, c, g, or t
  misc_feature (723)..(723): n is a, c, g, or t
  misc_feature (806)..(806): n is a, c, g, or t
tgcatcttacatactcaatgtgtgtcctgcactaagactaagagtaactgccttacagttctgcagtcccagcaagtaaacctatgtacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccttactactatctcgcacctgaaacaagctaacatgactaacacccttaattccatccaccctcctctccctaggaggcctgcccccgctaaccgggtttttgcccaaatgggccattatcgaagaattcacaaaaaacaatagcctcatcatccccaccatcatagccaccatcaccctccttaacctctacttctacctacgcctaatctactccactcaatcacactactccccatatctaacaacgtcaaaaatacaatgaccagtttgaacattaaaaccacccattctcccaantcatggccttacacgctanttctactatctcccttttatactaatatcttaccaaacaaaaaaaacaaaaaaaaaaaaaactatcggcccgctttgcccagncgatataacttggcaagctttacatgcggccgaattgggctattgggcacatgcctcaagggaggtatacaataatggcgcggttaaaaccgggcttggaaaaacgtggtaccactatagccctttgaaaacactttttcgcgggtggaaaaaaaaagcccccacggggtttttcaaaagggccctctaggggaaaaaatggcccgtatatttaaaaacccctatttttaaaccctttttaaaacggcgggggggacctcttaaaccggcgaaaactaacaatggggggtgcggggcgcccccaaatatttgtgggggagc

SEQ ID NO: 521768 - DNA, 1390 bp, Homo sapiens
gtttatgggccatggctagatgacatctgcttgtggctgtgggtaggaccgaccacaggtgttcgcatcaccctaggcttcattgcatgaccctgagcaggacacgtatcacgtttgagctgcagcagctgaggtagcagtgtcaggcaggtggatggatgcgctctggggtcgggccatcgtacggagcttcagtgtcggaggaatgcactcatcattcgtagcagggaagcgagagatcgcggaaacggttgacggagcacaggctagtgctgtcaggtgggcttgctaggagcggtccggggggtgtgaggctgcaaggttgcgctacgaaggggcaccgtcccttcacacgtctccttggacttcagttgggtccagctccggtcactactccacatcagagtgagcacccgctaggacagcgaagttctgtgctttatgacctgacgggacagtgcccatggttaccaaagctaagaggtcgtgcttagcaagggcagttgaggccgcaagggtcgaccaggtgcgtgtgccacgctgtgtgcacgcgagggcctggtggcgttgggcccgtagccccaggccatagtaatccgctttgggtcgtcgccttggattctggtgttcggtttgtcggcgtaattccggggatttgccgcgggtcagggggtttttcacgtcgatgttttgcccccaggggcataccgagggttgcaagtagtgtgggcagtgagctcacgttgttgatagcttttggccgctatctgggaggctcatagggttgcctccctaccctggcgcttcagaggtatgcccaagggttacgtcggtgcgggactccaccaatggtcattggaggccctggccagaagacctcgaggccgaatccatcacccttggggagtttgttaccacagttgcgggaacgggttgctgaggggtatgtggggaggaacatttccacaaggtggcttgagcaagccacagagtatggggttttgttgtgggccaagggaggcccttcccgtttgtgacctgggacagaacgatggtggccggtcgggccatggcgacttgggggcgacgcgcctgttggtgggtgtccccgcccagtggggattcttaacccccttataagcttgtgtgcctgtgtgcagcccctgtggtgtggcccccaacaatgtgctgttgtttgccctcgctcccggtggaattattgtgaggcccttcttcccccaacaggggttttcctccctcggccttggcatggggtgggtagcatcccacacggtggcgaccgggttagtaggcccccccagtgttgtagtgtgtctgtgtgcgccccgtgtgctcgcgtttgctggtgactaggtactaacccctgacg

SEQ ID NO: 521769 - DNA, 994 bp, Homo sapiens
  misc_feature (31)..(31): n is a, c, g, or t
agatgggtccatgccatactcccctgggccnaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatggctatagcaataaaactaggaatagcccccctttcacttctgagtcccagaggttacccaaggcaacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccaaaaaaaaaaaaaaaaaaaaaaaaaaaaacaatgtgtcgggggggcactacggaaaaagctttttatagcaccaactcgggtgtgtgggcccggggccccagagggtacaggtggaaaccgtggggccaaatggcgggttcccaaagggagaacaccggggccagaaaaaaggggggggatttctacaccacattaaaaaaacgcccggggggggaacacaggaggcggttctccggacacaaccaacccagaaggggggtcacgaggaggagccaccaaacggggggcactcaactccacagggggcgtcccaaggggagaagacgggataatcaaaacatactacagccccggcaacgtggagtcaacgacacaacacaaactaccacgcaaactaccacagaccgacgctcacaccaacagcaccagaaatcacccatacaagcacccaccagg

SEQ ID NO: 521770 - DNA, 130 bp, Homo sapiens
ggatttgctggtgcagtacaactaggcttaatagggctcgaattcgactcgaattcgaggttgcggtgagccgagatccggccgttgcactccagcctaggcaacaagagcaaaactcctgtttcaaaaa

SEQ ID NO: 521771 - DNA, 275 bp, Homo sapiens
cgaacagaacaagcagggttttgttccgaatgtctgacgtcatgccaccagagagaaacgaacgattgctacaatcctgctggagatatccaagggggtcgtcctggtcaccaatatcaagcccaagagcagcagtctcattccaagccatgggctctgttctgatgagagagctgtagagctaaactgaaagccgtttcttgaactctggtgaggtgacctaagacatacggtactaaccagcacatgcataagtcgacacaccttcattccta

SEQ ID NO: 521772 - DNA, 161 bp, Homo sapiens
ttgtccatcatttcttaaaaaaacatttcttctgtttggaatcataattaactctggttatcagcctatttgtaattattgtcttgtcgtcacttttcttgaatgttttctagtcattaaacagatatgaaggcatgccaaagagctttaatatccagtaa

SEQ ID NO: 521773 - DNA, 821 bp, Homo sapiens
  misc_feature (37)..(37): n is a, c, g, or t
  misc_feature (60)..(60): n is a, c, g, or t
  misc_feature (64)..(64): n is a, c, g, or t
  misc_feature (131)..(131): n is a, c, g, or t
  misc_feature (178)..(178): n is a, c, g, or t
  misc_feature (434)..(434): n is a, c, g, or t
agtggtacgggtccgactgaggggtactcgccaccgntggcgtccacccgagcggctgcncgancaaggcccgagggggtgggcgtggcggccgcgaatacacaaccccctctgttccctctcttcgcggngcgccgcgtagttgccatccgccagctgccatgagcgagcgcctccntcccaggaaaaggagaaggaatggcaacgaagaagacaaccatcttcccccccagaccaaaagaagtagcagaaaccctgtctttcaggattcctgggacacagatgtcttcagtgcatgtgacatgtgtgtgtgtgatgcatgcatgcatgcatgcatgcatgcatgcatcaacatgccctgtgacatgtggccatgctgtgtgcctgtgaatggcatgctttgatgccatgaaccatggcctggatccatgccnctaacactgcctcatgccctgtgccctgagcagtcctgctgctgtgccaatggcctctacttccacatcaaccagaccctgagtggatggcccacttccacagcctacagcacctgagggctggcctctgacatgatgtgtacggcagtttcttgccttctgtgaatgggacagcgctgtgcagatttgatatttcaacttacaacttgttttaaacagaaaaattgcacacgaaaaatgcctgttggcttttcagtctatatttgaaataacaggttaacaggcagtttgtctacttgtggttttgctgcactattgcaatttcaaaggggctttgaagcattttttataggattctttgagggagggtatcaaatctatgtccag

SEQ ID NO: 521774 - DNA, 468 bp, Homo sapiens
aagagctgcagaaattacagcaagacatagagatggtagaacgcaatgaggatcatcacctggtggtccttaaagaatctgagatacttcttcaggccaaaagagccgaactggaaaagctgaaaagccaggtgacaagtcagcagcaggagatggctgtcttggacaggcagttagggcataaaaaggaggagctgcatctactccaagaaagcatggtccaggcaaaagctgacctccaggaagctctgaaaactgggagagactgaagtaactgagaagtgcaatcacattagggaagtaaaatctcttctggaagaactgagttttcagaaaggagaactaaatgttcagattagtgaaagaaaaactcaacttacacttattaagcaggaaattgaaaaagaggaagaaaatcttcaggtagttttaaggcagatgtttaaacataaaaccgaactaaagatt

SEQ ID NO: 521775 - DNA, 298 bp, Homo sapiens
  misc_feature (107)..(107): n is a, c, g, or t
  misc_feature (139)..(139): n is a, c, g, or t
  misc_feature (189)..(192): n is a, c, g, or t
agaagttctactggtaggttttttttttcttcttctcttgaaacagggtcatgatcttttgcccaggatggagtgcatgatcatggcccatcacaacctcaaactcntgggcttaaatgaacctcctgccttagcctcntgaatagctaggactacaggcatgtgccatcttgtgaggctaatctcttnnnnaaaattgttttgtcgagacagggtctcactgtgttgcccaggtaccactggtgattctgatatacaaccagagttgcaaaaaatgttaggcttctgcctctatggt

SEQ ID NO: 521776 - DNA, 815 bp, Homo sapiens
  misc_feature (815)..(815): n is a, c, g, or t
gagggctaatatccaggatccacaaagaacttaaacaaatttacaagaaaaaaaggaacaagcccatcaaaaagtgggcaaaggatatgaacaggcacttctcaaaagaagacatttacacagccaacaaacatgaaaaaaagctcatcatcacttgtcattagggaaatgcaaatcaaaaccacaatgagataccttctcacgccagttagaatggcgatcattaaaaagtcgggaaacaacagatgctggagaggctgtggagaaataggaacacttttacactgtggtgggagtgtaaattagttcaaccattatggaagatagtgtggtgattcctcaaggatctagaattagaaataccatttgaccaagcaatcccattactgagtatatacccaaaggattgtaagtcattctactataaagacacatgcacacatatgttcatgtggcactattcacaatagcaaagacttggagccaaccaaatgccatcaatgatagatggttaccaaaatgttgccatatctaccatggaatactatgcagcataaaaaaggatgattcatgtgctttgcgggacctggtgagtagaaaacatcattcttagaataacagacagaaacaacatgctgtcccactcataatggagttgacctgcgaccatgggcccgggtggctccccatgggctggggagggggccacagcgggtacctagaaactagggggacatgttttggggccccccggtgtcttgtcaacggttgggtggccgaaagtaacaaaaaagacccacaccttggtcaaagcn

SEQ ID NO: 521777 - DNA, 843 bp, Homo sapiens
attactcccctgggccaagccgtcatctactctaccatctttgcgggcacactcatcacagcgcgtaagctcgcactgattttttacctgagtaggcctagaaataaacatgctagcttttattgccagttgctaacccaagaaaaatgaaaccgctcgttccacagaagctgcaatcaagtatttcctcacgcaagcaagcgatccatagatccttctaatagctatcctcttcaacaatatactctccggacaatgaaccataaccaatactaccaagtcaatagctcatcattaataatcataatggctatagcaagtaaaactaggaagtagcccccgtttcactgtctgagtcccagaggttacccaaggacacccctcgtgacatccggcctgcttcgttctcacatgacaaaaactagcccccgcatctcaatcatataccaaatctctccctcacggtaaacgtaagccttctcctcactcctcgtcaatcttatccatcatagcaggcacggttgaggtggattaaaccaaaccgagctacggcaaaatcttaggagatactcctcaaattaccccgcataggatgaagtacttagcagttctaccgtacgaaccctaaacataaccattcttaatttaactatttatattatcctaactactaccgattcctactaatcaattaaactccaggaccacgaactttattattcgcacctgaaaaagttaaatgagtaaaaccttattcatgcgaccttctctcctaggaggcggccggtaacggtttttgcccaaggctttggagatccaaaaaatgctctatccccttgccac

SEQ ID NO: 521778 - DNA, 683 bp, Homo sapiens
  misc_feature (31)..(31): n is a, c, g, or t
  misc_feature (258)..(258): n is a, c, g, or t
  misc_feature (329)..(329): n is a, c, g, or t
  misc_feature (356)..(356): n is a, c, g, or t
  misc_feature (362)..(362): n is a, c, g, or t
  misc_feature (374)..(374): n is a, c, g, or t
  misc_feature (417)..(417): n is a, c, g, or t
  misc_feature (446)..(446): n is a, c, g, or t
  misc_feature (455)..(455): n is a, c, g, or t
  misc_feature (485)..(485): n is a, c, g, or t
  misc_feature (496)..(496): n is a, c, g, or t
  misc_feature (498)..(498): n is a, c, g, or t
  misc_feature (536)..(536): n is a, c, g, or t
  misc_feature (540)..(540): n is a, c, g, or t
  misc_feature (547)..(547): n is a, c, g, or t
  misc_feature (584)..(584): n is a, c, g, or t
  misc_feature (588)..(588): n is a, c, g, or t
  misc_feature (604)..(604): n is a, c, g, or t
  misc_feature (679)..(679): n is a, c, g, or t
atgattttgctgcttagtattttttgctgangctatagagaatgctaaggctacggtttttaccccctcttatatgtttttgtatgttttagtgtgatatatattaatatatattgatacacatattaatatataatgcaatatatattaccgaagagaacacattgattaaagaaatacaaaaatttggcatcatttccaaacttaaatagtgaaaataaaaactacaaaaggagctgcataccctaaatgtatgangtgagaaacaagcatatgcaaaaatgtgaatgtacatccaatttctctggtcttgtgatatgacatcaganccatttacaatggcaaaaccctaaggnactgcngtgaagagagcntgtgtgcgcgcgcttgggtgtgctgcaaacaaatagcagagcncaaagcaaaaagcctgtgccggtgaagtntccgacgtnggtgaacaccaaatgatggactgtgctganagggggttgananatcaggttacacattgacagaaagtatttggacctcanattncagtttnaaaaccagaaactttacatttaagaaataatcccttnattnaagtgaaaaaggattnttggaacgatagggaggtctgttacctgggaacaaggagctggttcagaccaataaagctacgagtgaattaatnaagt

SEQ ID NO: 521779 - DNA, 100 bp, Homo sapiens
ggcagacttgaccttgaccagatagtcttcaagatgccaaactggagcggaggcagcaaaatgtggagcgtgtcaacagaccgtactacgatgcagaaga

SEQ ID NO: 521780 - DNA, 129 bp, Homo sapiens
actagctgtaagtcgtggtcatcggaaaaccccatgcacaaaagacaaacattcaagccgcattggaggctcatctcacaagagatgaacttcgggcaaaagctctccatatcccattccctgaagata

SEQ ID NO: 521781 - DNA, 238 bp, Homo sapiens
  misc_feature (7)..(7): n is a, c, g, or t
  misc_feature (65)..(66): n is a, c, g, or t
  misc_feature (79)..(79): n is a, c, g, or t
  misc_feature (84)..(84): n is a, c, g, or t
  misc_feature (91)..(91): n is a, c, g, or t
  misc_feature (94)..(94): n is a, c, g, or t
  misc_feature (96)..(96): n is a, c, g, or t
  misc_feature (105)..(105): n is a, c, g, or t
  misc_feature (113)..(114): n is a, c, g, or t
  misc_feature (119)..(119): n is a, c, g, or t
  misc_feature (150)..(150): n is a, c, g, or t
  misc_feature (179)..(179): n is a, c, g, or t
  misc_feature (183)..(183): n is a, c, g, or t
  misc_feature (193)..(193): n is a, c, g, or t
  misc_feature (209)..(209): n is a, c, g, or t
gggaaanggagagcaaacccacaaaagctaaactccaaacacccaaaggtgttgctacatttttnngaggcgtgggcanggcancaaatgnatnanaatggggcncctcccannaagtnagcacccctcccccacaggatgaaatgctcnggccagggatggggcccaagcccacacancatncacactggangacacgctgccctcanacaaacacacatgcacacacacccacgtt

SEQ ID NO: 521782 - DNA, 202 bp, Homo sapiens
  misc_feature (139)..(139): n is a, c, g, or t
  misc_feature (159)..(159): n is a, c, g, or t
  misc_feature (187)..(188): n is a, c, g, or t
gtcttcctgtttgcattgtgcagtggggcacatctctctcgatggcccactcactggtgtcacagagggcggcacagctaggcagtatggtcagtgtagttccatgtgctctgttgtacggaattctctggcacatgtnggcacaaagctgtgcccccngatacatgcgaccaggtggcatcctctnnagagtcgcacctgc

SEQ ID NO: 521783 - DNA, 929 bp, Homo sapiens
atatattagtgcatatagaatggccagtataaacatttaaccagtttccactctttttcagtttacagtttaatgacattaaatatgttcacatgtttagcaaccatcaccgccatcatctccggaacagttttatttttcaaaatggaaattgcaaccattcgccaagctctccactctctctctcgcccacccctgggggccacctattctagttatgcaactctaggagtctaactactctagacacttgatagataagtgtgaatcataccgtgtataatctttgtttctttccagcaggtagaatctttctcgtgtcacccaggctggagtgcagtggcgtgatctcggttcactgcaacttccacttcgggggctcaagcaattcttatgtctcagtctcccgagtacgctgggattacatggcgtgcgctatcatgcccagtctaattttccgtattcttgtaatagatgacgagctttcactcatattggccaggctggtctcgaactcctgagcttaggggatccacctgtctcagcctcccaaaaatgctggggttacgggtgtgtgccactgttgcctgggcatgtgtatcctttcgggatctctctgtttcccctgccgataatgtcttcgggttctccatgttgcggctgcttcagaagtgactgttggtgtcgtcgtttaccgcgtgggaatcgtctgggtagcgttccatggggttcactctgtggccggttggctttgcagtggccactcaggctcgtaaacctcgctccgggtcaggatctgtctcaattctgatactaattaagtgtgcccccccctttcgtttttacatgggtccttgtgcctgtttattgtcgtgtcagccacccgtgtgtagctctgcccggtttttagtgttcgctttttttccggg

SEQ ID NO: 521784 - DNA, 255 bp, Homo sapiens
cctttattatttcccctgaattccaatttcatttctgcttccgctaagtaagagcccccccttcctgtgttttctctactattgagcggtagacgaactgtttctctaattataaacccacctgtttgggatattcagggaaaccccccccatgttatgttgtcctttaatgggaaaggctggggtcatatgtatttttatgttctgtaaagtatttgccttcctagttccccataaaatttttttagggctata

SEQ ID NO: 521785 - DNA, 396 bp, Homo sapiens
caggtgtgagccaacatgcccggcccatcagctcttaagcagcaagaggccctacatctgtctgcctgtctgcacagcacagttaagcaggtggctgcatcctctgcagttgctgacagcctatcttcctgaagatgtaaaccttcctgcaaggctggctcttctttgggtgtgatgaagatgatgacagagatgaatgttgggctctaagggtcctggttcctttgaagcacatccaggggcctctaagatgatgggctctggttcctggcctgtagcatggtgtagaagcaggagcgctttgcaaggtagactctacaggcagcaccttgatggagtatggggtttcagggtgaaagacgtggatcacaggggcacctcagctcgtgaatctca

SEQ ID NO: 521786 - DNA, 337 bp, Homo sapiens
tttgggctgtcgtgccccgagtgccagactccaccagacgtacacagatgtgggtgctggtgctttgcgtcgtattggctctcctcgatattcctctccaggctgctgctggcctttctgagtgggtttgatgtctgctctccaggaaatagctttgctaagagctccgatcttgtagactacgtgtcactccacatggctacttttactctggcaaaatcacacgacatgtcggatctgggaagcctctattgctctttgatgatgggtacgaatgtgatgtgttgggcaaagacattctgttatgtgaccccatcccgctggacactgaagtgac

SEQ ID NO: 521787 - DNA, 1434 bp, Homo sapiens
  misc_feature (499)..(499): n is a, c, g, or t
  misc_feature (972)..(972): n is a, c, g, or t
  misc_feature (1202)..(1202): n is a, c, g, or t
tttaagagcgtcgcctgcgacgtgcgcggatggatgatctgtgtggagactctcgctgtgatagtgcacgaagcgcttatatagttgtgggcacaccaccgggcgtgtcatagcgatcgccctgcaaagtcgagaatcgatactggggtgaggtcggcccctccctgctgcctgtagttgttacccatgtgcgtcttctttgctaggttactacttcccgttgcacggcgcggatgtttttttcttgtagagcgcacccgggggttgtctgctcgcgtaattagtagctgctcctgttgccctcttttattggggggatattctcgcggagagaaactgtttagagaggttgtgaaaacctctgcctaaagaccccgtgtgcgggaatgttctctcagtgagagagggacgtgaaaaaaattggtgtcccccgaggtcccacacaggggtgtctcccccaacaccgagtaagaggtgtggaacaaccttaatgtcgtgngggcgttctcaaaaagatggggtgtatacttgtacctcctccccgcgcccttggtaaaaatgcttgttggggggaattttttagaggtgaaaaacaatgtcgggggggataagaacagcgcaattgtctcccctcagcagagagatcgtcccagcaaaagaaattggggccccccccgagggaacctcccgtcggttgtgtaatatccaatgcgggagggacacacccacatggcctttaaggatatttccaggatattttaagacctgggtacaccccccattatggtagcccccttgaggctctcatatgtgctcccagatagttctctggagggaataaaccacttcacatgccacagaatattgcgcacaaaatggcgctgagagaaaatatatgttacacacactggagatgaaaggaggggtcacagaatgttcaccggagacacatctcgagacactgtgagaggngacacacacgagagattcttaaaacccccacaggtatccgcaggaaaatgtgtttctgtgttgaaaatgttaaatggctaacactgaaatggcttgaatttattccaggcgcccacaataagagccacttgttaatagtatggaaaagttaaatgtggggtgggcttatggcttctttatcctcctgatttctagccactcttcaaggtgagactgttggcgtactggtnatcactattgtagagctattagggaagaagaaagaaatgttggcttaagaaagaacatcaccacttgattttaaatacacagtagcacgggtattgcctttgagttcacactgttttaagtcctcatttttctcacaactaagtggcttgctgttccccaatatgcacagaataacttttacactttttccttccaacactttttgattggctttgcagaaataaagtttta

SEQ ID NO: 521788 - DNA, 679 bp, Homo sapiens
  misc_feature (3)..(3): n is a, c, g, or t
  misc_feature (71)..(72): n is a, c, g, or t
  misc_feature (79)..(79): n is a, c, g, or t
  misc_feature (109)..(109): n is a, c, g, or t
  misc_feature (116)..(117): n is a, c, g, or t
  misc_feature (139)..(139): n is a, c, g, or t
  misc_feature (158)..(159): n is a, c, g, or t
  misc_feature (163)..(163): n is a, c, g, or t
  misc_feature (184)..(185): n is a, c, g, or t
  misc_feature (190)..(190): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (225)..(225): n is a, c, g, or t
  misc_feature (229)..(229): n is a, c, g, or t
  misc_feature (232)..(232): n is a, c, g, or t
  misc_feature (235)..(235): n is a, c, g, or t
  misc_feature (239)..(240): n is a, c, g, or t
  misc_feature (246)..(246): n is a, c, g, or t
  misc_feature (275)..(275): n is a, c, g, or t
  misc_feature (311)..(311): n is a, c, g, or t
  misc_feature (314)..(314): n is a, c, g, or t
  misc_feature (331)..(333): n is a, c, g, or t
  misc_feature (355)..(355): n is a, c, g, or t
  misc_feature (392)..(392): n is a, c, g, or t
  misc_feature (410)..(410): n is a, c, g, or t
  misc_feature (453)..(453): n is a, c, g, or t
  misc_feature (557)..(557): n is a, c, g, or t
  misc_feature (644)..(644): n is a, c, g, or t
agnaggaaggagagaccaagtgtacagagccttaaaaaagacatcctctcccggcctcccatcccaaagcnntggtccntaggttagtttagacagaaccaggaaagcnaaaaacnntaggtacctagtatgttagttnatggggagaacgcaggttnntgtnggtagcttccactttcaagcnngggcnttggttattgggatagtgcgggntcnagtngcttnaggngancanccgnnaggtgnaggttgcgagtgactagcacatgggtggnagcagcctcacggagtgtgggggggcgagtgtgagncanagggtgggtgaggaggnnntttgggggactaggtggctggnagatggggtctcggccttggctgatccattgctaggnatgtgaaatgcagctgtngatgagggagctggcactgtaggtgtggggtgggtggggcgcnagaagcagggatgcggacccaccgggctctgggctgggggcactccagaggtccgggctggcctgctcttcgtccaggtggttccagtgctgctggtgttccangcagcggacagcgacctggtccagtgtcactgtgaagttctgttggtctgcgttgcctggtggatgacacctctgtcaggttagggnagaagacggcatagtcaaactggcagggctgcagc

SEQ ID NO: 521789 - DNA, 706 bp, Homo sapiens
catggtgtctcacgcctgcaatcccagcactctgggaggcctaggcgggcggatcacaaggtcaggagatagagaccatcctggccaacacggtgaaaccccgtctctactaaagacacaaaaaattacccgggtgtggtggctcacgcctatagtcccagctactcgggaggctagggcaggagaatcgctcgaacccgggaggcggaggttgcagtgaggcaatatcgtgccactgcactccagcccgggcaacagagtgagactccgtctcaaaaaaataaaaataaaaacaaaatacaaaaaaatagcttgggcatggtggcacatgcctgtaatcccagctactcaggaggccgaggcacgagaatcacgcgaacccgggaggtggaggctgcagtgagccgaggttgcaccaatgcactccagcctgggtgacagagcaagactctgtctcaaaaaaaaaaaaaaaaagagccaagcatggtggtgcacaccttgtactcccagctacctaggaggccgaggcacgaggatcacttgagcccaggaggtgaaggctgcagagagccatgataagcgccagtgcaaaccagcctgggcaaaagagcgagatcccgctctggggcaggactacctatgtctggatccgggaggtggaaccccgggagtgtgcctgagtaaagtcatggagtactgatcctga

SEQ ID NO: 521790 - DNA, 322 bp, Homo sapiens
cctgtgggtagcacaacctagggtcagttttgcatgtggtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 521791 - DNA, 575 bp, Homo sapiens
tcactatgagatataagaatagtgcttaatccaatccaggactgggtgttcttataacacgcacagagcacttgctctctttctctctctctccatgtagaaccaagaaaagaacatgtgaagacacagcgagaaggcggctgactagcaaaccagagaagacagccctcaccagaaaccaaattttggggtaccttgatcttggactaccagcttccagaactgtgggaaaatacatatctgtagcttaagccacccagtcggtggtattttgttatgacagcccatgagactgcatcatatctcaatgatatcttgggtaggtgtgacaattatgcagtttcttcaaggtacaattatataaaccgaccaattgccacagatattgggacattacagcaacaaaaacaacacaactatacaatcacaccttagaatacagacctagaatgcaataaggacacgaagcaccatctcagcagtgaaatttcactaaataaagggctcacaagaaacgaaatatcatccagcaaaatatggtcatcactctttagagatgtctaacaataagttgt

SEQ ID NO: 521792 - DNA, 292 bp, Homo sapiens
ctgtggaacaagcggtagctcgggttgggaaaagggaacccgtgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgcgcttgagtcaattg

SEQ ID NO: 521793 - DNA, 428 bp, Homo sapiens
  misc_feature (118)..(118): n is a, c, g, or t
cattttaaaaacgtatatggcagcagaaacttgtttctcaatagaaaaaatacattcagaggcatttctgggatagtctatctgtgttagtatttggtgctatctatgtccagccaanttaaatacccaaagcacaaacatgattagtcaaaatttgagggtagataacttggctggacatagatagcaccaaattctgactaatcatgtttgtgctttgggtatttaaaattacatacatatatattctttttgccaaaaacaaaagtcttgcttcttgtcaaatgattgctaaagtaaatcttacattttttgttattatatatgtatttatacacatccccaacacacttactcatttctattatttcctacagaacacacctttaaggctataacatacaactaaaacgaacccatctatttaa

SEQ ID NO: 521794 - DNA, 745 bp, Homo sapiens
ttgatccgaggctttgcgcagataggctggggctgcgtgccatgagcgttgattgtgctgtcggatgggctggacgcagctgcgaggagctcactgcggatcctaaacccgaccgcagctcctcggacgcaggtttaactatcttatatatcaacaaaaatgcggattcagaacaagcacccaggaaggttgaacctcgaagatcagaaccagggacaagtggtgaagcatacaagagaagtgctttgattcctccatgatggaagaaacagtcttttatccattctccctatcctataaggagtctcataaaagctttatttattactgtagggtttacaggctgtgcaatatggatcagctgctattaggcaatatgaatcactagcaatccagggtccatcagttatatagatggtataaaagctgattggttggcatcagcataagcacacaaaaaagaaggagacttcagaaaggagataaacaagtggtggaataacctacagtgatggaccagcggactgtgacaggtattatagctgcaacttgtcctatgtatactggtatattggagaagtacattcttctgcagcggaaccaatgactcaagattattacacatcgaaatccagacctcacaggtcctatgttactccaattgtagctgtcaacattaagttaatatatacttaatacacatggagaaaataagaattgatagtggacattatccaacatataa

SEQ ID NO: 521795 - DNA, 361 bp, Homo sapiens
ttatgaggttcctaataacattttcttttctctagcctatttattgtaagaatgccatacataatacatgtaatattcaaaatctgtgttaatcatctgtttatgttatccataaagcttttggcaaacggtaggctactagtggttaagttttgggacatcaaaagtcatatgtgaatttttgactgcttggggcttggtgcctcaacccccatattgttcaagagtcaactgtatggccaggcgcagtgctcatgcctgtaatcccaacactttgggaggccgaggtgggcagatcacgaggtcaggagatggagaccgtcctgactaacatgatgaaaccccgtctctactaaaaaaa

SEQ ID NO: 521796 - DNA, 916 bp, Homo sapiens
ctgctgtttgttggttcactgtctcttatgaacaacgagccacagtcacagagcttcaagtaatttacaagtactaagtcatcttacgtttccatttttattcaatcgggatgttgcaatcgtttgtcaagctaataaacttataaagtgatgtggtccacaaagactccttgatccaataagctgtgcagttgaagtacaaaaagatacttaattcttcggagactcttacagctaatttttgccatgctcaacaacaatgagtcttgtacagtcgtaatagtattcatagtagtaacactctacatactgcttaagattcttctattatgagagaccttgactgcaaatcaaatggcgtactcctccattttattagccttacctgaatcagtcctttttggttggtaatacatttgttctatagcacccacgttctagacttctcacacaagtacaacaccttctagtttcttaagcactgtttcaacaagaaatccagaagcacatttgtctgcacaaacaagttacaaagttcaagaagtgtttcttgtgcattgagctttgagattcagtgtttaacttctgtgaaaccacatctgagagacttgtcatttctacattcggtgtgtgtgctaatctctttctgattcccattttggttaagagagcacgtaaatagatttctgggtatcttgtgcacttgattacatttggtagtaaccgttctgatagccagttgctcaggatacaagtgaccaggcagaattcttgaatcagttaaagtccttaaagcctaaggctcaatcttgcattcattgttgaattcttaattcctggtggccacgactggctatgcccttggctgcttcgttccgggtttttcaagcgactattggcagtccccctttggcgc

SEQ ID NO: 521797 - DNA, 710 bp, Homo sapiens
agcgggcgttggggttccgggcgccttccgcggcgcgcgcgtggcccgcgcccgccggtcgactcagcagtgtgcgaccgaggtcgcgggccgggttgggagctcgcggcttgctggctttctgtgctagcatggagtagcaggtgcagacgaccgacgaagcgcagaaggagagtgccgccacatgcgtacacgaggcaggggctgctttaggcaaggtgccatgtgcaagtggccgtatacatcggatcgaggcgtcgtgcgtagatgaaaggtctctatggctcggctgcatgaaggaaccatggactgactaggcgttgcattgaatggagggaaatattcacctaccaaatcaagtgtaatggactattgcggaactatataggggcctatgaggaggcatgcgcacttgagggacaggtgcggactaggggtttgaccgttcttctcacgccgaacggaggtaccttgggacaaagattggggctcatgtggttcccgttacacagttgaataggagcacggacggagtcgtcatctcggagatatcgctaaggacttcacaaggaaagcaaatagagaaagaaagtttgcccagtgaccggtggaatactatcgggacgccaaccaggtgatagtttatcaaatgtaggagacgtctccccgggaaaaacagggggttcctgaccaacaaatggttgaggtcc

SEQ ID NO: 521798 - DNA, 196 bp, Homo sapiens
tcgtatgcagaggaagacggggtttcaccatgttggtcaggctggtcttgaactcctgacctcatgatccacctgccttagcctcccaaagtgctgggattacaggcgtgagccatcatgcccagccctatagtagttcttcttttgccccttaatatcctcacccacatgtcctgtactctgcaaggaacccacg

SEQ ID NO: 521799 - DNA, 382 bp, Homo sapiens
catacgtagttcccagtggtccttcagcaccatcagaagatagcacccagacgctcatcacaagcatctgcatgcagctgagacccaacacccgtattgatctcagaagaagcgtcgagtggtgctggactccttcctgctcgtgctgctggagctgggtgagtggccctgagggttggagtcaagaggggccccgtgggaggctctgcactccttttgtacaggctctgtctcccccttgacactgagcctcgcagcatcctgaggaggcagctggctgccatcatcacagctcccattttatcaggtgaggtacacagaggccttgtgagtctgggcacacagtccaggaaatcacacatagctaaaatccctgggctgt

SEQ ID NO: 521800 - DNA, 226 bp, Homo sapiens
gagatcctgcatcagatgtgcatgagcagctgtgttgcctgtcccggaatgctgtgagatggttcacccccatagaacagtgaatgaaaggctccagcatctacctttctctggtgaatggtagaaggacgcccggctgcccatctgtgcacttggctcagggatggaggctcgagagaggcgtgctgtgtgattggcccttgacacactcgggtctacactcgtg

SEQ ID NO: 521801 - DNA, 174 bp, Homo sapiens
agtaattaccttatccaaaaccaatgcgtccacagtatgtcagcgccggggcccccgtgattaatgcggtaattgagcgctggtggtgtgacttcaaacatctgtggctggcacaccaccagcgacctcataacgtatgaccaactcttaagttagtggcagaaggcgttaggt

SEQ ID NO: 521802 - DNA, 139 bp, Homo sapiens
taggagtatctgacgctgttttcttgagcttaatatttttttagagttaactctttaaggaggttatcatggctgtagacaaggccaggtctggctgacgtgccttagaaggtttgaatgaagaaaaacgagtgcttgg

SEQ ID NO: 521803 - DNA, 110 bp, Homo sapiens
ctaggcttttcgattggctcggcgctccccgggctgcagtgcgggggggaggcagaagccacgtgatgctgcggcccgtgcgcacccgcgagctcagcacgtatgttggg

SEQ ID NO: 521804 - DNA, 546 bp, Homo sapiens
  misc_feature (464)..(464): n is a, c, g, or t
ccctttactcccacatataggcccccattctttttgaatataaattacgaggcccccttccacccgccttttaattcatattcttcaaaattctaatgttggtctcaaaaaaatattttgagaaccaccatctctttttaaaaacaagcatgtttaaccccagtcgtgcgactcttcgaacccctttaatagccccgccccccgtgcgaggaacattcgctcaattttaagtcccgctgttgatccccatatttttcatccccagccactcctaaatgtggaaaagatttattatggggagtggtctggagcggcacccaccttgtgtgcgaaagaataacacaaatttaacaagagggaaaactcgtgtaaaccaccaataatctggagatggcgcaagagaagaaaataaaggagaaaatatgcgggaaactataaaagacataacacaccacacacccctntatgcaagagaaaacaagagagacaacatttctagccccgaaacatataggagaggccccgaacaatagatacaagaaaaac

SEQ ID NO: 521805 - DNA, 198 bp, Homo sapiens
ggtactggtacaacatctgagtggactcttcaacagggatggaaagctttggaaaacaaagcagaagatggaagtttgggaatcagctgcctagaagcaagaggcagtggcatcatgggagaggaacagagagaggcagtgtgaaaaataaactttaaatagggaagtatacagtgtagcttttatttgctacttcgt

SEQ ID NO: 521806 - DNA, 360 bp, Homo sapiens
  misc_feature (343)..(343): n is a, c, g, or t
cacgaggggacaaggcacattccggcaagagccgggctttcatacgaaggagagcaccacaatggccggtccacagcgcaagtctgtgaacaagaagaaggtcgtccccatcaagaccgtgcatattggcgcggtcgactacaaggacaccgccctgctgcgcaagttcatctctgagcgaggcaagattcgcgcacgtcgcgtcaccgggctgtctgtccaggatcagcgcaaggtcgctattgcgattaagaacgcacgcgaactcgcactgctcccgtacgcctcgacggctcgctgagaagggggaagacatgaagctcattctcactgctccggtggncaagctcggtgtccccg

SEQ ID NO: 521807 - DNA, 187 bp, Homo sapiens
aattcgcgaccgcgtcgacgaagggctgatcgaactgtcccgggaacaggttgaccaaagacgctttgaagaacggcccggcaccgagcacttcaccgaacgacatcgcgtaccggcgcagcaggtacagcgtgcgctgcagctcctttttacggttgtcgaggatgcccagtacgccattgcgctt

SEQ ID NO: 521808 - DNA, 462 bp, Homo sapiens
acccaatcgtcgtcttaagctgggagtcaatacgtctgtcaagtgtcgcagtcacacagtgtacagaagctcaaaaccatttcaatttacggtctgcagagcattggacacatcgcgctcattttctggacctgtttagtgctttctttactcagaaacacaagataacacatgcctcatgctagggagggtcaatatttcttgcagccaaaattccaagataatgtcaagccagtgcaggatatttgtctcctaaagtctccacacattcccagacccgtgtggtcctttcttccaggtctcacccacgctttctgcgtacgccaagatgtgtatgtatctgtgcatgtggtccgggttgaccagagccttgcgtttaaagagtgatcgcatgcacaggtccagaaagtctggatcgcggataagctcaagcggaggagggtccacgcgtgagcacatcct

SEQ ID NO: 521809 - DNA, 136 bp, Homo sapiens
tctccctctgtccagcccctccctccctgcggatgcagcgtcgacagagctctctggggatgatggagacgggcagcacaggggtgcttgcctaaaccatgacgccgcgacaaaactgtaaagctgataaacctgt

SEQ ID NO: 521810 - DNA, 376 bp, Homo sapiens
atccttccttctttcacgactgcacccagtctgtattgtcctttgaggaatatatgttccggtccttcgcccatttttaaataaggttataggttttcttgttttgagttgttggcatttcttatctattttggatataactccttatcatatggatgggtggaaaatatattctcctgtgttataggtggacccttcactctgttaattgtttcccttgctgtgtgcaagcttttaaatctgggataatgattgatttctaaatgttaactttgcactcccgggggtgaatacatttggtcaagaggtattcttttaaagagtgattggatttaatttgctagcattttgtttagcacttttttccccatatgtt

SEQ ID NO: 521811 - DNA, 765 bp, Homo sapiens
  misc_feature (2)..(2): n is a, c, g, or t
  misc_feature (37)..(37): n is a, c, g, or t
  misc_feature (182)..(182): n is a, c, g, or t
  misc_feature (223)..(223): n is a, c, g, or t
  misc_feature (257)..(257): n is a, c, g, or t
  misc_feature (311)..(311): n is a, c, g, or t
cnatgttgggatactgagtcatcatggaccttcctanattcccgagcacaacatcacagtccctttcctgctggtaggcaaaactaccgaacctctcatctctctgaacaagtcacacctacaacttcgagctctctcctacatatggcagagaaagccacgggagactgtgcagtatcatntaacaaggtaggagcaggcggttcgagtttttcctttccanggacaactcccgcgtatatctgaaggtttcagcnaacagccgtgcttgtatgtccgcatggaaggcgtggatcccacacactgtccanggttcccaagttgatatttgtcttcacaccagaagcgaggaaggagatgtgaactttaatcttgatcctgcacatgtggaaagagaaagtccacccctgtgacattacaatgtcaaggcgcgagggctacactatgaatgtggagatcaagtgcaaggacaggacaggctccatcactctgttgactcccaaccagactaacatcatcaacttctatgaggtggagttaaatgaatgtgtccagtgtgaattcgactttatcaacactggaaagttcaccttcagcttccaggcacaggtgtgtggctccaaaaacttggtggaggtggaagtgatagagggagcctgcagtgccggaatttggagtatttcccatcagcggggatccaaatgtgtgatgagagaatggagtgtgtgcaggcggttctggtgatggatttgtgattactgtcga

SEQ ID NO: 521812 - DNA, 117 bp, Homo sapiens
gccgtgactcacgcctgtaatcccagcacttagggacggcaggtcaggaggatcacttgaggctagttcacgatcagtctaggcatcatagtgacgacctctatatgaaaaaaaaaa

SEQ ID NO: 521813 - DNA, 836 bp, Homo sapiens
ggtcatagttgccctgcctgagcaatgggagccctgcgcctgatctgccgaggtcgggagtgaggtgttagtgctctggtgcacacccaattccgcgctgctcccgctccttccgtggaccccgtggatgatggcttgcctcctaccgggatgagctagccagcctgggcaatatcagaggccgagcctcagggcgcgcgctaggtgatccgaggctggtcggccctaaccgggtattgatattcttgatgactctggcctgagttccagtgatggtttattatatcttgtggaccagacttgaacgaaagttgacctcatgatgcacttcagcctctccagctgtccatgctcactccgagaggctgtggcgactgtcctggggcagcactgctgtccagctcttcatcctaacatgtggtgacgtttggcctgctggtccccctggactgtcaccgacttctacactcttacttctatctgctccattggcatctgaaccaaatgagccaacgagttcctgcagtaaagcttgagagagggtgagtgctgccctccactatttgagggagcttccctctgccgatggcctcagtgcccattgtctagtgatgtgccagcctcccgtgcccgtggtcttggtgatcaccatcatccactgtggacaggcagcctggcttccacttacggtcctgcaggttgtgtccagttccagcggcttcttctcggaatgtgggccccagtgcgaggggcacaactcttctgtgcacgtggaggtgtatgttgagcaattgatgcaaggtgcctcccaggtttcctgtggcatggcaggcagg

SEQ ID NO: 521814 - DNA, 166 bp, Homo sapiens
cacatttgcaggacatacttcatttgtatataatatattatttgtaaattaaataaggaggctagtatattaattgaatgttgtatagatctcgcactagaaatagaagtacttctagagtatctgcatataatacaataaaatagtttacctatgacaattagtt

SEQ ID NO: 521815 - DNA, 421 bp, Homo sapiens
cgggccagtacggatgtgggaggttcagtaaaaagaaacccacatagtcacacagcctttgtggagctcacatttgaatgttgcatcaagtcgagttcacctgatgcattgttctttactccaaggtgcttccagctccatcaggaggattgggtgggtgtcctgggtccagaagaatggagactaccaacctctttgctcctattacaaccctcccttgcctgcaccacccactgcccttacttttgcatttgttattcacatcatagaatttaaagcaagtcacacggtttctcacattacctacattttactcagacgttctagttctcatacacattctcttacaaccttttccagggctaactccatggaatgatttttggtcttttagtatagtctagttttgtttttgagagag

SEQ ID NO: 521816 - DNA, 1210 bp, Homo sapiens
tggggtaaacccgaggttttttttttggggggacaaaaaaagggggggcccccaaaggccccccccttttataagggggtcacacatgaagaaaggttagtaagaagtatagaaaatacggagggtgggggggacaaataatagttatgaaagaacacccccccaacagagaaggtgactaccctacttccacttagtgtccctactttgatagggagatagtgtgaccacagggcagtttaacacacttgtgagagagcacatgtgtacgcaatatgatgcaaaaacacacggcaggtggtgagcaacacaaaaatacagcgagaggaaccaccacgcggaaaaacaaacagtttaaaaaaaaggggtagttcatgagagaaggaaaaaagacagaggacccccaaaactaaaaaaggggtggaagaacaagggtaggttcaaagatgaagaaacaacacaagaagagaaaaaacaacgcggggtgacaacaaagaggacaacacacagaaaatacccactaaagagaggaggaacacccacaaaaaaacaggtgaataaaaaaacaaaagtataaaagaaaacaaaaaacaaaaaatattgaggaagaataatacaaacaaaagaaagaagacaaaaacacacaacaccaagaaaaaacgacaaagaaagagagaaaaaacaaaaagaagaggcacaaaaaaaaaaaaaaagaacactcccagaaaaatcagacaacacagaaaaaaaaacaaatgaaccaacaaaaaaaagtagagaagaagacaccaaataaaacagcaggagaaagaaaaagaaccaaggaaaaacaacaccaccgagagaaaaaaaagagaacaaagagaaatgaccacaaaggagaaacaaacacaaaaaaacacaatatggagcgagaaaagaagaagcaaagaaaaaacaaatgaaaacaaagaaaactactacaagcaagacaaacaacaaagaaggtgtatagcaaatagacacaacacagaggaaaacaggagaagacacaaaaagatataaggatcaagaaagacggagcaatgaagataacaaataagaagaggagaggagaaaaaaatacaaatgaaggaaacaacaccaacgaaaaagaaaagagtaggagcagaaacaacaaatgggagggaaaaagaaaataaacaagcagacataatgggagcccacacaa

SEQ ID NO: 521817 - DNA, 774 bp, Homo sapiens
gaatttatttaaacttatttgagataattatagattcactggcagttgtaagaaataatatagagatcctgcatatcccctacccagttttcctaatagtaacgtctttcaaaacaatagtgcaatatcacgaccaggatattaacattggtacagtcaaaatacggggcattaccatcaccacaaggatatctcatattgcccttataaagccaccccacttccctcctacctcacccctcctgaactcctggtaaccacaaattatccatttgtataagttggtaattttgagaatcttacataaatggaataatacagtatgtaacttttgggattgactttttttcacttagcataattctctgaagattcacctaggttgttacatgtgtcaatagtttgttcctttttaaattttaacttttattttttcgagagtaagtcttgcactccaggctggagtgcaatggcacgatctcggctcactgcaacctccgcctcccaggttcaagctagttctcctgtctcagcctccagagtagctgggattgtaggtgcacaccaacacacccagctaaattttgtattttggttagagatggggtttcaccatttggccaggctggtctcgaactcctgaccttgtgatccacctgacttggactcccaaagtgcccagattacggtgtgaagccaccagttctggttgtggtcctttaaatgctgagtaatattcatggaataggtagatcacttaattaatctcgtgaa

SEQ ID NO: 521818 - DNA, 127 bp, Homo sapiens
gcccaggccagaccccaccccccaccccactgtcgtggtggccccagatctctgtaattttatgtagagtctgagctgaagccccgtatatttaatttatcttgttaaacatgaaagtgcctcccta

SEQ ID NO: 521819 - DNA, 440 bp, Homo sapiens
atcgatggctgggtgtaatgcacgatatcatcagatcaagtcaggatatgacccccaccgaagaatgagaggaagtggcgttatgatgtatctagctgtcgttcatccttccctgagacaatgaacaagtggaccacctttccaccagtataagcaagtacacttttagtaagttagatgatctgttgaagtacttatggagctgcacacacttcaaccttggcagataatatcaaaagtaacgaagacagatatgattatacttctcaacgcagaagcgcattttgagagaagttgggtactggctgtggcatcatttagctgaagtcctctttcctacaaccttgattagatcatatacgttccagaagggcatgccaccatgaattcttcttaatactgatgtagcccctttcatcagtgactttactgcttaacag

SEQ ID NO: 521820 - DNA, 350 bp, Homo sapiens
agcagttaactaaagatcaggcatattcaaaatagtgattaaaggactcaggaggcaattgcagtgcctcacgcccgtaatcccagcactgtgggaggcgaggcaggtggatcacctgaggtcaggagttcaagaccagtctggccaacatggggaaaccccatctctactaaatatacacacacaaaaaaattagctgggtgtggtggcgtgtgcctgtggtcccagctactcaggaagctgaggcagtagaatcacttgaatccaggaggtggaggttgcagggagccaagattgcaccactgcactccagcctgggtgacagagtgagactccatctaaaaaaaaaa

SEQ ID NO: 521821 - DNA, 471 bp, Homo sapiens
  misc_feature (70)..(70): n is a, c, g, or t
ggtaagctcccaaggcttcccccccccccccgagattagcatcccatactagaatcaatctcacttccanctaagctcatactcaattgatggttattaggcaattccatttctttctggttattataaacagaaaatctttcctcttctcattaccagtaaaggctcttgggatctttctgttggaaagatttctatgaacctgtcttattttaaaggtggggtttttttctggtaaaatttagacctaaatcgcatcatgccaacttgtgactttgagactattcatcaagaatgaggatatagtagccatgacatagcttgagctataacctttaattccttactttggctatgggtggagggtgagttttaaaaggttttgatttttttgtaacctgggaaaaccatgaccttgggcccgattttttcagattgctttgggtaataaaaattgggggtgggatttga

SEQ ID NO: 521822 - DNA, 444 bp, Homo sapiens
ctggaaaccacccaaatgtccatcaactggtgattgtataaaccaactgtggtacatccatacaatggaatactactcagcaatgaaaaggaacacactgatacatgcaacagcatgggtgagtctcaagagcattggactaaatgaaagaaactagaaaaaaaagagtatctactgtatgattccagaaagttctaggaaaggcaaaaccataatgaaagagaacagatcagtggtttccaggggttggggggtgggtggcaggaattgagtgcaaagatgcacaaaggacattttgggggtgatggaaatattctatacatgattgtggtggtggtgaacaggtgtacacatttgtcaaactcataaaatttaaaatgtacacttaaaacagaggcattctatttatgtaaatgacacttcaataaagctgtttagtatgtg

SEQ ID NO: 521823 - DNA, 1787 bp, Homo sapiens
gaattcaacattagaggagtaatttatcatggcagaagattttttaaacaaagttagtagaaaggcatctgaacaacttaaaaatctaaaaagtccataccaattcgaacagaaaaaactaaaaccgttcaacttcgcatgagcacatataagaagttaaacgcatcgcttttgagaatgacgaaaaattgttgatgtcttagaaaaaattattctgtgaggccttgccaacgtaaaataagattgagcttaacttatgtattactgattgtgtgatttatgataaaagattaatcttttatcataaatcacacaacttcgctgtacaaggtatatttaaaataaatttgatttaaacatacgtggtagatcgcaaatttaggggtctagaattttttggtgtggaaatatttcatccaaaagtactaggccctttttggtaaggtagattgtaaaattaatccgaacgctgttcggacaaaaaagatcagcttcccttaaaatcggtgtttaccacaaacccatcttttaggagctgatcttttgtctagtataacctattccgaacgaattaaaatcgaacctttgtgaactaggctgtccaatatccaaatgggggtgcggctgagccgatcacctggattatcgattactgcgctagctttcgttggcttgctgttagttggtgttcaatggctgccaattatcgtaaccggttgcctattcttattcggaatcggtggtggctattttcagccagctaatatttccactatcatcgaatcgggttccaccagcaatcaaggcacaatcggttcactgcaacgaatgattcaaaatattgccattgcaaatggtatggttataggatcaactttgattaatttaactgcgcctaatcttcccccggggattcaagtaacttggtatttggctttgttcgtagtagccatcattgtcattgccggaatctcaattaactatttacacccagaaaaggcctgagtaaacttactaacttaattagacttattaagtaaagaaaatagggaccctttcagttaacaagtgctaaccaaaaagggggcctattttcttttaataccgtatttcacacggtatcgaataaaggtcgtccgtttaatacctgtatttcgggacacatcaatgtcactcatgccagctcgataaagcttaaaagcatgttgcaagcggggatcatcttgggtgtattggggtttgcgtcccatgatatttaccctgctgcttagctaaggcaatcccttgctgctggcgcacaatgattcgtttacgttcactttcggcctgatacttatagagttcaataatcaagttggtcatcagttgacgtaaatttgggtacgcaatcccggtactggacggcaaatttaacacatctagggtaggacccccttattttgaattaggctgttactgatcttagttaaatcctggttatttctgcctaagcgatctaattcagtgaccattacaatatcaccctcacgaatataggccagcattttttccagttctggccgattagtgttagccccacttaatttatccgtaaataatttatcaacgtcttttaaagccgctaactgtcgctctaaatgttgctccttgggactcacacgcgcataaccgattttcagccatttccaattctccttttggacagttctaatgaacacttataattcctagtatagcacagaaataaaaaggccattagggataccctattggcgtttcgaaccatt

SEQ ID NO: 521824 - DNA, 132 bp, Homo sapiens
  misc_feature (116)..(116): n is a, c, g, or t
ctgcttacctgcagctctctctgatgagccaagcactggggtcatggccccagagataaacaggatgtaatccttggccccatgtgaattcctgagagataggaagtgagatagancgcatacacatgtaga

SEQ ID NO: 521825 - DNA, 174 bp, Homo sapiens
tcctgggattacaggcctgagccactgcgcccagccaactctttgctttacatagaagctacaaacgctgttaaacctttctgtcgcttctgacaggttgcgcatggagggcctagagactgcagaagggtccaactctgagagttcagatgatgccagtgacccaggagacaa

SEQ ID NO: 521826 - DNA, 118 bp, Homo sapiens
aaattttctaattctgttcttaaggaaccgcgcgaatatttgtgcttgttagatggggaaccctacaaaaatttaaaacaagggtccactcgttgctactaaaaggggtatttattcc

SEQ ID NO: 521827 - DNA, 124 bp, Homo sapiens
tggcgctaggatgccagcacactacacagacacactgcaaaaatctacatagattgccattcagatgtgttactacatagtgtcccaagataacatttgaatctgtccccttctcacgtcctgt

SEQ ID NO: 521828 - DNA, 296 bp, Homo sapiens
actgatacagatgaacggtccatggctggcttcatacagtgacataagtcaggaacctaaaatacaagcaaatgatcaaatcacaaaattaactctaaactataacacgtgtgagtcaagtttcgatgccaggcaatataggagatagagaataaatacgtaagagattatgataatatatttaacataaaacctttcacttgatttaaggctgtttttgttttgtatttgtttctattccttgggcagctgtatcctccggtaattgtatcttattcttgggcagctgtattctc

SEQ ID NO: 521829 - DNA, 229 bp, Homo sapiens
  misc_feature (82)..(83): n is a, c, g, or t
  misc_feature (111)..(111): n is a, c, g, or t
  misc_feature (120)..(120): n is a, c, g, or t
  misc_feature (192)..(192): n is a, c, g, or t
ccaccctaaacaaattcaccaaaaccacctttaataccatttctaaaacctacaactacctaacccccaacctctggaaaannactgtattcaccaagtctccctatcaanagttcactnaccacccagacaaaacccacaccaaagtctccgtgcaacggactcaggctccaactgtgacaacaacataangtttttaaacaaaaaaaataaaatcaattaagcgtga

SEQ ID NO: 521830 - DNA, 397 bp, Homo sapiens
ttttttttttaacttttagggtgagaggtacatgtgcaggttagttatgtaggtaaattgcatgtcacaggggtctggtgtacagtttattgcatctccccagtaataagcatagtacctgatgggtagttttttgatcctttccctcttcccacctttcaccctcaagtaggtcctagtgtctgttgttcccttctttgtgtccacgtgttctcattgtgtagctcccacttataagtgagaccatgggtaggtggttttctgttcctgcattagtttgcttaggataatggcctccagctccatctatgttgctgcaaaggacatgatctcatgaagttttttgagaagtttttcagtatggttttcacgtttgttgtcaacaaaacaagcatgc

SEQ ID NO: 521831 - DNA, 527 bp, Homo sapiens
gtgcgcagtctcgaggtgcagcgcagcgcgacttcggtccgagctagaacgcacgacgactgagaggagcatggacggcgcgcctagggcgagccctgcgacgaggtgcattgtttctgcgtaggtgagccacctcggtgactggaacgccttgccgagcgcactgcacagcgcctgcggcacctatacccgtcaagctcacgcgacgagccgcataccctggaggcctacagcctcgtggcgtgattgggcgacttctctcccccgtccccgtgaacgtaagcgctctgagaggtaacggagggggggtgtccaggcgcgcccacgagtgctagtgcacttcttttgggattgttgaccccaccgggtctttacacgagttgggaatctgtgatggcatcgggaccagtcctgggcgcccatgagaccactcgctgctctcaccatctgcagacgccccacccgctcggtcctggacacactgctacccctctcttgcctccacccctctgcgactctgcagctcc

SEQ ID NO: 521832 - DNA, 363 bp, Homo sapiens
  misc_feature (130)..(130): n is a, c, g, or t
  misc_feature (224)..(224): n is a, c, g, or t
  misc_feature (347)..(347): n is a, c, g, or t
cattggtccgagagaaattagatgcatcaccagtatattacaacagagccattaatcttgtagcttcatcaacattaactggtttgctttcatgacgctgctgaggaatcagttctttctgcagaggttnaagtgaaatgctttgtgcgaaatgtgcaagttcctatggtacattaacaaaagctatcatgtactctgtaaactttttcctcattcataatgtntatcttcttaagacttagtggtaactggttttgctttgtttttagccttaaagttttttatggctggctatgtgaaatacattcctggacttcggccctcctaatttctctcggaccaatggnggatcctgctagagat

SEQ ID NO: 521833 - DNA, 245 bp, Homo sapiens
  misc_feature (229)..(229): n is a, c, g, or t
cattggtccgagagaaattagatgcatcaccagtatattacaacagagccattaatcttgtagcttcatcaacattaactggtttgctttcatgacgctgctgaggaatcttcttaagacttagtggtaactggttttgctttgtttttagccttaaagttttttatggctggctatgtgaaatacattcctggacttcggccctcctaatttctctcggaccaatggnggatcctgctagagat

SEQ ID NO: 521834 - DNA, 235 bp, Homo sapiens
  misc_feature (219)..(219): n is a, c, g, or t
attgatcgagagaattagtcgtcaatttttatacacttatggtgagaacatttgcacttctatcatagggcctctgtgttccttgtccttctattccactttcttaagacttagtggtaactggttttgctttgtttttagccttaaagttttttatggctggctatgtgaaatacattcctggacttcggccctcctaatttctctcggaccaatggnggatcctgctagagat

SEQ ID NO: 521835 - DNA, 783 bp, Homo sapiens
gagagcgcggtgatcgtgatctcaatggcctcctctcttcactcgtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttgggtttctgcccttgcagcctcagttttcacatttcagcccttaatgttcactaaaaagggtcggagttcctggcggcaaataggggtggtaaactggcgcccaactctggtctggctaagttcctacaaatttttgggcgtctctggccattggaagggattaaagaaccaaaaacaattccaagaattggaccgggttttttaagggccaatcccatcccttcgggataaccagatgtcaactcattgagatccgagatgcggtccatcaagtcccaaaaagaggcgctaaaaatcggtattctcaccttcgctttgatgagctgcttaaatcccaagtctatttctcccttatgagttcctatggggaatggagggggataccgcgaaaaacaccataatttccctcggaatctgcgggagggcgagatttcaattcaaagggggcccttaagagacaatggtttttataccttaataaacaactcactataccactcacataaactc

SEQ ID NO: 521836 - DNA, 906 bp, Homo sapiens
  misc_feature (38)..(38): n is a, c, g, or t
  misc_feature (130)..(130): n is a, c, g, or t
  misc_feature (140)..(140): n is a, c, g, or t
  misc_feature (183)..(183): n is a, c, g, or t
  misc_feature (192)..(193): n is a, c, g, or t
  misc_feature (195)..(195): n is a, c, g, or t
  misc_feature (200)..(200): n is a, c, g, or t
  misc_feature (204)..(206): n is a, c, g, or t
  misc_feature (221)..(221): n is a, c, g, or t
  misc_feature (229)..(229): n is a, c, g, or t
  misc_feature (232)..(232): n is a, c, g, or t
  misc_feature (236)..(236): n is a, c, g, or t
  misc_feature (240)..(240): n is a, c, g, or t
  misc_feature (256)..(256): n is a, c, g, or t
  misc_feature (261)..(261): n is a, c, g, or t
  misc_feature (268)..(268): n is a, c, g, or t
  misc_feature (274)..(274): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (302)..(302): n is a, c, g, or t
  misc_feature (304)..(305): n is a, c, g, or t
  misc_feature (309)..(309): n is a, c, g, or t
  misc_feature (320)..(320): n is a, c, g, or t
  misc_feature (322)..(322): n is a, c, g, or t
  misc_feature (329)..(329): n is a, c, g, or t
  misc_feature (332)..(334): n is a, c, g, or t
  misc_feature (373)..(373): n is a, c, g, or t
  misc_feature (430)..(430): n is a, c, g, or t
  misc_feature (448)..(448): n is a, c, g, or t
  misc_feature (881)..(881): n is a, c, g, or t
tatgtaaacaagttactgaatatttttcacctcgtggngttgtacacaaccttttatatatacacaccctaccttctctcaaatgctgggcttacaggtttattagctagggccttttgaggtatgctgncaggcgacancctgaatgagggtgctcgccggcaaggcccgcccgtcccgtcngccgccgannanaagcnaggnnngttccctcttctggntgtgaccngcntgcnacanccccgttcctttatgnccgtncactgtncttggngggtncttgtgactngnttcctcaggtngnntttnatgggcttggngngggtganttnnncccgggccctcctaagaggggtccttgggagggtgaggngtcgcagatccccggtgtcccctgggccccaatggcacctggaagcccaggatctcngggaggcccaggctcgcngggagcaccgtcctggccgtccttgctggtgccgggcacgccttggggtccttggggcccctggtctccttcaggcccgtccagccctgctcctgccgcgcctttgtctcctctgtcaccctggtttcctctgggcccggggtctcccagctccccagtgggaccgcggtatccagggggtcctcgagcgccagggtgaccaatggagcctgggggtcctgggggccaggggggcagctggaccgggccgaacaatggacccgggtgccaaaggcttccttaggtgcgcggctaactgtgcaatttgttcgctgatcatcccccacacagctccctgatgcgctgctcgctggcctccttccccggaactcccggcttccccgtgatgccaggaacacccgggacgccctgcaggcccagaggaccggggggnccggggacacctgaacaccgctggt

SEQ ID NO: 521837 - DNA, 481 bp, Homo sapiens
caatagaggtcacagcagtgcagcctggctgtatatagcgcaaggggtgcggtacagggacatcacctgcctggtgataaccctggttccatactgcgttgtattcacattagccatacatgtgtctgattatctcattccacttcttattatgaacttcataaggtattaataacttaataaggtatcttattacctctacatttccacacctggcaggatgtctaacatagacctacgatgcttggtaaactgtttcttctgtgacatacgtgcatgagaccacgtacttggcatcaggtagacaggatacatgtcttcctctgccatttactagctgtgcgacctcagacaagttagttcatctctctgggccctgtatgtactgaacaacttaacggagcatcttcgttggccagacactgttctgagccccagtgttgcagtactgaacacagtcctcttgatctccattctcacg

SEQ ID NO: 521838 - DNA, 162 bp, Homo sapiens
ttcacattaccgttcaggagacaacctctacttgtcctgctgcgcggaatctaaactcaccggcagagtattttaaggaccattatatgtgaagtttcagcaactcaggacaaaatctgtttatcccccaaattactacaaagcatagtattacatagtgtg

SEQ ID NO: 521839 - DNA, 93 bp, Homo sapiens
aaaaatgtatgatatatagggcgctgcgtgtcaaggcgaacgaacgagcgcagcgaggtctgtgagcgaggaagcggcgcataacttcgtata

SEQ ID NO: 521840 - DNA, 824 bp, Homo sapiens
tcctattacagatctggaagacaggccaatactgaaaatcggagaagaacacttgaagacactcgatgagaacaaataatggaacaacaaacaaactccataatacatgacaatagacgaatatagaacattagagagaaacacagacaaagatgaaaagagaatcaagccaacagacaacaacacgagctcgaccagaacaaggaagcccacccagaacaaacacacaggacacaaggcataaaagagcagcgcacactagagcgcgacaacgaaacaaaaaaagaaaaacacacaaaacgaacaacaaccataaaagaagcaaaaagcaacagaacaaaaaaaagaaaaaccgaagaacaacacaaccatacaaacaacacaggcgaaaaacacacaacaaaaaaagagaaaacaacgggagcaccaaaaatcagacagcaaaccaaacagacacaaaagacgaaacagaaaaaaaatacacagagacgcagagcaaaacaacaagcaacaaccacacaacagacgcacacgaagaggaggcctaagcacagtgacaaagaagcgaacgccacacacgcaacagaaaacaatacagagagagtagcgagaggtcgagcaaacgaacgacgacagaagagagagcacaatggcgcgaacgccagcgaacgcagagcgaagaaaagagaaacgaccacaacaacaacgaaaggaaaaaacaaaaacaaaggcaaaccgaaaacgcaagttaaagagtacgaagcaaaaagagtaaaagcagaaccaacaacaacaaaaaaaaagcaaacgtacaaaaagagagc

SEQ ID NO: 521841 - DNA, 133 bp, Homo sapiens
cccgcggaggaggagacccattctataccaacactattctgatttttcgggtcaccctagacgtttatattcttcatcctaccaggcttcggactacatctcccatattgtaacttactactccggcaaaaaa

SEQ ID NO: 521842 - DNA, 168 bp, Homo sapiens
  misc_feature (24)..(24): n is a, c, g, or t
cgaagaccaatgacattgatgtantcatgaagacggactttaaggccagctgtccgctgcagaagctgctggacggagggccgcggtcagaacgcgtgctctgagatctacattcacgggtttgtgccctggccaatcaaccgcgtcactcaaaaattgggccttgag

SEQ ID NO: 521843 - DNA, 197 bp, Homo sapiens
atcagagctaaacacagatcagcaagtagccctggagctgaggactagcttatgatttttggtagaatttagtgatgccacagctatctgatcaatcttgcgcgtgctccgtcatctcatatttctctttttctgtgtcgaagatctcaccttcctggtgtctgggcttccggagcttcttcttcttgaagaacact

SEQ ID NO: 521844 - DNA, 781 bp, Homo sapiens
cgaggaagagttagagtgagaatgtggttgctcaaagggaaaccccgtgtaaaaagggggcgaactcagcacgagtggtaagtacaacgaaatataactttgaggaagtgccagagtagggcacaagggtgaagtatggaaaacattatatggcactatagaaaggaggcccggtaaacctacagcgtccctaatttagaaggcatcctggggaccgcaacatcccaaagaagttggaataacagggtgcgttgaaccactccaagcatagttttaatattttaaataaaaaaggagttctgcccatgttgccaagacgcgtctgaagctcctaaccccaggtgttaaccctgcctagcgctcccaaagttctggtatgacaggcgtgaaccactgtgcccaaccactcggaagtgttccttcatgcagtaaaatgttcctttagccgcaaaaagataaacaagcgtttcatgaaatactattgaaaagctcccaggcccgggtgtggtggctcaggcttgtaatcacagcactttgggaggccaaggcaggcagatcacttgaacccaggagctggagaccagctgaccagcctggggaacatggtgaaactccttctcaaaaaattaaccgggcatggtgtcatatacctgtaatcctagctactcgggaggctgaggctggaggattgcttaagcccgggaggtcaaggttgcatgtgagccgtgattatgccactgcactaaaacctgggtgacagtgagatcttattggccgaata

SEQ ID NO: 521845 - DNA, 335 bp, Homo sapiens
  misc_feature (114)..(114): n is a, c, g, or t
  misc_feature (119)..(119): n is a, c, g, or t
  misc_feature (122)..(122): n is a, c, g, or t
  misc_feature (127)..(127): n is a, c, g, or t
  misc_feature (133)..(133): n is a, c, g, or t
  misc_feature (135)..(135): n is a, c, g, or t
  misc_feature (195)..(195): n is a, c, g, or t
gttttagctcagtgttttctaaaaaaagaaactcccccccagcaaaaaattgtttactttgttgggcaaaccaaatcagttctcaaaaaatggccggtgcttataaaaagtatnaatancgngagcntaaacnanccccctgcccaagagggaagtgagcttgtgcttagtatttacattggaagccagttttgnaatccctgacttatgtgcaaactggggcagaaattctataaactctttgctgtttttgatacccgctttttgtttcattttgttttgttttgtaaaaatgataaaacttcagaaaataaaatgtcagtgttgaataaaaa

SEQ ID NO: 521846 - DNA, 133 bp, Homo sapiens
catatcggcacggtctctgagttccctcagtatttatggatcattatttttactctcttggtgaggggagtgtggcaggcaacagggtgatggtggggagggtgccgatgaatagcaaggtgccgatgaatag

SEQ ID NO: 521847 - DNA, 494 bp, Homo sapiens
gagtgaaggctgttagatcgccgacgttagaacctcgtggaagagagacggatagaggacaggcaagaggaagtcaggcgatggactcttcctgcaggaaaacacaactcaaaaaccatgttttcctctgctctcacaccaacaccacaatccacacagaagacttcgtgtggccgaaagtgcgaggggtttctccccaccaacaaacagcaagcaacctaactggcggtcctccagtatcagttccaacactgtctgcatgaagatagtgtcagatctcacagattgatggctcagttcccagttgcatgtccaggcctctgaaacttctgaccgaccaacttcaagttgaggttcccatgaacccttctttgggttggatttatttgctggagcaactcttagaggtcagagaaacactcagttttactggttgattataaatactattacagaagataccagtgaagagatgcatgaggtgaggtatggcg

SEQ ID NO: 521848 - DNA, 104 bp, Homo sapiens
acatgctgtgatttgggagcctggttaatttttaaatttgtgtgtgtggagacagggtctcaccatgttgcccaggatggtgtcaaactcctggcctcaagcag

SEQ ID NO: 521849 - DNA, 82 bp, Homo sapiens
acccaatttttgcccttaaaaactgggcttatactggactattccttggggaatccatccaaattaaaattttttccttcca

SEQ ID NO: 521850 - DNA, 874 bp, Homo sapiens
tcggccctggcggctccccgaccgtgcccggttgtggcgaggcggctccagcccagtctgtggcagccgcgacccccggggctgctccggagcccactgcgcggcgcgcgtgccggctgcctgtatggactgcggcactgaagcggagccgctcggtaggagccagccgaatatcctgccgcctacccgggacgaggaggaggaggaggacgaggggatggagcaggggctggcaggaggaagaatgaggtggatccccggatccagggagcaactggacgaagttatacatcagctccactggattgatatctaagcagtagcggcgagactgagagcttgagagagtgctcggtcagcataggttccttgctctggttctgggttgtacagcaaccggatgaacacctggcctgaacatgggtgaacgaagaattggcgaaagcctgctggaccgactcgcaagcctctactgcggagggcacggacgggctggcgcaggcatcggctcaggcttggaagctcatcgaacagccactgcaggtatttccagaaggtgccacagaaggtgcgtccgccgccggcctaagggagacccgattctccccctggtccgatgcagctgggcttgctgtgcatggatgaaccaagcggtccagttctgaaatccggcctggccaggacgatgcttgaagtcacggccactcagaaggggtcactgcgacggcggacgcagacccaaagacccagggagccgagcctggttgcattaagggagacgcgcagcccagggtaccaatggccgaccatgggcccggcactgcggacaggctggaccaacgaaccactcatgagagcccatccaagaagtacc

SEQ ID NO: 521851 - DNA, 195 bp, Homo sapiens
ctttttttggggggaaaaggggccctttttcccaaggggtttttttcaaaaattaaaaattgcctttctggtgggccctttggggcccctctttttttttttgggggccccggcccccccctttaaagtttggggtttttttttggggttgggggggcccccattgcctttttttttttttttgggttttaaaca

SEQ ID NO: 521852 - DNA, 108 bp, Homo sapiens
ctaattaggtttttggttttgaaagttttgtttttttgcttacaaacaaccaaaagttgctccttttggggggctaacaaaacaatgaataaaatgtcagtagaacca

SEQ ID NO: 521853 - DNA, 1525 bp, Homo sapiens
  misc_feature (886)..(886): n is a, c, g, or t
gcttaggcgcagatggggaacgcggagctaacatggcagtggactcggagctgggatttgtcgcaaaatttatgtgaaccctgcggagtaccctttcgcatcaaattctcgtctcgcagcataagagctgcacacgctgagtctggcggagtatgggctccggtacatcatagaccgtgcaggcgtctggacgtggtcaaactctagcacctggcgcagatgactccgtcaaggcacgctccgggaagctgctgtagcgcgttcgcagtgaggacacggagcccaccgggggttcatggtctgcggagagtgctagaggaccgcatgtgtgcagggccggtcctcgggtaccggcagtacgggggggtagcctgtgacctgaaggggccagaggactgaaacgctcgtgaattcaacatttccctcgtgggcacctaggaaagtaataaggacgcgcattgtgctgtaacgcagaaggaacgacgcgtaggcgacgagcgcacgaagggctactatactacacggcgtggagcgcatcttgggggccacggaggatccacaagtgcgcaaacccgaacagacgtctgacggagtgacctcgaggtatgcccgcgaccaaggaccgtagtcaacttaaaattccagaggtgcgttacgcggaaaacaccgtgcaaagggggatgatgtccgtgaaaactactttctccccagggattacacattatccgaaggagatgggatcacccaggacccggttggcgcgccagatctatcacctccgaatgtcaagcacgtggccagacgaagtattacgtggaaagcgctaactaacgtttgccatcccgtgtgactggctcgtgcactatgcgcgccttttaacacatgnggcaagagctgtttttgaggaccactggagtcccaccaggtggttggctatccagcaccgggattcggacagaagagaacgttggagaagacgcaaaattttggcccccacatgagaataaggttgggggtcgcaacataggggagtatggggggagcggacatttcgcaggagtgggagtgtggagcgtatccgacaggcggaacaacgagcactgacgacatatgcgtggaaagtgtgaactttaacaccgagtaatctaaatctcattcggtatccaccacttctacgattacgagggtctgggaacgtacgagcacaggtaacggaaactctgcaagaggggaaatcccgctctagagcgcgcaagaagcgaaaacacatcgccgcggcacactccccagctcgggccacgttactcaggacacaaccaaccacgagcaacaacagaagcgcggacagaaaccaacaagggcagcactagcgcgaacgagcacgcaaagacacatacgagccccaagacgccaagcggccgacatgagcacccgagcgtcggagagcgcaaaagaaatgggcgcgccagacaacagatagcgcgcgacgacaccagtgcgcaccagaacgacatcaccaagtggc

SEQ ID NO: 521854 - DNA, 302 bp, Homo sapiens
gcgcggctgcgcacgggactgccgggggcccggccagaccgtggctgcatgctttcgctaagtcactagtcttttggtgaaggatctgccatgggtgtcctgggccagagtgagcgtggagggccggtgggtcccgctcgtgctctgactcttacgtcgtcgcactcggcccctgacggccagaggggaaccgccgggtgacacctgcgtggagcgctgagctcgagaacatgggcctccgctttgagctgcgggtacacgacgtcctatttctatatgcgacacatttcttcctcagatct

SEQ ID NO: 521855 - DNA, 338 bp, Homo sapiens
acagcggtctgggccgcaccggtgtcatatggaagttcccaggctaggggtcgaatcagagctgtagctggccggcctacaccagagccacagcaatgccagatcggagctacgtctgcgacctacaccacagctcacggcaacgcaggatccttaacccactgagcgaggccagggatcaaattcacatcctcacagatcctaatgtggttctttaccactgtgccacaacgggaacgcctcccaagacttatttttaagctaaatcctacctatgcttaatcataattaacgcctgcatgaattaactggaatagaataaaaaatattctaactca

SEQ ID NO: 521856 - DNA, 164 bp, Homo sapiens
atcgggcatcgcagctctcataacaataaaagagacggacccatgcagaactcgacccaagcggcgaatgcctggcgcattctgttcctgctgttcctcgctaacctgttcaacttttttgacctgcaccattcccgcgatcatcattgagccagaacgaccca

SEQ ID NO: 521857 - DNA, 210 bp, Homo sapiens
  misc_feature (71)..(71): n is a, c, g, or t
ggggggagtggggattagcaccctcataaaagggaccccagagctccctcgcccctcccaccatgtgaggncacagtgagagggcgccatctggaaccaggaagcctcagcaaacaccagaccggccagttcctgatcctggacttccagcctgcagaaccgtgagcaacaaatgtctgcaagggttttgttttattttatttttttaaa

SEQ ID NO: 521858 - DNA, 901 bp, Homo sapiens
ggagcgtggttggggctacacatagtcctaataacgcgacggccgtgttacggggttcatagattgaattccgtcgcgcgtagacctctgatagagagtagagcgcgagcgatgctaatgagcaacggcttcgttcatgagctgcgtaaatagagaccgccgcgtcttgatgtgaaaagagactttgtctgggagaagagatgtatcatatgtaggcgaactcgaaggtctcgatggatgaattggatgatttagggatgcgtaatagtagatatcaatagttaatgctcagatatagatacgtaaatttaaccatagttagacaaattttacagatgctagaattaggcgaataatagattctcaaggggtgatctgctaaataatgtgcagaaaatgtgtccagaatacgtcatgctttctcatataggactgtgtgtcaccaaattcatggaatctcagcccagttagagccggtgaagtagtaaggtaatacttgcaagagtcttgagaacctttttcaaattcgcggaggtaaccagacgttgagatgactacccgagacaaatgtgtacaagcgtcctcccggatgtcaacatatctcgagggtttgtgacgcgggcacgacaagtgatggccctgatctcggattgctgaggggataacggtgaatggggccaggaataatgaggatgaggatggggaatgacgcggagtatgagtgaatgtctcaggttgtgagagacgaggatgaggagtataatagagcaagaaggtgtacgaggaacacgtgactggaaagggggagaggatgaaaaagttttatcattggcggtatatagaggacattgaacacttgggaacaagggctcgcgaaaaactcaaggggaaaatcacagga

SEQ ID NO: 521859 - DNA, 104 bp, Homo sapiens
ggcgtacccctcgtaatggcacctgtgtgggtaccccgtctccagagtccatgacaatgccagtggtgcgcccagaggcgtagagggcgtgggtaatttgcgcg

SEQ ID NO: 521860 - DNA, 614 bp, Homo sapiens
  misc_feature (614)..(614): n is a, c, g, or t
gggaaggggcagccaggaggaagcttctattactacttatgtctctccaagtaccagccactctgcacacactgactcatgaccataacatggaactatcagaacgagcccatagaattagctccgatgataaccggattctgactggaaattaatcctgagatccatagggaaccccatgcggaacatcatggtgtgctccatctaccagaccatcggcggtgtcatccttttcctgaacaccatctaccagaacgtctgccatagagacctgcacagaaacatgctcaaagacatggtgatcgaagagggaatcgagttagacctcagaggtgctcctcttgctgcaacaatcgcagaaaccaccattcaaaggcttgatggacgcttagatcgctattctcagtccaagacacatggcgttaactatggaaatggcttgctatgctggagaatgccgatcaggatcgcttacaaccgtctatccagcataactctaacggcctagcttcgatactccagcctcttgtcgccagttacttggcccctattgtttgaaccccaagtgattaccctaagggggacccatgacatggccacctgcacctttgtcn

SEQ ID NO: 521861 - DNA, 287 bp, Homo sapiens
atcagctcggtccagtttattcgactcgggtactggaggatctctaatcgaccaggctccatcttaacgagtatatggaggtcagcacggagctcacgtgtctacgaaacttgtacagggaggcatgcaccgcagtggtgaatacacgtcgaccaggatccatgtatgcaatattgggacgtgaacacggatctcatatattcaaggaacttgtataggaacgtgtgcatcggcagtggtgaatacacgtcgagctggaggcatgcctgcgtgctcgggtactggac

SEQ ID NO: 521862 - DNA, 389 bp, Homo sapiens
acgcggtgaaagagacgaagcgagagcgcaggccgcactctcgcactgtgcacggaccgccttggaccgcagatgccgcgcaggaattccagtgtcacggtggacacgccttcctcgcgcccttggcggccacactggtcacccagctcaagggctttggaattctgtggccacactgtgaggagatacgggtctgggtcggaggctacaggaagacttccacttcctggaatctggagtgaagaacgccggcattcaggcaccatttcaaggaggtgcaggagaacaggtctgtgagaccatttaacttggtgacattacttttatttgaaggaacgcatattagagcttactttgcgaaggaagaaggttggttccggtggacttgc

SEQ ID NO: 521863 - DNA, 701 bp, Homo sapiens
  misc_feature (598)..(598): n is a, c, g, or t
  misc_feature (644)..(644): n is a, c, g, or t
  misc_feature (676)..(676): n is a, c, g, or t
ttttccacccccaaaaggaaggggttctcaccaaaatatattgttgggccaggttttttctccccaacgcggttttaaaaccccccgccaatttttatacaccccccacagaagggggggggggggcgcgccccccccctgtttttttttttttttttcccccccccccaaagagggggcccacaaaaaaaagtccccccccctttaaaaagcgcaagggcgggggggtgttaaaaaaaaaagttggggggataaaaaaaaaaaatgtggggggaaaaaaaaaaaaagggaaagatgttccccaaaatggggtggaagcccgggaaaccctggggccaaaaaaattttcaccccaataccccccgggaaaatgggaaagggaacccccaagaacttttgagcggcttggtaagggggggaaaaaaaacacccccaggaaaaaattgaaataaaccgggggccttaaaataatttggggttcggggttttttttcaaataagacaaagggtagagcccaggggatattaaaacccccttaaacccagagtaaatcggaatggtgtttaagaagttggactttcttaggggaatttagcngggtaatgccttgtggggggcagtgcccctcctagttgggggtaangggctaggctgaagtggtaaaaggctcagaanaatcctgcgaagaacacaacttctg

SEQ ID NO: 521864 - DNA, 333 bp, Homo sapiens
gccgctgcggcgggggcaaaaggcggcggcaacagcggcaaaaagccgcgggcgcaaaaagcggcggcaacagcggcggcggcaaaaagccgcggcgaggaaaaagtcgctgcggcgggggggcaaaaagccgtgacagcggggggcaaaaagccgcggcgggtaaaacgccgtggcgggtaaaaagccgcggcgacaaaaagccgcggcgggcaaaaagccacggcggcggtggggcaaaaagcagcggtagcagaaagccgcggcggcaaaaagccacggcggcgagggtgcaaaaagctgtgtcggcggtggggcaaaaagcctggtcgg

SEQ ID NO: 521865 - DNA, 123 bp, Homo sapiens
gacggggtgagtaagcactatccacgtgcaggctaggagggcggataggacgggtagtcccacgagtctgagaagggtgtcgccgcatctcttgctgccacacacatatcactacgtatacca

SEQ ID NO: 521866 - DNA, 237 bp, Homo sapiens
  misc_feature (24)..(24): n is a, c, g, or t
  misc_feature (46)..(46): n is a, c, g, or t
  misc_feature (80)..(80): n is a, c, g, or t
  misc_feature (91)..(91): n is a, c, g, or t
  misc_feature (98)..(98): n is a, c, g, or t
  misc_feature (120)..(120): n is a, c, g, or t
  misc_feature (134)..(134): n is a, c, g, or t
  misc_feature (139)..(139): n is a, c, g, or t
  misc_feature (141)..(142): n is a, c, g, or t
  misc_feature (157)..(157): n is a, c, g, or t
  misc_feature (178)..(178): n is a, c, g, or t
  misc_feature (187)..(187): n is a, c, g, or t
  misc_feature (193)..(193): n is a, c, g, or t
  misc_feature (195)..(195): n is a, c, g, or t
  misc_feature (202)..(202): n is a, c, g, or t
  misc_feature (209)..(209): n is a, c, g, or t
gaacggctgacgctatcactaagntcctagtccagacggcatgggncatttcacagaggaggacaaggctactatcacangcctgtcgggnaaggtgnatgtcggagatgctggaggagnaaccctggggaggntcctngnntgtctacccatgggncccagagggttctttgtacantctttgggnaacctntncctctgngctctgngcatcatgggggaaccccaaagtcaagg

SEQ ID NO: 521867 - DNA, 146 bp, Homo sapiens
tcttggtgcggagatcattggactgaggaagctgcacctctggggtcagaatatgcccagactgcggggtgctctctatctggggtcttctgagagccagacagcctgccttgtgctgcatacctggctttgctctgtgcagaacc

SEQ ID NO: 521868 - DNA, 1033 bp, Homo sapiens
tgccaccatgacctgccaatggcacagctgaggctggtgcagatccagttctgtgcctcatcaactgcgtgcaacaagtacctgactggccgaggctgttctgtgtgttcaatggctgaactgctgtactgccatgcatgccttgaatgaatgaatgcagatcttgtgactgctgtgatgcatgccccactgcacgatggctgtgtgcatgctgctggcctgtcgtgccattgctgcatgccacccatgtgtgcctgctaccctgtgctgtgctgtgatcaatgtgactgtgcacactgttgaccttgctgatgctgctgatgtgttgcccttggtcccttgacttgcctggtattccgtcgatctgtcgtgctggcatcttgactgaccgtgtcctgccttgtgtctgccttgcatgctccttgcatgtgcctcgccgacctgtggctgccttcacctactcctgtggcgtgtgccgacccctggatgtgtacccttgtccctttgctccctcttgctttttcggcctgccatggaactcgtgctggtcccgccgactggcactgacatgagactcgttggcgatggctgttgccatccattcggtcccattgctatgccttctcagcgagctccagacgtcattccttaatcacttgttggtacaacccctctggatcactgcctggccttacctgcttgccacccccttgaacgtctgctcgcttgtgccctgtagcccttgacgccgacgacttcaggaccctcttgtcgaccctggctctgactgtttgaccgccttagtctctcccgttccccaatgtccgaataaccaaattccaatcccatcggttcctttcccaatggtcacccatgcgctctcatacagcacgtcttgccaccaagccgtccctgatccaacctgtcaatcccatgctgccccagcgtaccagggaccaccccttgtgtattcggcggagcccccctgcaagccccgggccccatcctgggcctacaccctccgtgtcgccta

SEQ ID NO: 521869 - DNA, 794 bp, Homo sapiens
  misc_feature (562)..(562): n is a, c, g, or t
cggccgcacagcttctctggaacatgctagacctcctggactagttcttctttggaaaataaaagtctttcctgtattattttccctctgccttattatattctttctgggagattttcttaatgcttttcttccaacttttccattgagttttcacttctaccatgctttgaatttccaggaggattttttttattatttttgttccgtggcttcatacaggatcctgttcttgtttcgcagctgtgatgtcacctgagacggctgagtctcttcacagctggtggtggacccttcttcttcctggacccctccctctctctcatccaagttgctctttggctgttcggctgctttggtctctacctgctctcagccggcaggaattcctcaggtatctgggactccttggttgtcccatttgaagagtggaagactaagagctgactgggacctgaagcctgtgcactgtgaccatctacaagggccctctcactaggctgtctgctggggaatctgactaaataacctcacgcatctcttcttgggcagagaagttccnactctgtctgcaagctacagacctggctacctgtggttctgagagctgagtgaggagaagctgggggtgggagaagtcctcagcattcgagaaggctgcatttaccccacactcctgtctggggaaaatgcccccaccttcaactgggcctagagtccctcatccagaaatgcttggtccgtctctcctgtgagcgagcactcagacttctgcatgataggagggggggggt

SEQ ID NO: 521870 - DNA, 131 bp, Homo sapiens
taaatccatatttattaaatatcccttcttttttcattcaggagaaccagaggccaggctgagccaagcaagttctcatctgagcagagactgccacaactaggcagagcttcgaacagcagcgaactgat

SEQ ID NO: 521871 - DNA, 370 bp, Homo sapiens
gagatacacctaatgctaaatgacgagttaatgggtgcagcacaccagcatggcacatgtatacatatgtaactaacctgcacattgtgcacatgtaccctaaaacttaaggtataatattaaagttattaatacgcgtctcggaggttgtcactgttatccttatacaggacacaggctagacacacagaataccaatgcttttctagggcctatgagagactgaaatttcatggcaacctgcaccccataatctgagacaggcacacactggggagcacagctagactcctaccgggggagaggctctgggcataactggtggacacttagtatttgcaactcctcgggttatgtggttctttagaat

SEQ ID NO: 521872 - DNA, 146 bp, Homo sapiens
ctcgtcatgtatgttgagtatcaaatgtcaccgatcgtgaatacagaaacagagcatgagaacgtagctgacttagtgaagtcagactaaagagatatgcaaaagtataaaacagcctgtaatcccagcactttgggaggcagaga

SEQ ID NO: 521873 - DNA, 321 bp, Homo sapiens
tcgatctcatacacggatccccacataaggaccaactagattgcttaatggtgtcggacgagaatcacacttcccagttactgtgcggcatgcatcttaggggagtctgagaggcagtctgtggtagtgtagacgtgataacccatctgttaagagagaactggagagaaatgaggaaatgccggataaaggtttgccctcttactttactctgttccttaataggtgctattccccattcttccttatggttctcacataaatcagtcttcctgtgtccctttcaccttagtttccactcatcacaattaccctctttag

SEQ ID NO: 521874 - DNA, 577 bp, Homo sapiens
atgtcacgaaagtccttgaatgaactgtcttttaaggattagatgatgtgagtcattagatctatacgggtatttagaagcatctgcttatagtggttttccggtcttacctctccaacgtcgtggagcttctaagaccctcgtcgcctctatttcaatctttatagttctacctactctttaaaacctacctcatatgtcatcttctcattcttttcttaagattcttctgcaggcagttagccctcataggaaatcacttactattctgtcattctctcctggcacaagaataggactcaaaccttaaaattcgatattcacaagaaccacaacttttgttgttgttgttgagacagagtctcgctctgtcgcccaggatggagtgcagtggcgcgatctcggctcactgcaagctctgtctctcccgggttcacgccattctcctgcctcagcctcccaagtagctgggattacagccacgcgccaccacattcagctaatttttgtatttttagtagagacgtggtttactattttgggcaagctggtctggaaatcctgagctccggtgatc

SEQ ID NO: 521875 - DNA, 254 bp, Homo sapiens
cgcgcagtgtcgaggccgtggatgcgggtggagatggtggacatgctggccgttctggttgggaagtggcggatcatgccatggcccttcggcatccgccactgtttgccgataaaatgtcggctcccgaatcattccaaccctttcccctggatcagcaccgcatgaatccccagagccagtaccaattcaagtccgtcaactacaccggcctccagccgggcccgcgcgtcatcatcatggggtaccgagct

SEQ ID NO: 521876 - DNA, 212 bp, Homo sapiens
cctagaggatccttcacacgccgagtacatacctgtgtcacagggaagtctgggtggacgaagttgttgcgcaacaacttcgtccactccgatctgcaacaacttcgtccactacgacttgactttaagaagtgtatggagactcggcgtgtgcagcaacaacttcgtccataatgacttgcggcgtttgggcactcggcgtgtgcagggtc

SEQ ID NO: 521877 - DNA, 374 bp, Homo sapiens
cgtgtggtggctcatgcctgtaatcctagcactttgagacgccgaggtgggcagatcacaaggtcagaagatcaagaccatcctggctaaagtggtgaaaccccatctccactaaaaatacaaaaaaattagctgggcgtggtggcgggcacctatagtcccagctactcgagaggctgaggcaggagaattgcttgaacccgggaggcagacgttgcagtgagccaagatcgcaccattgcactccagcctgggcgagacagtgagactccgtctcaaaaaaaatacatctaccaacagatgaatggagcgcactgctatatctatacgacagaatattaactacaggtgcagacagcaacatggatgtcttc

SEQ ID NO: 521878 - DNA, 506 bp, Homo sapiens
tttatttggttgtagaaagtatgcagacatatattacaaagagacagcgaacaccaactaaaggggggcactatcaaaaaaagcgtgcccgccgcccctatgatcaattctatttttctgcgccgctccgagtgcaccggaagcaacagtaactgcatgaacaaaaatgatagcacgactagcatcaacagcttgaagctcacctgaaagatgaaggccctgcctcgtgcggagaatggcaaaaaggccaagaggcgacctacactcgctgtagaggggaactaagcggaaggcctcgtcgacccaactatctggccaaacagacgtatagcaaagcctcccttatattactcgatgagccaggataagcttttggggaagaaatcgcacatctgggagaacaacagccagggtgaacaatcgggagaagaggcgcactggggatgcaacccaggccttccttccggaaaatgaccaggaagggcaccgcgcccagtccgcccacg

SEQ ID NO: 521879 - DNA, 101 bp, Homo sapiens
  misc_feature (16)..(16): n is a, c, g, or t
cgtatgagtagtatgnttatgtcaagcgtggctttggatatagccccttcctcagcatcacagatggcaacatgccaggacaggctgccagcgcgatgcag

SEQ ID NO: 521880 - DNA, 199 bp, Homo sapiens
  misc_feature (7)..(7): n is a, c, g, or t
  misc_feature (167)..(167): n is a, c, g, or t
ccctgtncaccagccaaaaactacgaggagggagagggcagccaggatagagagctcggctttgtggtcagagctgccctctccctcctcgtagtttttgtctggtcagaggggtgctcccctgtgtccaaggctgccctggcgctggggctgctgggcatctactngctaccggggcggccatcgggagtgtccggtt

SEQ ID NO: 521881 - DNA, 918 bp, Homo sapiens
gagcgggcgccccccgtcgtttcccgcccgcgcgccgaggggggcggggaccctgccgggcaggggccggggcaggggtcggggcctcggggctactgcaggccggcgtggctcccttgtcccgcccgtcgcgcgctggcccagaaaagggggcctctgtcgctgccgtccgggggccggtttccgcacccttcccccactgggttggtccttctttgacgtccttctgcctatttgctcgcccgggcccctaacccctcgcgacaagaaacttcttggttgactttgaaacttcgcgaaaaaattacccccggcagatgacgggccgagttggagtgagcctgacccctgttgaacaagcctggtccttcgtgattggcctggccgggtcggaagaactcgtggtttacgtaaacgcgaggggaagagctccttatgtggtatcgcagatcccagtttggggttttaaaattccttgtgacacccatattacgcgcaggggtttctggaagcgacgcgggtaagggcgactggccttggtgttgggggcatacagggttaccactttggaaacaaacagttgaccctttggtaaaagagtgatataagctttaaggagtataaagcggtcccaacgacgttaatgtcgtcattcaaaacgcattatttcgttaacccagatgaagggtaggtagagtaattttgaaaccaagctgtgttccaaaaattggacgtgggtgaagtttactagaagggaaaatttactaaaattctggctatggtcgtggatggtcccgggtgaatcggtgcaaagtgggcttatagctaaactttaagggtagaatgaatgcgggggaaatgacgcggtcatagaagcctatatggagttgcggagattggggattttcaggggagaaa

SEQ ID NO: 521882 - DNA, 573 bp, Homo sapiens
  misc_feature (45)..(46): n is a, c, g, or t
  misc_feature (52)..(52): n is a, c, g, or t
  misc_feature (56)..(56): n is a, c, g, or t
  misc_feature (67)..(67): n is a, c, g, or t
  misc_feature (80)..(80): n is a, c, g, or t
  misc_feature (88)..(88): n is a, c, g, or t
  misc_feature (125)..(125): n is a, c, g, or t
  misc_feature (172)..(172): n is a, c, g, or t
  misc_feature (268)..(268): n is a, c, g, or t
gttaaagtaggcggcagttaataaaataagtgagggacagaatanntatggngggnactttggtgtnttaagcaatagtntcaactgntatcaaatcagaaccaataaggtttgtcattcaaaangaagggctcagaattatttttagataaaagatacaattgtagggtanacatgaaatactggctagcccaatatgaccatattaattaggaaaaaacatactaaataataagaataaaaactcaaagaataaggagatattacnaaattaagaaatgagtgagaaaagataagagagtaataagaactaggaataaaacagaatcaaaaccagaagtttaattggtagaataccagcatactatcaacttcaaggcccctaatgagcccatggttcaggcctctcacccttttacagtctattttgagcaggacacaaagttctcttgactaaaaagtaaaacaaaatgaccaaattattatttttgaaatggagaatttatctacattgtatataacaaagaaatgagagtatgttaagtattttgatattaacatttgaaattacaa

SEQ ID NO: 521883 - DNA, 920 bp, Homo sapiens
gagggcaccccagcggtgggccatgtgtgtgaggcagcacggaacatgtaggttatagatctgtcagtggaggaggggtcaagttgggtgcattgtttttctgaatatttagtgtccttgaatcagccctcgtatcccattccccactacgctgtccgccaatgacctgcactgatgagcattgatatccccctcgacagagaaatgcagtcataacacatatgacttatagggaaatacgttcacacgagcctagttatgcgccacaacacgttactgcgtcacatgaggggacaccccatagttatcccacaagggacgtacaatacgaggtttcaatcatgtgaagacgacagaccgcgtaaggggcatgatagatagatgatgacaaagggttggggagacagctcaggggtgtgccaccatgggatcatgacaaggtaagggggtattatgggagaccacaagtaggaagcgttacagtcagcactggacgcaaattacacgtagacatgacaatttcacattaccattcatttggtccattaccacatggagtgacgctccctttacagtctgccagcgcctgtttccacaggatcaacgtagccgacgagggccacatggagagagtcgcaggcgatcgcagtagctcagtgcaagcgacagggaggggccaccacgataggggaccaaaagcaagacggaaggacaaggggacagatgcaatgacggacgcaagagcgaacaagggaaaacccgaacgatggcgagagagacaatccattatgaccttaccgcgacaaaagtgggcagtgggcaacggacaacacgggcacaacgggacacagcctggggaacagcaaaacgcgcccgactgaggcgggaccgaagccgccacacaccagtgggggcacgac

SEQ ID NO: 521884 - DNA, 451 bp, Homo sapiens
tgttgagttattgccatctgtcgctaagcgggaaatgtcgaagcaacttatgaatacatgaccaaatatctggtatcggagaagctttgagcaccagttaaatctcattccttccctttttattgcaaatggcgctcgtagctcctacgagcgcaaccttgtgaccagatgcacccttcccaggaattgtcagaccattctacagaagtaccagcctctgatgccctacagtctgtggtgccagaggagcttcagctgcattataaaacaattggtataccaagaagtgtcagggaccaagtctatgactaagtagatgcttggaaggttctgagcaattcagaacaatgtctactgcatcctctaagaatcagtacacaacacccatcccctacactcacgctctctctttctctccttccttacagagttcaaaaccacaagacaccct

SEQ ID NO: 521885 - DNA, 115 bp, Homo sapiens
tcatgatagcttgccactaaaacaatgttaccaccaggaataaagtctcttcaaatatagacaaaactttgactataaacagctgtatcctacttgtctcccatgaaacttatac

SEQ ID NO: 521886 - DNA, 460 bp, Homo sapiens
gcactatgttgatctaaaggaaggaggatgtatcgtgaggatgagaggtgggaatggtgatcaggagattcactgactagggaactgaatgatgtccatgatatcattgattgtcataagcagccgataagtgagtggattgtgaaggcctggatacgctgggcgtggtgtgtggctagtgtaggaaaagaatgtgagatgcactataccacgagacctgtgacggagtctcggaggttcgagaagactatatggaaacatgggactagcgcggactaggttagttagctggtgttagcatgcctttgttgacaaagtatctagagatgaggacgaaaaacacttatgagacttggacagaggatatgattttccggctgcgtcggcaagttctgcgaacctcagcccgactggtccgaagccttccagatgtgtgtctgcgagatacgaggtggagatc

SEQ ID NO: 521887 - DNA, 1234 bp, Homo sapiens
  misc_feature (1234)..(1234): n is a, c, g, or t
ggcggagccatggagggtcggcttcggtctctgatttcggggtgctccgtgcacgcgggaagctggaccctagggtctcataatggagcaggtgaaagtgcagatcgcctgtggccaacgcgacaggagctgctgcagaggatgacgggacaagttgtttccgtgcaagctgtatagggcaaacctgggggctccctggaccaacttccgagcagaattgcatcgccatgtgctatggactcgcctatcatggcacgcctggaacaccgtagtctcgcgccttacaaatctgcggatgcagcgggaacgagccaacatgtgaccggcgagcgcgggccaacccaccctgatacatttccataaacgatgctttgagagtgcggggtccgcatgtacgtactgcctgaccggggcttaggagggtggcaccggatgctgggacagactgggactgtgtcctcgaccagcccacacgacctgaccccttgacaagccagtgcagactaggatctcgagagggatgtggggccctgtagccttcctgaagtgctggcagaccagtggcacactcctaacaaggcctatagagggtatatcccactaagtgtagcccaaagtcaagcctcatattctgcgacggacaagcttagtctggacttcaggacgtaagagcggtaggtcagaacacaacaggaagctcgacatcttcctggcgagcctgggaccaaaacacacttggcggcacgcacggccaaaacacaaaaccacacgcaaccgaaaacacaccacacacagaaaaacaccaaacacacacaccacacacacacaccacaaacacgaaacacacacgaccaccaccaaccacaaacaccaacccgccacaaacaagcacaaccacaataacaaaataacagagaacaaaaaaatcgacttaataacaataatataagataatataatataagatagcgagatccatcacaaaaccttacacaacaatgaagacatacaccatccacgtactaaacaatcactaaaacagaaccagaagacaacacagaacacacacgacacacgctactactgacacctcgcaacctacagcaaacataagacatgacgatcctccatcagactactaacttacacacaccacattatttccccgccactgtctgctaacacagcactaccaccgtgagaaccacgcccgcacacactcactacacaacgn

SEQ ID NO: 521888 - DNA, 200 bp, Homo sapiens
  misc_feature (49)..(49): n is a, c, g, or t
  misc_feature (56)..(56): n is a, c, g, or t
  misc_feature (135)..(135): n is a, c, g, or t
  misc_feature (145)..(145): n is a, c, g, or t
ccccaagctcatgccagcctcatctcctttcttgctagcccccaaaggnatccagnaacatggggggcccagtcagagagccggcactctcagttgccctctggttgagttggggggcagctctgggggccgtgnttgtgcatgntcatgctgacccaacaaacagagctgcagagctcaacatagaggtgagccggctg

SEQ ID NO: 521889 - DNA, 608 bp, Homo sapiens
gggctggtggcgtcgcctgcgcgtctcggctgagctggtccatggctgcagctgtgcgggctgaggcggagccggagcgtctctcgccctgtctggcgatcgctgctcctctctggggctcctgtgctggccggacccgaggaagcgcatgcgactcccactgatcttctgcctgtgtgtcctaaatggtggttgggcagatgcctgggcctccattgcctacggtggtggatacatgtgtcactgacggattccttgccagctgtttgtgtatgggggctgtgacggaaaacaaggtaaataaaattaccctgaccaagaggatgctcataatgtccctgtcacagagaatgccagggtgacctggcacacagaatgcacgattctctgtccaagtgctccagaaggaagatctgaaacactcagcgatagtcaatataaaatctgacgcaacgcatcactggcttgccggatcttccagctggtacttgacgtggaagaatcctgcataatatcatggaggtgcgggaataagacagtacgtctgagagctctgtcgtgttcgcagagaaacctcctgcctggtcaagtggtgtcgcgggtgcgga

SEQ ID NO: 521890 - DNA, 530 bp, Homo sapiens
ggagagagagaactagtctcgagttttttttggtttttttaaggttggagggggaatgctggaaatggtaaggggtatggagacttttcatataagtaaggctagggtgaggggtaggaagtttttccataggaggtgtatgagtgggtcgtagcggaatcgggggtatgctgtccgaattcataagaacagggaggttagaagtagggtctgggtgacaaaatatgtgtgtgtagagttcaggggagagtgcgtcatatgtttggtcctaggaagatggtaggtggtgaggggtgtttattataattaagtgttgggtgtattcggctatgaagaatagggcgaaggggcctgcggcgatatacgagtgtttgaagccgtgagacactagtgcggactccccttcggcaaggctcgaagggggttcggagggtcatcggctagctggcgagcataacatcatatcagggccaagggctcatgagtggcaggagctcatcagaggggtcctcggggtggcgcaaaagggg

SEQ ID NO: 521891 - DNA, 107 bp, Homo sapiens
gcggccgcctactactactactgctcgaattcaagcttctaacgatgtacggggacatgggaaatgtcaacaagtatgaataaagacacctactgagtggcaaaaaa

SEQ ID NO: 521892 - DNA, 582 bp, Homo sapiens
gctggaagctgactgacattccgcaaaactcatactatctagggatgccacccgtgcagtagctcacacctcccccctccaggagctacgacacaaaggagaatggacttttgtagctctgatcatcagggaatcagtgcaggactgatctactagctccaccacaccctgccttaatactaacattgactgttatgacctgggcctaagactctatgttccagaactggctcggctacccatgtaacactcactaacttgagatcttggtcagataactgataacttttaagcctctagctacttactatgctgaacagagatcgtgaatgaacatcggctgctactaactgcgtacatgctactgcatgcttaacgccactaggcatatccattcaatgtggggaccgaaacttccatgatatcgatgtctgaggttgattgaatgcactactgggatcagctacgatgatcacaggccaccactaggggagacgatcgtgaagattacactggtaacggactctcaaatgatcaggaggtggacacttcgcaacttgctacctgcacccagctcattac

SEQ ID NO: 521893 - DNA, 154 bp, Homo sapiens
  misc_feature (36)..(36): n is a, c, g, or t
atcagggtctggacagatgcatttcgagctcttcangaaactcagtctggatcatataaaattgggtccaaggtcattaagattgcttgggctttaaacaaaggtgtatatgtaactccaagatccacatcccagaattgtttgtattctgttt

SEQ ID NO: 521894 - DNA, 143 bp, Homo sapiens
ttccggggcgggtggggaggggtgctttgctggttttcaattcccaagaattctccaaaacaattttttgcaggatgattgtccagaatcattgcttatgacatgttccctttttcccctgttttccataaataaattaaata

SEQ ID NO: 521895 - DNA, 706 bp, Homo sapiens
  misc_feature (34)..(34): n is a, c, g, or t
  misc_feature (522)..(522): n is a, c, g, or t
ccctaaagggcggccataaaaagagggcccccgngggagattacaaaagtttcccccccaagtggggtggggaaggacaacccctttggttcccctagtccaatgggaaaatgtgtccctcctccaagccataaaatgggggctgaaaactgtcccagttttctcaataagaaaagatgggaaggttgggcttttccccaaggtgcaaagtccgcccatctggttaggagtccagaaaagtcctgaggccctcctcttcccctcagcagtgtttatgactccatcagcatggagacgctgtcaaacatgtttgagctggatttgccccctgtgccctccctcctcagcaaaatgatcattaatgaggagttgatggcccccctgggccaaccaacacaaacagtggtgatgcccccccttgagccccctgcccaaaaaaacctggtttttcaattggccaaaaaattgggcaccctggtggaaaacaacaaacgggtgttttcccccaaacagggcccctcngggggttttttccaaaaccaaaaggggggctcccccaaaaaaaagggttacatgcccccggggggttccccccaaaaaaattttcaaagggcctattgagctttcccctttgtttcccgccggggccatccacccttaaagtcttaaacccccccccagtccctaaaggtttgtttaaagttta

SEQ ID NO: 521896 - DNA, 218 bp, Homo sapiens
atgagctcgtaccccatttgaaagcctgtggaaaagtaccgtgtggaaaagtatctgggaaaacgtaccctggtgaaaagtaccctggtgaaaagtacccatgggagaagtaccctggggaaaagtaccctgggcaaaagtagcctgaggaaaagtgacctgggtaaaagtaccctggtgaaaagtgccctggagaaaagtagcctgtggaaaagtag

SEQ ID NO: 521897 - DNA, 474 bp, Homo sapiens
gatatgggtcctggccaggccctgtgtgttgggagcttttccaccataccccccttggggtgcttttctgtttgttttttaacccacccgtttcggggggggttctccaaaccgtgggccaaaagggttgtggggctgggcagggcccccagtttgccccaaaagccccaaagggttaatttattttttcccctaaaccccccccccccctttttttccggggggggaggacgggttccaaaccgtttttttccattggcccctttagttttgggggtaagccgggttattatacccaagccttggtaacccctccaaagggaaggggaaagttttttgggcccccttgggttttttttttggggggggccggttttaggtttttggtttttaaacccgggcttttttttggggacccccttgccccaaatttgtccccggatttttgggccccctttaaaaggttttttggga

SEQ ID NO: 521898 - DNA, 638 bp, Homo sapiens
ccaggccaaggaatgcccacagcccaagattcctcctaagccacgtcccatctgtgcaggaccccactgaaaatcggactgttcaactcacctggcagccactcccagagcccctggaactctggcccaaggctctctgactgactccttcccagatcttctcagcttagcagctgaagactgacgctgcccgatcgcctcagaagccccctagaccagcagggacgccgagcttcaggtgactctcacagtggaagaagacaggaatctcatgcctctgagcccaagctaagccatcatatcccatgtgacctgcacgtacacatccagatgactggttcctgccttaactgatgacattccaccacaaaagaaatgaaaatggcctgttcctgccttaactgatgacattatcttctgaaattccttctcctggctcatcctgactcaaaagctcccctactgagcatcttgtgacttccactcctgcccgccagagaacaacccccctttgactgtaattttcctttacctacccaaatcttataaaaaggccccacccctatctcccttcactgactctcttttcagactcagcccgcctgcacccaggctgaaataaacaggctttactgctc

SEQ ID NO: 521899 - DNA, 248 bp, Homo sapiens
gccccacacagaaacattccaagcctgtgataaactctctcacccttataccaataaaaactcttagtccataggagcaagcacttttaaccaaaaaaaaaaaaaaaattgtccagaagcccctttaaggtttattctccaaaataaacttgtttttgactgtggagccacttttcatgtttcttttctctttctttacttcttacatttggggctgaaacctgggatgggtgttgggcgataacata

SEQ ID NO: 521900 - DNA, 358 bp, Homo sapiens
cgccatttacaactatctccattcaataagatagttgcccggactgcacaacttgcatgacttcagcgtagttgtcttacttttatttctttatactttattattcattttgttttcactaagttgacaatatttaagagtatgagtttggaagaagtaagagaatgggaacagaaggtaatagaaaaggagaaaaaaatactaaaaagccttaagatgtctagctcacaaaatacaaatctaaagcaaattcttttcactgtcattgcagtatatcattgtttattaacttatatcttcttcaatttctttcatcaatgttttatagctttcaatgtatagatgcttcacctccttg

SEQ ID NO: 521901 - DNA, 538 bp, Homo sapiens
tgggtgcgtttactcaagtatcaaccaggttcctgggtcgacttgccacaaatcctacaagattctttatgctatattaactaacatcagtgttccccatgagctataggatctgagatgcagaatgtgaccctcaacatcctctgaatagggacagagtgatctggtatctagattccttagattgaggcggactgtccccgaaaagagcttcccccacttggcctgtagcagagcagaaacaaaaattcaaatgccatggtctcccatggagctggtacagcaggcatcctccctgtgtttttcataagaaattatgcctgtgtccccctttcaatctgttggaccagttcttctacataggctgagtcagagagaaccagtttgtctagcctggggaccaggactgccctccgctggcatgtcagagacttcatagtagcttcagcattcctgagggattcccttacattcctaggagatccctttatgggagggctttgtcaccaggtgacctgatatagcttgagaaagccta

SEQ ID NO: 521902 - DNA, 674 bp, Homo sapiens
  misc_feature (98)..(98): n is a, c, g, or t
  misc_feature (528)..(528): n is a, c, g, or t
  misc_feature (586)..(586): n is a, c, g, or t
gtttgtagaataacatttttagttatgggctacaggaactggaatactcattatctgatcagtttggattggaaacagtttaagtattccagggtccnagatacctctggcctggtagtatgttttgtgattaattgattaattgaaaagtaaaccacagtaggaagaagtagactggaagagtctggaatttagaatatagatgtgctcattagtctcggaggcagaggactccaaattcactttagtgttatgggaaaagattccagtctgctggtggaatataataggtgtacaggggaggcagtttgtggaggaccatgtgagcagctggaggctgggaagtccagcaggaggaaacagggagtctcatttaactattgggatgttaaggagttaccagactgtgattttattatagagggagtctcattatccacatcatgccaggaaatcactaatggagtaatcccttatcaagagaagagtaatagaaattcagcatataatccgcgcgcgcacacacanacccctcagcataaatttcctaaagctaaaattatatctaacactgtaactgacaacngcacaataacctactgaaagagatgctcacttacacagccttcaaatattccaaaaaagacacaaaagcacagcgacacacaaaccct

SEQ ID NO: 521903 - DNA, 802 bp, Homo sapiens
agagagtgtgcccccccccatgtgggaaaaccaccacaccttgccttgtgtaccacaattacataatccaggtggttcagccccagtttttcgtgttagaaaacgcgcagggtgtctctccgcccccaaggtgacttcgtccaatgaaatgtccccccggagcagattgtctaagtaccagattggatttttttggaaattgggaaaggactagtatctccaaattggcaccagctagtcgccttccattccgcttgtgttctcatcccccccgaaaggggccaaaagccgccctcggccaatgggcctggccagctaggaagcacttgaccctcacccttcagaagtatgctaaaagttctttcatgccaacgtcacctggtgagggcgtccggctctctggtagtcacttctactgttcactgagatgctgtagaaggtcacatggtcacattaacttcgcgagcgtgcaaccgtgcgcccaaaaagctaagactgtcttcaccaagcttgtatgtaatcagcacagcttccgatcgtaggaaccttaaatgtcatttctcaaaaacaaccccttgtgcactcctacggtaagtagcccgcacgaatattcatttgttgatcaggtatcccctttaatttgatactaatgttcgtcctgaatcgtcatatacacagattatttccgaccccaatgctggtcaacgtggctgcttggagcgggtaagttgaactatctgcaagtggaagattccaataatgggccctgaggttgtctccctaggaacagtgcagtgtttgt

SEQ ID NO: 521904 - DNA, 392 bp, Homo sapiens
  misc_feature (15)..(15): n is a, c, g, or t
  misc_feature (37)..(37): n is a, c, g, or t
tcccacggtagattntggggagggtccaaggacaggngtgtgttttggattggtgctgtactaacaggggcaactcaaagattattattattttttttttggaaatggagtctcgcttttccacccaagctggagtgcagtggcgcgatctcggctcaccgcaggctccgccccgggggttccacgccattctcctgcctcagcctcccgagtagctggaaccacaggcgcccgccacctcgccgggccaattttcctgtattttaagtagagacgggtttcaccggtgtaagccaggatggtctcgattccctgacctcgtgatccgcccgcctcggcctcccaaagtgctgggaccacaggaaatctaccgggggcggttaccgagctca

SEQ ID NO: 521905 - DNA, 300 bp, Homo sapiens
gagatcggacccacttttcatctgcaccactcatctgccatcaccagatattagaggcactgcatgaccagtgacacatgtttaacggacgcggtacccataaacgtgcaagggtagcataatcacttgtaccttaagtagggacctgtatgaattggctccacgagggtacagctgtctcttacttttaaccagtgacattgacctgaccgtgaagaggcgggcataacacagcaagacgagaagaccctatggagctttaatttattaatgcaaacagtacctaacaaaaccacaggt

SEQ ID NO: 521906 - DNA, 681 bp, Homo sapiens
  misc_feature (4)..(4): n is a, c, g, or t
  misc_feature (63)..(63): n is a, c, g, or t
  misc_feature (66)..(66): n is a, c, g, or t
  misc_feature (120)..(120): n is a, c, g, or t
  misc_feature (164)..(164): n is a, c, g, or t
  misc_feature (178)..(178): n is a, c, g, or t
  misc_feature (184)..(184): n is a, c, g, or t
  misc_feature (198)..(198): n is a, c, g, or t
  misc_feature (201)..(201): n is a, c, g, or t
  misc_feature (208)..(208): n is a, c, g, or t
  misc_feature (234)..(234): n is a, c, g, or t
  misc_feature (241)..(241): n is a, c, g, or t
  misc_feature (264)..(264): n is a, c, g, or t
  misc_feature (318)..(318): n is a, c, g, or t
  misc_feature (388)..(388): n is a, c, g, or t
  misc_feature (429)..(429): n is a, c, g, or t
  misc_feature (437)..(437): n is a, c, g, or t
  misc_feature (493)..(493): n is a, c, g, or t
  misc_feature (508)..(508): n is a, c, g, or t
  misc_feature (535)..(535): n is a, c, g, or t
  misc_feature (540)..(540): n is a, c, g, or t
  misc_feature (542)..(542): n is a, c, g, or t
  misc_feature (570)..(570): n is a, c, g, or t
  misc_feature (585)..(585): n is a, c, g, or t
  misc_feature (597)..(597): n is a, c, g, or t
  misc_feature (658)..(658): n is a, c, g, or t
cccnccccccccccccccccccccccccccccccccccccccccggcccgcccccaccccatngcnccctacggctctgcctccccgcgacccccaccccgctaaaaaggcgggtaaggngtcacactgagtcttcaaagtctggtgtgtataaaacagcacanctcaatagccacangcaggnagggcgcgggggcncangcctctnatcccaacactttgggagggcgaggngggcatnggacgaggcagggctggacaagngcctgggatatggtgggcacaattcttgaatggacccacgccaatgtacgcgtngcttttgcctgggccgtgccttcttcctagaatgtcctgcttctatctctatgtctaactcatgtgaatnaactttttaaaaaattagtatccttcaaaactgtatttgcncaggcgtnctgaggtgagggcctcctgactctccaggtgcgggtgcttctctgcgctgtgtgtntgacctccaacagcntgttctgcctgcgcactatttgctgangtgtnanctccggggattctcgaatttctcacctncatccccaaggcctnctcaactcagtnttctcccgggtcgtggtgcttgaggcactggatatcccctggttaaacacccactgcagtngagcagggaggggacgcgcccct

SEQ ID NO: 521907 - DNA, 1808 bp, Homo sapiens
  misc_feature (278)..(278): n is a, c, g, or t
taaagaaggaaaccccggtattgattgtcggggttaacggatataggaggaaattggggagataggtgtgtatagaccatagagggtgagttaaccccgtggtagaatagaggggttaaactgtgttggtaaatggtgggtgggtgtagatgtagacgccccattgtgttgtcgtggcgtacacttcttgtaaacggagatgtaatagggttgtgtgtgcaccataaataatgtgtgtgagtctcgcgtgtataagatatagggaagagagtgtgtanatcattgtgtgcatctccagagagagaacacgtgtgggtgtatcactatagcccacgagagagaaagtatctctctcccgcaagagaatgaggttctacacataagtgtgaggagggggtattaagagggcgcgagagatttttgagcgagagggatctgtgtcgctttaaaagagaatctcttatacaaagagagatcttatatagtgagagtgggagacgatattgagagatagtgttgtgaaagattctccctttgtgagaaagagagaagatatataagagtatagagcgcgcaagagagttgtgacagagtcgcgccgtattacgcgcgtaagatttatgtaggagagtactttgtgggcctacagaggcgacgagcaaaatatagcgtatcaatatagagaggaggataattgtttctaaagcaccccgcgtgtgtggggcgccgataattttatagttgcacagcacaaatagtgaaaagcgttgcggcggcgccccggtgttgttgaaaaaaagactcttccacaagagggggggagttaatcatgagagggatacgttgagcagaccaacaggtgggggggtcgttggagttaacaacacataaacgacggaagaaggggagggccccctacaaataggtagatggcgggccgtcggatacgttgttgacaccacgaacacattatttcttggcaccccaagtgatgtagaacgacgccgaccaataatataaagaagaagactcatcgttgaagttgatggtgtgcatacacgcaataacaagcggcgcccacgaatcattggtagaaccgcgcccgctgtatggcgatctaataataaaactgataagttgggcgcccctcacaaaataagggggaggactacttatgatcaccgcaacctgcgacaacacggtgggggtggtacttacgcggcaataaaagcttgagtgtgatcatcacagctgtctaccacaaggagggggagtgtacatttctagcaacccacaactcgctgacaactagcttggcttacacacgggaggcggcaataaatatattaatataacacgcagaaaatatagacgccgggcagcacttaatgtattttactaaacaacaggaaagcttaaccgatggcggggggccacagacgtcacacacacaatatgtatgaagccccccgccaaagagggtaaaatggtggggggatgtcctatcagccaaaccacacttaggtgagtggacccatattatcgggagggaggaggaagatccacactaaaaagtagaagagaaagcccccgcgctaaatcaacacgacaggatcaactctctctagtagcagtttattaaaacacgcgctctatagtgggtgataagagcagcgcacatagccactccatacatcaacaactgtagtgtagtaggcacacccagcagagatgcattctgtagacaaactcatgtcgtagggcaccgatcgaaagacacagatcgtatgattactcatcactcacat

SEQ ID NO: 521908 - DNA, 303 bp, Homo sapiens
tcatatatacttgaatagtccattgaccgcaactctttatagactattgtgtaaatgtggaatcccagactgttatcattgcctggtcttcagcagagtcctggagctgctgggacctctcctatcatgatgaacttgaacttttcttcttcatttctggttttatgtaacataaaattatagaatccagataattcgctggagtcattctgatcctccatgtagatctgtacttagtatcctttggatttggacaagtgttgattacattatggctgtgtaataccattcttattaaatctg

SEQ ID NO: 521909 - DNA, 186 bp, Homo sapiens
gtacccgcttggctctgaagaagccacgcctgagatacaaaagatgcactactcttacccgctttatgttcgcttcctctccccttccgatgggaagggggactctaaggcaaggagatttacacgttgggaaggaggcagtggcagaggggtgagggacaggtgcccttacgtccagcgaggaat

SEQ ID NO: 521910 - DNA, 339 bp, Homo sapiens
ccctccacacagaatgacagggggttacttagcctatatcaagagtcccatttatcagcctttgttgaaggaagatagtcacaccccttcgagacagcatctctccctataaagaagcagctttgcgctttaccctgatttacccttcatacccttgtctgcacagtcattagaatcattaaggccatctattaaatcctgtagagataaaatgatactctctgtacaaaattgtacttctcaatatttttttactataccaagctttgttaccctacgagctaattccctcgtttacttactcatctagaataccctatgttcaaaaaatctgattgg

SEQ ID NO: 521911 - DNA, 243 bp, Homo sapiens
ttcttattttctatgtcgttgttgtagaagaaatcactcagctgcagagggtcagatgctcgtgagactgcgagtcctggatcaacaccctgcttgggatgatgctgaccacggggaatgccacacagctcgcgatttcagcctctgcatgtccgcctcttggtggtccacctggctcccactgagaggctgcctatgactactgactagccatggcgagcttgtagattgaatatcccttgc

SEQ ID NO: 521912 - DNA, 586 bp, Homo sapiens
ttacagagtgctttcggcgaacgcttcgtcgtcgttgtcgatctcggtggatccgctcatggcggactcctcaaggaaaggcggcagtttaactgcattcaggggcgtgatgctgctggcgagagagccttcgaggttctataactgccggggccaaccccctgcacggcctggaggctttgtgatgctcaaactttatggattcgcggtcagcaactactacaacatggtcaagttggcgctgctggaaaagggcctgcctttcgaggaagtgccgttttatgccgggcagaccccggaggccctggcgataagcccccgtggcaaggtcccggtgctgggcgtagagcagggttttatcaacgaaaccgcggtgatcctgccctatatcgatgacacccagccgggggtgaagctgctgccggccgatcctttccagcgggcccgggtgttggcgctggccaaggaaatcgagttgtacatcgagttgccggcacgggcgtcgttcgccgagggcttcttcgggatgccggtgccggaggcgatcaaggagaagacccggggcgaattgctgctgggtttggct

SEQ ID NO: 521913 - DNA, 1732 bp, Homo sapiens
  misc_feature (1721)..(1721): n is a, c, g, or t
tggagggcaaaacaatttcaaacttttttgcccaggaaaaggaaaaaggggaggcccgggggtgtggggggccgtgggttgtgcatcacttgtgtctcaacccaaaaaacagtttgactggaaaggggaaaacaccagtgtgttaggccaacacccctctcccgggttcgggaggcttaaagggtttgcagcaatcacggaaacaccatgcgagatctccggggtgttaggggagaaatgtgttgtcaacacccgccacggccacaagaatattgtgtgacgcactgcgtgcgatgtgtagatcttgggcgtggagaggcgtgagaacttcgcccatagaggtgtctctaggagaacctctgcgatccagcggagaagcgtcttcacgaagcatctccggaggaaatataccctgggcaaaaacgagcgaacacagagagcgagcaggagagcagacaggcgtaactacaaaagagcgacacaaacgctccccaccacagtaataagagcgcagaacaagggagaaaaagggagagaggggagagggagctcagagaccaccgtgaggacacacacacctagttatagtaccaacacaactaatgggggaataaaccccactagtagtgggcgaacataacatagaaggaatgtcatagcgagagacaaaacaaaacaaaaattgcaacaacctgcgcgagacaactagaagagaagaaagagcacatatacgatgcgtaagaaaagagaaaatagagcgtgattacacaacactggagatagagacaaatacatacctaaaatatagtagtgacacacacaaacccaagaaaggattatagccaaggacacaacaacatagtcgacaccgccacacaaaaatgtaaggatttaatcccaaacgagtagaaaataatttgacggaccctccgcgtatatacatcagccatctggagaggcaatagaagagcaatagtgttgaaacaatgagtacgagcgcctatgacaaataaatgatagtgtattaccccacggacagtaattaaaaaaacaaccaaacaaaagacaatattcaatataacacagaataccacccacatacataatatcacatacatctgtcaaatcaacaatccaccaaacaccaccccaatacccatgacaaataaagaaaggcatactttaacatatcaacaaacaccactgcaaatcataacaacaacatagacgagaagctaaatcaacacaccatgaaacataccacacacaacatactatcataaactatgcaataactcaaacataaaactacctatcaattagatgtagacacccacccactgataaaccccaccaacccgacatcacacaataaagaacacaaacacctatcaacacaacagacataaacaaaaacaaaccgaacacaacaaccaacaccctcaataaaaaacaaaagaaatcaaaacaacaaacaaagcaacccaaccacctaattttcagcacaacactaacaccacgcatacgagatctaacaaaacactaaacacactcaaaaagcgaccataaacaaccacatacaacacatcacagcaacaaactcacgaacaacaacaaacacaacactcacaaaccactaaaacgacataactaccacacagaagaccagactaatacaagcagcatcatcgcagaactaaccacaacttactaacgctcanactccactcaa

SEQ ID NO: 521914 - DNA, 919 bp, Homo sapiens
  misc_feature (32)..(32): n is a, c, g, or t
  misc_feature (43)..(43): n is a, c, g, or t
  misc_feature (46)..(46): n is a, c, g, or t
  misc_feature (51)..(51): n is a, c, g, or t
  misc_feature (59)..(59): n is a, c, g, or t
  misc_feature (61)..(61): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (103)..(103): n is a, c, g, or t
  misc_feature (125)..(126): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (152)..(153): n is a, c, g, or t
ctgggagggtcccctggccttaaaaggggccnaggcccttttnatncttgnacgcctantncattgccntggagnagnaggtntggcnantggnggggggtgntggcccccagattcccccagcnnanctntctttgtcnccncgtgggctnncttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgcacccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttt

SEQ ID NO: 521915 - DNA, 1181 bp, Homo sapiens
  misc_feature (32)..(32): n is a, c, g, or t
  misc_feature (43)..(43): n is a, c, g, or t
  misc_feature (46)..(46): n is a, c, g, or t
  misc_feature (51)..(51): n is a, c, g, or t
  misc_feature (59)..(59): n is a, c, g, or t
  misc_feature (61)..(61): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (103)..(103): n is a, c, g, or t
  misc_feature (125)..(126): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (152)..(153): n is a, c, g, or t
ctgggagggtcccctggccttaaaaggggccnaggcccttttnatncttgnacgcctantncattgccntggagnagnaggtntggcnantggnggggggtgntggcccccagattcccccagcnnanctntctttgtcnccncgtgggctnncttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgcacccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttttgggatcctacactcactataaagactaacaaaaatacctcgcgggctcataatactcgacagactctacacaaacgggcgtagataacaagaaccatcggcccccacactgcgccaccactacgacgcaacacacatataggttcaacacgtcgccacatcatctctgccagataccaaaaatagagcaagacagtattatctttgctccaacacccaagtcaaacatggaaatagagcagcatcacaccgaatgcttc

SEQ ID NO: 521916 - DNA, 942 bp, Homo sapiens
  misc_feature (23)..(23): n is a, c, g, or t
  misc_feature (39)..(39): n is a, c, g, or t
  misc_feature (44)..(44): n is a, c, g, or t
  misc_feature (58)..(58): n is a, c, g, or t
  misc_feature (76)..(76): n is a, c, g, or t
  misc_feature (84)..(84): n is a, c, g, or t
  misc_feature (90)..(90): n is a, c, g, or t
  misc_feature (98)..(98): n is a, c, g, or t
  misc_feature (102)..(102): n is a, c, g, or t
  misc_feature (105)..(105): n is a, c, g, or t
  misc_feature (113)..(113): n is a, c, g, or t
  misc_feature (116)..(117): n is a, c, g, or t
  misc_feature (121)..(121): n is a, c, g, or t
  misc_feature (126)..(126): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (136)..(137): n is a, c, g, or t
  misc_feature (139)..(140): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (152)..(152): n is a, c, g, or t
  misc_feature (155)..(156): n is a, c, g, or t
  misc_feature (159)..(159): n is a, c, g, or t
  misc_feature (161)..(163): n is a, c, g, or t
  misc_feature (171)..(172): n is a, c, g, or t
  misc_feature (183)..(184): n is a, c, g, or t
  misc_feature (189)..(190): n is a, c, g, or t
  misc_feature (194)..(194): n is a, c, g, or t
  misc_feature (206)..(206): n is a, c, g, or t
  misc_feature (209)..(209): n is a, c, g, or t
  misc_feature (212)..(212): n is a, c, g, or t
  misc_feature (228)..(229): n is a, c, g, or t
  misc_feature (236)..(236): n is a, c, g, or t
  misc_feature (238)..(238): n is a, c, g, or t
  misc_feature (241)..(241): n is a, c, g, or t
  misc_feature (248)..(248): n is a, c, g, or t
  misc_feature (253)..(253): n is a, c, g, or t
  misc_feature (257)..(257): n is a, c, g, or t
  misc_feature (259)..(259): n is a, c, g, or t
  misc_feature (265)..(265): n is a, c, g, or t
  misc_feature (267)..(268): n is a, c, g, or t
  misc_feature (272)..(272): n is a, c, g, or t
  misc_feature (274)..(275): n is a, c, g, or t
  misc_feature (278)..(278): n is a, c, g, or t
  misc_feature (280)..(280): n is a, c, g, or t
  misc_feature (283)..(285): n is a, c, g, or t
  misc_feature (289)..(289): n is a, c, g, or t
  misc_feature (294)..(294): n is a, c, g, or t
  misc_feature (298)..(299): n is a, c, g, or t
  misc_feature (301)..(302): n is a, c, g, or t
  misc_feature (306)..(306): n is a, c, g, or t
  misc_feature (308)..(308): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (327)..(327): n is a, c, g, or t
  misc_feature (330)..(330): n is a, c, g, or t
  misc_feature (337)..(340): n is a, c, g, or t
  misc_feature (343)..(347): n is a, c, g, or t
  misc_feature (350)..(350): n is a, c, g, or t
  misc_feature (354)..(354): n is a, c, g, or t
  misc_feature (356)..(356): n is a, c, g, or t
  misc_feature (363)..(363): n is a, c, g, or t
  misc_feature (373)..(373): n is a, c, g, or t
  misc_feature (381)..(381): n is a, c, g, or t
  misc_feature (384)..(385): n is a, c, g, or t
  misc_feature (391)..(391): n is a, c, g, or t
  misc_feature (393)..(393): n is a, c, g, or t
  misc_feature (398)..(398): n is a, c, g, or t
  misc_feature (400)..(400): n is a, c, g, or t
  misc_feature (404)..(407): n is a, c, g, or t
  misc_feature (409)..(410): n is a, c, g, or t
  misc_feature (414)..(414): n is a, c, g, or t
  misc_feature (420)..(420): n is a, c, g, or t
  misc_feature (430)..(430): n is a, c, g, or t
  misc_feature (432)..(432): n is a, c, g, or t
  misc_feature (437)..(437): n is a, c, g, or t
  misc_feature (443)..(443): n is a, c, g, or t
  misc_feature (446)..(447): n is a, c, g, or t
  misc_feature (451)..(451): n is a, c, g, or t
  misc_feature (458)..(458): n is a, c, g, or t
  misc_feature (468)..(468): n is a, c, g, or t
  misc_feature (473)..(474): n is a, c, g, or t
  misc_feature (476)..(477): n is a, c, g, or t
  misc_feature (554)..(554): n is a, c, g, or t
ggaggggcctcgttcgagaatcnaagtggagtaaaagtnctgcntcaccaaggcccanaaaatgggtgagcagcangcatgggnatgaanaggcaagnaaantgnattgtgtnaannaagnaaaananagnanggnnannagcnantnaaanaanntgnannnaaaattannggatgaaaaannaaagnnatgnaagaagtaaaanagnacnggaggaaagtaaaaannaaaaaananggnaaaatgnaaaanttcnanaaaggnannaaanannaananaannnaaanaattngttnnannaagnanatggttnccttnaaaananaanaaaaaannnnaannnnncanatgnanaaaaaantgtgtttgtnaaatgaanaannattgtntnaaaananggannnnannaatngtgaanatgagtagtncncaatnaaaaanaannaaangtagganaagtggaatnaaaanngnntctactgggcaaatatggagagaaacgccattcatttaatggctgcaggagaaaatggagtaaatgcaacaccctcngatgctgcaagtgacaggtgggaaactggtgcagggaaatatcctgtgccatgtaggctgcaccagcctgggccctactgctctctaagtggccctaccaccattgtccttcatcgcccagagaggctggtctcagttccgcctgcagcaactatgttgatttgcttgtaacatgttttgtcctttttggatccattgtagattggccccaaaccagacactgggattgagtcaccaaaaaagtcctttctcttttgattcctgggtgtccagagtctgatggggggacttcttttcgtttcattttcatcattgtatattgcagcttctggtctacataaggattgctgagtttgtttgcactttaataaatagtccattaaaatgc

SEQ ID NO: 521917 - DNA, 81 bp, Homo sapiens
tcaagcttctaacgatgtacggggacatgtgtacctgtaatatttttccattcatatctcaaagtaaagtcattaacatca

SEQ ID NO: 521918 - DNA, 332 bp, Homo sapiens
tactgcacaaccatgaaaaagaataaaatcatgtctttgcagccacatggatgcagctgaagggaattatgcttagtgaattaacaccaggaaaagaaaatcgaataccacatgttctccactagataaagcaaatgtggtctttctgcatcatggaatactatgcagccatgaaaaagaataatatcatgtcctttgcagccacatggatgcagctgaaggacattatgcttagtgaattaatgccaggaacagaaaatgaaatactacatgtcctcaactggataaagcaaatgtggcccttctacaccacggaatactacacagtgatg

SEQ ID NO: 521919 - DNA, 105 bp, Homo sapiens
ccgccgatacctttaatgccgtacacgccctcagacgcgaccgtctatgccaaaccgtacgctgctggtttgcacccgcgcggttggcctatgatcgtccccctc

SEQ ID NO: 521920 - DNA, 151 bp, Homo sapiens
cccccctccccccgagcaccgcacgcagcaccgcgatcgctccgagtttcaggctcgaactaagctagcgccgttcgatcgatcgtcccattcagatcgtccatcattgattatctaccgggacctcatcagtccacgatgagaatgttct

SEQ ID NO: 521921 - DNA, 211 bp, Homo sapiens
agagggtgccttgggcacctctgggactcagaagtgaaagggggctatacctagtgatattgctatagcccttatgattattaatgatgatgtcttgattggtagatataggttatggttcatatgtccggagagtatattgttgaagaggatagctattagaagggactatggatgcggttgcttggcgcgtgacacactctccgcctta

SEQ ID NO: 521922 - DNA, 83 bp, Homo sapiens
gagattccagcagcatcatgctccaagcaggtaacggtgagagaaacagccagcatcaagaaggtcactcggaaactctgccg

SEQ ID NO: 521923 - DNA, 399 bp, Homo sapiens
caggcaactttttttttggagtttcagcttgcttcccacaggggcggggagtgtgaggtttattcccctttttaagacgatagaagttttcagcctaaaccgtattcctaggtaagcagctggattgcagttttgtcttggaaattttccttaatgactaaaagttaagattaacaactagctggttttaatttttccttacccttagaggaccccgtaatcccataaattttgccatcatctgtttatttagcttaactgtttttttttatttgttgaaggtggtggtggtatttcagtcttttttttattgggttggcccgacttggtaaaatttgtaaaaaagttccctaattatggggaagatttcctttgaattgggttaattcctgtagctga

SEQ ID NO: 521924 - DNA, 1025 bp, Homo sapiens
tgtgggtttgagcacagggtacttaattggatgggtacatgacaaggtgggggttccctaggcccctcccctcttcaaggggtcatacatgtggaaacgggtgaggaggggaaattcaggtggtgggtgggggacgtgagtgtggtggcagggactccccagcaggtgagggtctctctcttcctctggtgtgctctggcgtggggctgggtggtccaggggttcttatacctccttgggaggccatgtgtgtgggccagtgaggttccaccaccctgtgtgtggcgggtagccaaattccggtgggtcataccaggaaagtgaggttgtgaacaaaggggctcgtgtgagggcaatgtgccagccccacagggtctcaaagggtgggaggaggtggggtgctcgcgtgtggaagttcaggaggaagaaccaccggggggctccagggttagccccaggaagtgcccctggaaagggggggccctcggaagcgcccgtggttatcacacaacctttctttgaagtgctccactcaatattgggggacaggggttcttatcatagaagcgggccggtctcaggtttcccaccaaagggaacccgcttgtggccgtggggggaaccagcggaaaagggcccaggccaatggagacgcataccccggtaacaagcctcaggggagtgacccgtggcccccaacaggcttggggaaaggggcaaagaaaagaaaggcacgggacaagatggtcccggggaagaagcccccggggggcccatacaaaggccaacaaggttcccccgggagggggggcccaatcccaaagggtctctctgggggggggcaggagaatcgcgctttgggcacggggggcccatagaaaatccacttcccacaagaataccaaaaggttggggcaaggggaatagaccttgtggccccgcgggttggtcaaacgacacagttttggttcggttgaccacgagaagcctttcgcaggatgacactccgagaggatggggaccat

SEQ ID NO: 521925 - DNA, 327 bp, Homo sapiens
tactctaagatcggcacggatcgtgaatgtttgaagcagttgcactgtcacaagcgatacgacagtgtcatgagacacagaatcgaggagagaggagtgcgaaccattacatgtagcggcacgagggagatcagcgtgcaagctagtcgcagagtcaggtgcaccacagcatttacatcctcccagaccctacgtgtctcacggtggtgcagtggcccccgcactacagaagaacatgcgagcgagctcaggcgcgctggtggtggtttccgatacaactcccactcaaagaacccgtgtatccccggtcgaggggtaccgagctcg

SEQ ID NO: 521926 - DNA, 318 bp, Homo sapiens
  misc_feature (25)..(25): n is a, c, g, or t
  misc_feature (82)..(82): n is a, c, g, or t
  misc_feature (125)..(125): n is a, c, g, or t
  misc_feature (155)..(155): n is a, c, g, or t
  misc_feature (184)..(184): n is a, c, g, or t
  misc_feature (225)..(225): n is a, c, g, or t
acaaaggaaaagaagcccaaaactncaaaaggctgcttaactggattcccttccatatttatcccaaaaagccaaaacaatngggatggagaaaaaaacttccagtggatgtccaggggttaagnttgggaatgccccttgactacaaagtggtngcctggaggaatttgtctttaataattgnaaattttcccgtgtctttattgtagttacataagtatatgncatttgtccaaaacccataggcttgtacactaaaaaggatgaattttactgtgtgtaatttttttaaataaatgttatttttatggaggaaag

SEQ ID NO: 521927 - DNA, 165 bp, Homo sapiens
aaaaactcaggatcgtagttccctcaaaggacaccagaggtgaaggacaaccaggaggttgtcttcaactgtgaggtcaatactgaagggtcccaaagccaaatggttcagaaatgaggagctatatttgatagtccaaatacatcatctcccaaaggcctaggt

SEQ ID NO: 521928 - DNA, 395 bp, Homo sapiens
agtgtgtgtccaaaggtgattggaagatgtgttgtgtgagccaatgttcctagtagctgagttgagatgagtatggaaaggatggaagatcacgcggggtcttatgggccacattgagtaccttggtttttcctgcgaggtgccagccacagaagggcctgaacagagccaggacaggatgaaatgtgagcagcgttggcatacaacctgtgcagtggttccatgtgccgttagggggtgctaaagctggtgttaagatcattcccaagaactatactgataatgaattggaagagatcactaaggaggttcaccatgaagctagcacaagagggctttatcggtcctggcattcatgtgcctgctccagacatccgctcaggtcagcgggagat

SEQ ID NO: 521929 - DNA, 325 bp, Homo sapiens
atctaaaggatcccctgatcttccgtcccaatgcaaccataaatatcattttttaaaattattataatttcaaaaacagggggtcactctgacgcccaggctgaattgcagtggcataatctcagctcactgcagtgatcttcgtgcacatacctatggctctggcatttacatggctctatagattcttactcaacatcccttaaaatttttttttattctgatataagagcgggatgctcttccaacaagaagatgagaagagaacaaaagactcctccaatatattaaaaatatggtagtcggggccgggcacggaatatga

SEQ ID NO: 521930 - DNA, 356 bp, Homo sapiens
tagtggtggaggggtcaaaaacgggaagctttggccctggtttccaaacagcggctcaaccagaagagccagtttttccaaaaatgagctggatatttgtgagccccccagcatgtgcaggccgtggggtgaccttaggccaatgcccgaggttgggaggccccagtcaagggaaatggggcccatggaaaacatgttttcgccccctgaacccagcgctgggatgaggactttggagttgtgttgagacctccaaactcaggctttagggtcagaccagggttgttttacccgcccttcccatttgggcattcctgccccctcccatggagtaggaatgaaccctggtttgagca

SEQ ID NO: 521931 - DNA, 649 bp, Homo sapiens
  misc_feature (23)..(23): n is a, c, g, or t
  misc_feature (29)..(29): n is a, c, g, or t
  misc_feature (31)..(31): n is a, c, g, or t
  misc_feature (78)..(78): n is a, c, g, or t
  misc_feature (643)..(644): n is a, c, g, or t
cttcgtttgggcattcggcgcgnccgtgngngggccccaccgaaatccgcccattatgcccggggcccaacttttctnaccggaggagagagccgactaatacactcctcttgccccacgtcacaggaaaaaaccggacatcaaggcccgtcacccatggcctggaaccccttctgagagctgacccacgaccaacaaccaagaaagcctctcgcacttaaggacgcccattcctcatttaacacaagaggggaccgaaccaccgagccccaatcccaaggtcaaaagcccacacactccctgcgaactccataacccggcgcttcccccagggcaaactcctcaccaaagacaagcccactcaaaaaaacaaagatcggtgcataatgaagggatcgaccgaaaaccacaaatttgtaaaaacacaaaggagagcttctacgagaccaaggaaaccatatagcctcccattgagggacgaaacggccctaaaaaaaacgcaagggacgggaacaacccaatgggcgcaaacgaaaaaaaaaaaaacacctcaaccaaagatcttaaccgaaatcccaaaccctgccccccggagcccccattgacttagtctccccggtcaccccatcaagcccaccccctnnaaaaa

SEQ ID NO: 521932 - DNA, 425 bp, Homo sapiens
  misc_feature (192)..(192): n is a, c, g, or t
  misc_feature (223)..(223): n is a, c, g, or t
  misc_feature (372)..(372): n is a, c, g, or t
gacggactccccggtgttatcgactgccacctctgacggggtacgcattactggactactgacttctacgacaactggtgacttcagcggtggctggacgacggtgtgacacacgacgactggacgacgtgactacagaccgtgttactggtcaacgacgttacgacgacggggtggactcactgcacgggntctgtgtaaacccacttactacaacgacctnttgggtttttacctcctgacatgacgactaggacagccactcacgacacggtgctgacgcccgacgaccgtgaccaacaccttggaccgtgctatgttgacacgacgcacacggtgacacgtcagacgacacccctctttacggaccgnctactttcacgacaacttccagaccacgacggtgactacgtgactcttcaacc

SEQ ID NO: 521933 - DNA, 420 bp, Homo sapiens
  misc_feature (420)..(420): n is a, c, g, or t
catggtaccttccaagtacgcctataatcccagtacttgtaaggccgaggcgggtggatcacccgaggtcaggagttcgagagcagcctggccaacatggtgaaacctcatctctactaaaactacaaaaattagctggacgtggtggtaggcacctgtaatcccagctactcgggaggcagaggcaggagaattgcttgaacctgggaggcagaggttgcagtgagccaagattgtgccactgcactccagcctggctgacagaacgagactgtttcaaaaaaacagtcaaagagacagggtgttgctatgttgcccatgttggtcttggactattggcctcaagcaatcctcccactttggcctcccgggctgggattacaagcctgagccaccacacccccgcctgtaaccagtctn

SEQ ID NO: 521934 - DNA, 116 bp, Homo sapiens
aggtcaaagcagggcatgggttggcagggtgggcgtttggggccctatatgttggcttttccccccagaggacacaggcagcttccaaaatatatttatcttcttctcgggaaaaa

SEQ ID NO: 521935 - DNA, 91 bp, Homo sapiens
tggtcggtttcgttcgtctcgatcgtgcgttctgttagagaactccagttctacctctccctcgacccagattttctccctcgtctaatcc

SEQ ID NO: 521936 - DNA, 483 bp, Homo sapiens
ctgtgtccaggcttgattgcagtgacagaacctacgttcactgaggcgcttaagactaccaagcataagcgatagcacatggctcagcctactgagaagatgaagatacaagcgcatgccagacacacccatttaaaaatcgtgataagggctgaggcacgtgtaaaccatgctggccaggatgagcgagagctcctgaccatgagatccgtccacgtaggtcgttcaatgacttgtaatacacgtgagaaccagcactaccgaacgcaccctatacatacatgtgcacatggcatggtgaatctcatgctgggagtggcgagctctgcaatgactagcaccacaacagggccaatctttaagcggagaataactctaaatttatgcgcgacggaactccaaatccaatcaattgagaccaccagcagtgatgtattcgaattatccagccactgcggcatcactccatgtagacagagtctt

SEQ ID NO: 521937 - DNA, 313 bp, Homo sapiens
ctgggctggacgagggctgggctggggaagagggctggctggggaagagggctgggccggggaacagggcaccactgagggggtcttggaggagcctatgccatgtccatcgcacctcctgggtgaagctcctgaggacctggccacaagtggggtgccatggaccactgtgcctcctgcctggcggacgcctctgggagtgaggaagacggaggacggggggagaagaatttcctctctgtggcctgtgtgtgcggcgttcacattctctctcagatcttccaggactgtccctctcttccccatgcccagg

SEQ ID NO: 521938 - DNA, 750 bp, Homo sapiens
cgtcgcgagcccctctgctcatcgctcgttaccccctcaggcccttggcgcttggagctcaggcccagtcgttcctctgtctacaaatccaatggaaccgtgccctccctgaatcccacgtttaggaagaggaggaaggacgcccctctctgcttggagtggaagaggtgcatacccgaactctggagtctccgcgaggccccccattcactactctcacggcaagcccacgcgtacatatcgaggaccgacggtactctccagacggaagcgtccctgagaccttgcagagtacgttagcggaggggtcgggacgagcacgatcgcggagtggataccgacctggccgagcataggtagcctcggctcgggtcgtcgcaagaatcacgagttcttgtctgtgacaggtgtagagcgttctgaagcgcggcaggtaaacacttctccgtatcgtgcactcgataaaccgtgtagaaccgtattttaggatacacctttgcttggtaccaacgactgggtgtatgcgacccggttctgggcaaagggtggccgtatcggtgcgcgaagacaagaaagattaaccaaacattttatcaacctaaccccacgactaagggtatttcgcacatcagcctttgtcaagccccttgttagactctcccaggcagacacgtgggtcggttaaaccggcctgttgggaccccccaatgaccctaacaacagacctttgttaaaaccccgggtggttga

SEQ ID NO: 521939 - DNA, 152 bp, Homo sapiens
ggtgaggtcggagtcaacggatttggtcgtattggcgcctggtcaccaggcttgcttttaacctctggtaaagtggatattgtgccatcaatgacccttccattgaacctcaactaccatggttttacaagttcccatatgattcaccatgg

SEQ ID NO: 521940 - DNA, 232 bp, Homo sapiens
  misc_feature (138)..(138): n is a, c, g, or t
  misc_feature (144)..(144): n is a, c, g, or t
  misc_feature (148)..(148): n is a, c, g, or t
cagtcggacatttgccgacgtaatcgtccagcggttgggtcacgttgagctcgcggtgcacggtgccgacggctgggggttaagcgggtcgcccaccagccgaatcggctcacggggaatgcccaggccgatggcganctcagngcanagcggcacgaagtcgaaataatcggcgagggtctggctgcacagttgagattgtttgtgcccgccgttgaagcgcacgttctcg

SEQ ID NO: 521941 - DNA, 240 bp, Homo sapiens
gtgatctagaggatcccgtcatttctacactagtcacagttccagaaatcaaaactgttagcagatgatgtgattgcaaggtttggttgcttctactaataaatcagattgcttatttgtctaacgaatgttattagccaaacttgtgatacttggacacattacaagttttagctcaccgttactattatcaaatgttgaacagatgacgatcttgctatttgtgtgtagacacttgaa

SEQ ID NO: 521942 - DNA, 1588 bp, Homo sapiens
ggaacaagatccttagctacaagattggcaaatgagatgcagaatgctgtaagatgacacattgcatgaccggactcatttcagggtctttgcgttaaaacaatcattgcaaaagtattctgaactggtcaagctgcccagtcagatgggctgttgccatttagaatcactgtaattaattagttgatgcagagcacgagagcttcaggctaatcaaccatgtcatttgtcccatggagttgggtcctcaacgagcgatggcaacaatccagtctcagtttcaacatggtctttctggttcaggcctttcatttcttaacaatggcacagcagcatgattcttctaagtttaatgggttacacaagttcttgaagtgtctcaaaaatattttacctaactgtaaccctaaaattgatgtctttgggtttatgacactcaagtaacttttcgatatttccccagttctttttaatgcggtcaactcactggaccttctagtttacaggtggttgatggcatttagcaataattattgctggtaaaggacagtgtctaccttttcttcctcacctggttccatttatgtaacggtgcagattagaggacagccaatttgctataatccacggtgtttcaccttcaagaacgggtacttaagtagctacaggtggccacaatttcttaacaggcagctcaagggttgacactggaaggcaccctctttcgcaagcctaaggggtctcgcggcacgcacacgggatccagtcgcggttatatacacgccaggtttacgcgggataatcatcagcagcggcgatctgtgtgcgactgccgtcacttattgtgtcttatctataattctcgcaatcagcattattcggcaccaccgactagcgacgcaacacacaacagcagagcacgacaacagcaccgcgcagggcgcgggggggggaggacacaacgaaggagacaggacaagggaggaggggggagcgagcgcagaacagcggcgcaaaagagcgcagaagccgggactagaccgcggaacagcgcaacaacgacgggaggagagccggaaggagaagaaaaggaccgggagcaggcgagagaggagcggaggacgacaaagcgacaggcaaagagaaagagcgggaggacgtagggacggacggcgagacgagcgacaagacaagggaacgagaaaccggcaaccgggacgagagaagaggaagcgagaggcgcccgcggcgcgaggacacacgaacagggaccagaacagcaccgaccagcgacgccagcaacacaaggagcagcgggggccgcagaaggagccgagggaacgcgacagaacgcacgcggcggagggaccgcgggcaagacaggaccgcacagggcagcggcgatgaagcggagacaagcgcgcaggcagcgaacagggacggcagcgagacaagagcgcagagcaggacacgagtaaaggacaacacgcaagagagagggaggaggggacagcgagagggcaccagagaggcggcgaagcccgagacggagccgcctcgccaagagcgcgggaacgcgacgagagga

SEQ ID NO: 521943 - DNA, 222 bp, Homo sapiens
ctcctggactcaggcagtcctcccatctcggcctcccaaagtgctgggattgcacgtgtgagccaccatgcctggcctcattgatttttaaagtaggacaaggtaaagatctaacccccaagccaggtgtggtggctcacggctgtggtcccggcactttgggaggctgagatgggcggttcacctgaggtcagcctgggcgacagagggagactccatctc

SEQ ID NO: 521944 - DNA, 745 bp, Homo sapiens
  misc_feature (653)..(653): n is a, c, g, or t
  misc_feature (680)..(680): n is a, c, g, or t
  misc_feature (720)..(720): n is a, c, g, or t
agcgggacagaatctgcggtgctctgctggcgactggcaggacgcggtgcagagagcggacttccgcgacgcgggttttttttttttacttgaatgtaaataccaatcaagatacattgaaataagaaggtcctacagtgtaggggaagcaatggaagaacttctacctgatggacaaatatgggctaatatggatccagaagaacgaatgtggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtcacagttccaggaagacaaggaatcttcattggatgtttcacaaaaatttaacctaccacatgaataccagggaatttctcaagatcagntcattggctctctacaaagagaagganggggctctccagttacgaacaagacctgatggttgccagnagacccaagtcctttattctcccaa

SEQ ID NO: 521945 - DNA, 273 bp, Homo sapiens
tatggagtacctggtgtatcaccacgaggtcattgcattgtgagatcagcctagccaagatggtgaaaccccgtgtctccagaagaatgcaaacattaagcgtgcatggtagcaggtgcctgtaatcccagctactagggaggctgcgtgcaggagaattgcttgaacccaggaggcagaggttgtcagttagccatgattgcaccagctgcaactccagcctatgtgacagaggcaagactctcatctcacaataaaaaaaaacatgaaaac

SEQ ID NO: 521946 - DNA, 200 bp, Homo sapiens
  misc_feature (173)..(173): n is a, c, g, or t
gggaatggccaggatgcagttgttactattgggacaaatgacactgaggcctttggggttatcgcacgtttcgaatacgtgcaattcatgggtattgtgtgtcaatgtcaacatcttaatcatggagtccaataaccaccattattctatcttgccgcatcttgactgtcttnacttctttataaaattctttttcgcta

SEQ ID NO: 521947 - DNA, 824 bp, Homo sapiens
tctttctaaggaaaaggaactattttgcttccacttgtatttaatagatcttccctgttctctttttgtcatttatctattattgcatttgaactaggcaacaatcacaaaacctcaggagtgtaaaacaagtgttcattgctcatgcatctgagatggctgaattggtggctctgctgaggttggccaaggtgatgggatgtgggactgctccacatacctctcttactctggttggcaatgccaggcatgtgctcatgcttcccaattccttctgctgtcacctatgagatgttgtttctggactattcattttgtcagtatttcttcctaaaatgtgtactcagacctgtacaaccttcctctaggtgtggtctaaccagtaaaaactgcaggggaaccattatttcctatcctctggacacactgcttctattagttattaatttaggttagttattaatttaggctgagatggcattagcttacttagcagatgaattgcacagttggccctcttctcacattaagcttgagaaaaataaaacttctcagatttttctccatatatactgctgccaagtctcatccatcctgtgaaaaaaaaaaattgtctttcatgcctagtccttgaaccgtgtcaattgggttttgtaaagggtctttgaagtatgtcttgaattaactaagttcattcattcattccataaatatttatcatgtccctattaggtgtcgagcactgtgcagggaacaagacatgaacatagtccttggtcttgtagaatttgtgctctacttgcagaagggtaggggggtccgct

SEQ ID NO: 521948 - DNA, 112 bp, Homo sapiens
tcggccgcctactactactactgctcgaattcaagcttctaacgatgtacggggacatgatccttgctgataaatataaccatcaataaagaagcattcttttccaaaaaaa

SEQ ID NO: 521949 - DNA, 515 bp, Homo sapiens
atgtgtcctatgccaaatagagtttttcttttttaacccaatgggtcaaacagaagggggtggggggcttataccctgtacaccccccaatcaatccatcccactatcacactttaaaacacattgaccgaaaaaaaatttacaactaccttttttttaactgttttcaacactatcactggttatccccctactaccccccacccccaaaaagacatacgttaccttttacttcgattaatggacttaacaatttcaaacacaccataaatttaatcccctcataaaatataataacttgtccgtttttaacaatgtcccaacttacacaaattccaaaaatccaccttttccaatttccgatttgtggagttcatcgcccgattgctttgtttcaaacacacccattttcttattacccttttaacaaccagcccaatctctgaattataaaattagggacttttacagtaaattttttcctaaatggaagccgtaaggcgctgcatccttaa

SEQ ID NO: 521950 - DNA, 1028 bp, Homo sapiens
  misc_feature (507)..(507): n is a, c, g, or t
gaaatgcctgaaccgcaggtacatacttgctatactacaacctagtaggctctcttcccctatcttcatcgaactgatggacactcagaagaccctatgctcattatacatggtatctactcatctctcactgtccttggtaactatcaaacttccgtgagaccaacgaacttatattagtgatctagtctgatcatcgagattatgcttctaattaagttatacaggattagccctcttcctaacgggatctcctaccgttgatgaagcctccactaatagtcactcattgctcggaagggccaccacgaatcgtatgaggatcacagtaagctatcattgccagccagtctcagctcattcaaataaactcagtgccgggtcattactcgcgctaaatagagtagctgccacatacgatcaatcttcaagtttcgtacaatacgccccacctgcatcacaaacaggaacagtaagactcattagcacacacttgtactcctttgnttagctaagttcgccttcattggaagcgccattagagtatattaaatcatatgtctttctcaattcatcgccgctaagcgagcgacacatcgaagcatcgcgtacataagttcgtccttcatatgacataactcctttcaaatcaatcgcacaacttagccgcatcgctgattcatccagtcagttgctcaatctataaaacccacttggacagccttcactcagggagcatgtcaattttcgtccattaaatcagcgcccgagcggtacatttacactccgcattctatttcacctattttcctgcacgtgagtcaaaactctaaaaactcaccgaaaacctgaccgctcaacaagttccgaccatttcatatattccatcattcttccatcgggactttcaaaaacttcatgtttcccctacctcaataagcttttttttgattgaacttctaagcaaagccctcgcattaaaccattcgcctttaacccccagtaattgaaccctactggggaggaac

SEQ ID NO: 521951 - DNA, 489 bp, Homo sapiens
ggcctggtttgttcaaggaactggagggcaagaaaatcaggagccaattcatgcagggcacagttagccaaggcaggaggcaatcatgctcaccctcttccacagccggactcactcaggaggcccttcatcttcatgttccccacatagcagaggggagggcagaagatgagagggaggagagagcagagccaagagcctccttttctcccactgtgcccctcctatgtgtggctctggacaccaggaaccacccaaggacagtgggactcctcgaaaagataattgctcatgagggatccaagagcaaggcttgttacatcctataaccttcacacaaaatattgactgagaatcctccatgtgccaagtactgttcaaaaacactgggaacccagcagggatgagccacaagtttccttgtctttacgaagctttcattctgagggagtggagagagacaagcaataaacaaccaatcaaaacaaa

SEQ ID NO: 521952 - DNA, 454 bp, Homo sapiens
  misc_feature (121)..(121): n is a, c, g, or t
agtaaggactgggtcaagcacctgacaaccagagctcgtccgtggcttcacttgttttggactaaggagctgaggagcgtgcaagactgtacttggagaatctgtttcttgctgccatttngtcactgaacactattttttttctccttctttttttgtaagaaaaggagaacacataaaaccccaccagaacaaactccactcggccctgaaagtatttacaatcacggccctgaaagtactgaaagtatttacaatcacgttacagttcattcactgctgcagaacctctctccagcgatcaaggtcgaagggagccgacgtcgccctctatcggctccctgctgcactagaagttctggatgtcagaggtccaacttgagtctcactgggctgatgtcaagaagcctgcagagctgctttcttcctggaggctctaggagagattccgttt

SEQ ID NO: 521953 - DNA, 1113 bp, Homo sapiens
  misc_feature (736)..(736): n is a, c, g, or t
  misc_feature (1113)..(1113): n is a, c, g, or t
gctggtagaagacaagcctctctaatgctatcgttgcatgaccccagtagggtcctgtgtgggtgtggcagatggccaagtgagaatcacggcagcccccgggtaggcagagcgtcccatgttggagtcactccaccatggtacctccgaatccatgagcctagccctgttctccaaagtcaatccgcctggttcaggacctccgcagaggagctggtgcatgcagagctggtgagaagtgctggagccggagggcagaatcgtccctagtagttcaaccgattcagcaatccatggtccctgtgcgtgcagcatgaccgtagcgtggggcgagcacgatgctgaatttcgagacgcctttggggcatgaatgcggagccgaacgtgcgcccaagactcatagcttgagtggaaaactcgcccgtgctgagaagcaagcccagaaatgcgggagcctctcgtgacgtaggcatggcaacgtcgggccatggtgtgaaggaatgctccaaggacttgagaacttccatgtgacgagcctcacaggacgcaagtctggctgtcccgctaggacgttccccctcaggttagtccccagggacaacgccgcaataagactggtaagaagtagtgcgtggataacagttgccaccgtggaaagactacagagcaagacattgcacggttctcacttaggaaccacacttgcaggttgcgtacctgggagaccacttgggancaatattctcaaagaaggccaatactggctgttgggtcagttcagacgacaaccctgggggcggccccctttccaggaaagcgcttgcattgttgcccccggctaagttccccggatagaagtgggtagacttgggcatgccctgcgttccttccaaagggttacaaatatcccttagaacatgactttcaggggacagggcaccgtacatcggagcgccagccatggatgagccacgcccaagcgcatacgccaaagggagccaattgggaccgcgcctcctagccggggcaaggttctatatgcaaaaccccgagttggggaaattgcctgcggaagcatgtcgaaaggggtggcggtaaagaaccaaccaaggn

SEQ ID NO: 521954 - DNA, 504 bp, Homo sapiens
  misc_feature (121)..(121): n is a, c, g, or t
agtaaggactgggtcaagcacctgacaaccagagctcgtccgtggcttcacttgttttggactaaggagctgaggagcgtgcaagactgtacttggagaatctgtttcttgctgccatttngtcactgaacactattttttttctccttctttttttgtaagaaaaggagaacacataaaaccccaccagaacaaactccactcggccctgaaagtatttacaatcacggccctgaaagtactgaaagtatttacaatcacgttacagttcattcactgctgcagaacctctctccagcgatcaaggtcgaagggagccgacgtcgccctctatcggctccctgctgcactagaagatattgactgagaatcctccatgtgccaagtactgttcaaaaacactgggaacccagcagggatgagccacaagtttccttgtctttacgaagctttcattctgagggagtggagagagacaagcaataaacaaccaatcaaaacaaa

SEQ ID NO: 521955 - DNA, 975 bp, Homo sapiens
  misc_feature (122)..(122): n is a, c, g, or t
gcactgttcttcacaaatagtttgacgccgtgcttatatacaaggtccgactggcgtctctcaaaaccttgggcagtgaacgcgttttttcacggggcgccttaagctttttttgaagcctntttcgggtctattgtgccttgtgccagcgtcagttagttcccctcctggggaatgtataggagttccctctgatccttggcgtgggtgccgcccttgtgattacccttattggggggcaaccgctgtttcgcgccccctctgtgacccccgcccctcgttctcagggggttttattcacggtgggcccccttggctgctgtaaccctcttgcgtgtttggcagtttcttgcccggaactaatttatctgacgctgcttcctgcctcgtggccgcaactgtgtgttggccccccccctactgtcgctcgcccgtctcgatgcttaccaaatgggtttggtggtgtcgcgctctagggcttttttttcggccgccaaatgtggtgagataacatttgggtattattaggaagcccccctctgttctacatggggggctgagaacacaccttctcgcgttgtcggcggtcttcttatatatgggcgccagaacgccccgcccacgtgggggttctctttcctacccggcgattgtagcctgtttttttttctctgtgaaacacacttcggggacactgaattgtcaaaccccgcggtcgtttccctcgggaaagttatttataaccctcgctgggtgagacataatagaagttcaaattatgtttttttttccccacagtcttgtagcgtgttatactcttgtaataatttcacgtatataaacgcgcggagtatccctgcccctgttgagaatttcacgaacaggtcatctttcccccaacgccctgtgttacttttcatgtcattggcccttcccactttcaaaataaaaacccatttccggaccaacaaaaca

SEQ ID NO: 521956 - DNA, 817 bp, Homo sapiens
aacggctagggtacgaggctgggtttaaattcggccgaggcgcggtgccggcttatggcggagaggctggcggtgggctccctggggtgtgtgagcccggtgatggagccgggcccgacagccgcgcagcggaggtgttcgttgcctgccgtggctgccgctggggctgctgctgtggtcggggctggccctgggcgcgctccccttctggcagcagtcctgcacatgtggtcttccacgacctcctgtctggagcatgcatgtttgctggatggttggagtgacttgtccctgtccctcctgcagtggtggatgtggctggggcctctgtctgcttgccccctgtgaccttgcctggatcttggatcctgagtgcctgggagctcctgctggacttctgccaacagcatgcgcagatgcttgacagtggtgtcttggttgctgcatgcgcccggcccgtgctgcctctgtcagacctgctaccccctcttccaacatggtcgtcagcaagatggacaacatcagcctgagccgcggggaatacttcagagagtcagagtttgttgccagaaggtctcttaatgtgcagatagaattgcaaatagtatgtgattctctcagaattttttaataccacatgcaggaggcaaatttgtgccaatttgtttaacaaacaacagtgaagattatcaaacagcacagaatatttccttagtctatttaatcacaccctgaactgctttgaaaataacttcaggggaatgcccatatctttacggaccaaacattttccgagtttgcaaaatgccgtaacaac

SEQ ID NO: 521957 - DNA, 702 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (16)..(18): n is a, c, g, or t
  misc_feature (23)..(23): n is a, c, g, or t
  misc_feature (40)..(40): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (76)..(76): n is a, c, g, or t
  misc_feature (89)..(89): n is a, c, g, or t
  misc_feature (93)..(93): n is a, c, g, or t
  misc_feature (97)..(97): n is a, c, g, or t
  misc_feature (557)..(557): n is a, c, g, or t
anctcnccnttntggnnnccaangatccagtggctcaagnatgctcaggggctncntgnagggggtggggggacancagtgggactctnaganatgnccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacactgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaangcactcaaatctgcctccactgacctggggacagcagatgttgtcctggggcgggtgctggaggtgacagatctccctgagggcatcacccgtatctgagcgcggacgaactcttcacgctattgtacaacggggggccaggtta

SEQ ID NO: 521958 - DNA, 211 bp, Homo sapiens
  misc_feature (78)..(78): n is a, c, g, or t
accatagaggatttcccaggcgcttgttgggagagcggcactccttggtttagagctagtgtatgaaatccattttgntggttggtttttaacccaaactcagtgcatatttttaaaatagttaagaatccaagtcgagaacacttgaaacacacagaaagggagaccccgccttagcatagtatttgcagttaacggcctggattgccag

SEQ ID NO: 521959 - DNA, 458 bp, Homo sapiens
  misc_feature (32)..(32): n is a, c, g, or t
  misc_feature (40)..(40): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (62)..(62): n is a, c, g, or t
  misc_feature (64)..(64): n is a, c, g, or t
  misc_feature (89)..(89): n is a, c, g, or t
  misc_feature (100)..(100): n is a, c, g, or t
ccctgatcgcagcctgctgagcatatcaccgnatgctatnacaccgngnagctgcntatttngngatggaccacaatgttgatcaaacngggaaagctgncatcatcaacaaaactagtaacacaagaatccctgaacagaggttctcagaacatataaaggatgagaagaatacagaatttcaacagaggttcattctcaagagagatgatgccagtatggaccgagatgataaccagatcagagttccattgcaggatggaaggaggagcaagtcaatagaagagagagaggaggaatatcaaagggtccgagagagaatatttgcccgagagactggccagaacggatatctaaatgacatctgactctccgtagaagcattttcttctagctctcaccagagatagtctagatttatagcgggtaccgtgaatgatctgagcgtgcacctttaa

SEQ ID NO: 521960 - DNA, 1538 bp, Homo sapiens
  misc_feature (2)..(2): n is a, c, g, or t
  misc_feature (6)..(6): n is a, c, g, or t
  misc_feature (9)..(9): n is a, c, g, or t
  misc_feature (12)..(12): n is a, c, g, or t
  misc_feature (16)..(18): n is a, c, g, or t
  misc_feature (23)..(23): n is a, c, g, or t
  misc_feature (40)..(40): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (76)..(76): n is a, c, g, or t
  misc_feature (89)..(89): n is a, c, g, or t
  misc_feature (93)..(93): n is a, c, g, or t
  misc_feature (97)..(97): n is a, c, g, or t
anctcnccnttntggnnnccaangatccagtggctcaagnatgctcaggggctncntgnagggggtggggggacancagtgggactctnaganatgnccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttcttttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggctcaaactcctgacctcaggtgatccacctgccttggccttccagagtgctgggattacaggcgtgacgactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggacaacaaataaagaaacaaacaaaaaaatttttcggccggatgggcccaagaaaaagcttccacacacactccgtggggcgcggggccacagtggacagcgccagcggccaaaccggtcccaagaacaccgggcaccagaaaggcccggggtttccccagataaaagcccgcggggaccgcgcgcgttgaacaatcccgagcgaaccgaggcgacaagggggtccaaccggggcacacgggcgaaaagcaggcgcgcaggcacga

SEQ ID NO: 521961 - DNA, 2233 bp, Homo sapiens
  misc_feature (32)..(32): n is a, c, g, or t
  misc_feature (40)..(40): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (62)..(62): n is a, c, g, or t
  misc_feature (64)..(64): n is a, c, g, or t
  misc_feature (89)..(89): n is a, c, g, or t
  misc_feature (100)..(100): n is a, c, g, or t
  misc_feature (1475)..(1475): n is a, c, g, or t
  misc_feature (1486)..(1486): n is a, c, g, or t
  misc_feature (2088)..(2088): n is a, c, g, or t
ccctgatcgcagcctgctgagcatatcaccgnatgctatnacaccgngnagctgcntatttngngatggaccacaatgttgatcaaacngggaaagctgncatcatcaacaaaactagtaacacaagaatccctgaacagaggttctcagaacatataaaggatgagaagaatacagaatttcaacagaggttcattctcaagagagatgatgccagtatggaccgagatgataaccagatcagagttccattgcaggatggaaggaggagcaagtcaatagaagagagagaggaggaatatcaaagggtccgagagagaatatttgcccgagagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggttnctgcaaccccntggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccaggcagacattctgatgcaaggcagtcaatgttgtttacatgggatgagagtcgtctttcaaatgttgaagggacagagtggactgaagcatggaaaccggggcaagagacaangcactcaaatctgcctccactgacctggggacagcagatgttgtcctggggcgggtgctggaggtgacagatctccctgagggcatcacccgtatctgagcgcggacgaactcttcacgctattgtacaacggggggccaggtta

SEQ ID NO: 521962 - DNA, 693 bp, Homo sapiens
  misc_feature (80)..(80): n is a, c, g, or t
caggaacttggagaaaaattttcaatcttcctaaccttgaataataagctttccaactggtgaaagtattaaaatgtgcntgagtgtctttttcttccattaagattattgggcacagtctgaacctatttctcttgcatggttaaagataaatttcaaaactgaataaatttgattctatttgatgttccaggttggtgtggtgagaaaccagaattactcttatcatgggcttggcataagcatagtgtcatataggcttgtttcattacattattgaaggtaggtctttaaagtagtgacattatggattttcatgaaataaaagatttttcattggagatactaagaaacttaaatctctatagtggtagcccctttttaaaaatcatctggctgggcatggtggttcacacctgtaatcccagcactttgggcggccaaggtgggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccagcagggcaaggctgcagtgagctgtgaccatgccactgcactccagcctgggagacagagggagacctcgtctcaaaaaaa

SEQ ID NO: 521963 - DNA, 2164 bp, Homo sapiens
  misc_feature (32)..(32): n is a, c, g, or t
  misc_feature (40)..(40): n is a, c, g, or t
  misc_feature (47)..(47): n is a, c, g, or t
  misc_feature (49)..(49): n is a, c, g, or t
  misc_feature (56)..(56): n is a, c, g, or t
  misc_feature (62)..(62): n is a, c, g, or t
  misc_feature (64)..(64): n is a, c, g, or t
  misc_feature (89)..(89): n is a, c, g, or t
  misc_feature (100)..(100): n is a, c, g, or t
  misc_feature (1475)..(1475): n is a, c, g, or t
  misc_feature (1486)..(1486): n is a, c, g, or t
  misc_feature (2019)..(2019): n is a, c, g, or t
ccctgatcgcagcctgctgagcatatcaccgnatgctatnacaccgngnagctgcntatttngngatggaccacaatgttgatcaaacngggaaagctgncatcatcaacaaaactagtaacacaagaatccctgaacagaggttctcagaacatataaaggatgagaagaatacagaatttcaacagaggttcattctcaagagagatgatgccagtatggaccgagatgataaccagatcagagttccattgcaggatggaaggaggagcaagtcaatagaagagagagaggaggaatatcaaagggtccgagagagaatatttgcccgagagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggttnctgcaaccccntggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaangcactcaaatctgcctccactgacctggggacagcagatgttgtcctggggcgggtgctggaggtgacagatctccctgagggcatcacccgtatctgagcgcggacgaactcttcacgctattgtacaacggggggccaggtta

SEQ ID NO: 521964 - DNA, 994 bp, Homo sapiens
agcggaggggggatcacgcctaggctggagcgccgtggtacagtcttgactcactgcaattctgcctcctgggttcaggtgattctcctgcctcagcctcccaagtagctggcactacagacacgcgccaccatgcccggctaatttttgtatttttagtagagacggagtttcaccatgttggccaggctggctcaaactcctgacctcaggtgatccacctgccttggccttccagagtgctgggattacaggcgtgacgactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggacaacaaataaagaaacaaacaaaaaaatttttcggccggatgggcccaagaaaaagcttccacacacactccgtggggcgcggggccacagtggacagcgccagcggccaaaccggtcccaagaacaccgggcaccagaaaggcccggggtttccccagataaaagcccgcggggaccgcgcgcgttgaacaatcccgagcgaaccgaggcgacaagggggtccaaccggggcacacgggcgaaaagcaggcgcgcaggcacga

SEQ ID NO: 521965 - DNA, 838 bp, Homo sapiens
  misc_feature (330)..(330): n is a, c, g, or t
  misc_feature (456)..(456): n is a, c, g, or t
  misc_feature (484)..(484): n is a, c, g, or t
  misc_feature (633)..(633): n is a, c, g, or t
  misc_feature (644)..(644): n is a, c, g, or t
  misc_feature (750)..(750): n is a, c, g, or t
cttgtagatatgccctctaatctttcttcgcttttctctggactttggtcccggattactatagcacccccacaaatgaccgccattggaacaggaccccaaccacaatggagaagtggaagaccactgaggagtcatcgcagtcgggagggatccatccttcctcacattgacactggagctcatggtcacacacagcatgtcctttgcacttagatgagcaattggttgatttgtaggctttctcaatatccacacattctgcattaatgcaaaccttgttatcgccacacttagttccattggccaccatgcctatttcttgacttntgtcttcaggatcaaatgttttacatgtcaggaaagtcactatccgtcctttccagggcaaattatccgacccaccttgacagaacaacttcccacacatggtatcactgaggaaaaagccaaatntattgcaggattcaaattgcagttttanataaatgctctaggactatggatatttaactgatggtatttttccctgtagccgagactcttagttgtactttacactcattttcccttatttctcagtaataggatgcctgaacgttagcacaatatattattgctcaaataaacagnattacctaganccctgtacacctaatttttgccagttgccgaagtgctggcccatgagaagaaaacagaatcttaagcacaattctagaaggtggccttaaatgaggaattatcttntatttctcaacattttctcattttttgcctgattggagtatgatagctagagaagctatcataggcctagagaaacacatggaaatga

SEQ ID NO: 521966 - DNA, 826 bp, Homo sapiens
accaaatggcggatgacgccggtgcagcgggggggcccgggggccctggtggccctgggatggggaaccgaggtgtgcttccgcgtgaggtttcggcagtggcatccgggggccggtggtctgcggccgtgtgactgggccggggccgtatggccgtggagtctcgcggagtgcaaggccgaggataggagtggatgccctgtcaccaatgttggggcgcgcttggtcaatgacatgaagatcaagtccctggcagtgagatctatctcttctccctgcccattaaggaatcagagatcattgatttcttactgggggcctctctcaaggatgaggtccctgacagattatgccagtgcatgaagcaagacccgtgctggccaacgcaaccaggttcaaggcattgtgttgctatcggggactacaatggccacgtcggtactgggtgttaaagtgctccataggagtgtggccaccgacatccgtgtgggccatcatcctggccaagactctccatcgtccccgtgcgcaaaggctactggtggaacaaagatcggaaaagcccaaactgtcccttgcaaggtgacatggccgctgctggctctgtgctggttacgccctaatcccgtgaacccaggggtcactggcatcagtctcccgtaccttgtgccttaaggaagctggtcatgatggcgtggtatcgatagactgatacacctcagaacggcgcgtgacgtgcaaccattggggaaacttacgacaaatggcagctttaatgcagttctaagaactacaagaaacttaaccccgacactgaaggagactg

SEQ ID NO: 521967 - DNA, 755 bp, Homo sapiens
  misc_feature (330)..(330): n is a, c, g, or t
cttgtagatatgccctctaatctttcttcgcttttctctggactttggtcccggattactatagcacccccacaaatgaccgccattggaacaggaccccaaccacaatggagaagtggaagaccactgaggagtcatcgcagtcgggagggatccatccttcctcacattgacactggagctcatggtcacacacagcatgtcctttgcacttagatgagcaattggttgatttgtaggctttctcaatatccacacattctgcattaatgcaaaccttgttatcgccacacttagttccattggccaccatgcctatttcttgacttntgtcttcaggatcaaatgttttacatgtcaggaaagtcactatccgtcctttccagggcaaattatccgacccaccttgacagaacaacttcccacacatggtatcatttgctttgcagggaatgagtgtgtcatccactctgcgacagtacccgtactttgacccaccttcattcctgttgtaacatgacttatctgcaacctcagttcctggtccccacagctctgtgcactgctcctgcagagtggggcatgtccccatcaagcagtggcccttcccgtgatggcaagggaagccattgacttggaatctatcatcaggacaattaccagatttaccattacacatttcaggcaggtcgcactcatcttttgctggtctgcacaccatcccagcctatgtaaattggcatatgcacaacatt

SEQ ID NO: 521968 - DNA, 558 bp, Homo sapiens
gtttcacccacccctttccctttctagttagaagtataaaagaaaatctagccccttctatcggggcaagagaactttaagagttagccatctcttggccgcagctaaataaacagacttactacatgtcaagtgtggcatatctctaactcgctcacgtacaacatattggcggcccgagcgagaaacgccaccaggggagacagcgggctcgctccggggtccccccggaaggacggccggcttgtattgggggtgccactgagacaaattttcaggtccccacacaggtgaccgtcttccagaggagaccggatcgactcacgtgtggatgcccacaaacaattccacctctgagtcctcaacttctgaacccgaggttcagggtaggtcagacttctgacgtctccgttctagtaagagggaagcggccctgaatgagggcgtccctcttattgagtctgaccggcacatctaggaagctcgaccggtagagccctggatttactgtaaggccacctctgtgtactcttactaggacgggacgtggccctgaca

SEQ ID NO: 521969 - DNA, 368 bp, Homo sapiens
  misc_feature (18)..(18): n is a, c, g, or t
  misc_feature (262)..(262): n is a, c, g, or t
  misc_feature (274)..(274): n is a, c, g, or t
  misc_feature (305)..(305): n is a, c, g, or t
  misc_feature (315)..(315): n is a, c, g, or t
  misc_feature (340)..(340): n is a, c, g, or t
  misc_feature (355)..(355): n is a, c, g, or t
ctcccttgggaactctanggcactgccgactgccagatcatccctatactaccacagctgatgctctcttgatcctccacttcctggcaggaggccaaacagcacaaaactagtgcaataaacaaaactacaactaaggaccctcacagagttcatttcactctcctgccacctccaccagagcaagtgctgctatccacagctaagagacctgaagatggttcacatcacaggactctgtgtagacacccccaagtaccancctggagccacngtagctctgctggatggctagagtccaagangagaaatagnaatcactaccacttttggctctcangaaaaccccatcccngggggaaattggg

SEQ ID NO: 521970 - DNA, 192 bp, Homo sapiens
  misc_feature (60)..(60): n is a, c, g, or t
  misc_feature (89)..(89): n is a, c, g, or t
  misc_feature (99)..(99): n is a, c, g, or t
  misc_feature (114)..(114): n is a, c, g, or t
  misc_feature (121)..(121): n is a, c, g, or t
tggggaggcaaggcaggagggttgcagagcccaggagttcaagactgcagtgagctacantcacaccactgcactccagcctgggtganagagcaagancctgtctctaaatanataaatnaaggaaaagaagaatgatcacaaatcaataacctaaatttctaccttaagacattgtaaaaagaagagcat

SEQ ID NO: 521971 - DNA, 885 bp, Homo sapiens
  misc_feature (1)..(1): n is a, c, g, or t
  misc_feature (3)..(3): n is a, c, g, or t
ntnacaaggaagtcaaaaaaaagacacagaagcagaaaaccaacaacacaagtcgcaatttggttcatctcgccatacttttctttcactctgtcagcgtttcccgctgaaattgtcaagaaacttcaccctgaggaatcatccctctttggacagtgggttctgaaatttcttcctgtcctatgtccgaattttgcgggtaatattcaagaacgggcccattttgtcaagaaattagttccactgtccgtgccagtatttccccatggcgagttgggccccgcgtgccacacgtccccgcgtgtatgagtcgcatgaaaacaaaatggggggaaaaaacgtaaccaggggaaactttatcccgtgtgtaaaaaggagggaaactcctgtcctgtgggccatcctggatttatccccggggggcccctgcgcgtttaccccaatttagccctgtgccccgtaaatccaaattctgcacggagtcccccttttcaaccgccggaagtttaagaaaactgttatatttaatacacaagctttggtaggtaaatcaactgatgggtacccccaggtggctgcggagtgcaacagatgcaatgttattgatccacagaatcccaacttccggttgccccgacagaaggcttgagagaactccctgtctttctaacacacggcgactagaataggatccagcatgttcatcaaataagccgcggcaccaggttaacaagcccccctatttaggcggagacctagcatcacggagccatgagtgttgcggggatacctcttgaacccccgagttcaaaagtgatccgtgcgctgtgccttccccccgttccagttcaccccgggccaaacacagaaccccttcttcataca

SEQ ID NO: 521972 - DNA, 497 bp, Homo sapiens
  misc_feature (31)..(31): n is a, c, g, or t
  misc_feature (225)..(225): n is a, c, g, or t
  misc_feature (232)..(232): n is a, c, g, or t
  misc_feature (486)..(486): n is a, c, g, or t
gtaaggaaaggagacataaatcaatcttaangcaaggctcttgatattaagaatgtatatccagagcaaatccaattcatcagggattgattaaggaaggcagctagtccaaaaaaaatttggtgaggaaatgttcactcattcacaagaatataaagtagaagtgtatataaatctgctatgtctattttgtaactttgtgaatttcatcatctatagaaaatncagtatnctatttgtcttatgttgtaattctaaaagtattcttatagtcctaattttccaagtgaaaaatatatgtatatatatttatcttttttctatattatattatcatatattttatttatatatgtgtatattattcaggggtcctaaatgactctggacttatccaattatgctacatatagagatcagagctagctcagggcctatgcccttcatgaacctaagcttcaacattaacatgctgagcatgtagtngattaggcttc

SEQ ID NO: 521973 - DNA, 176 bp, Homo sapiens
catggtggtgggtgcctgtaatcccagctactggggaggctgaggcaggagaatcgcttgatcccaggtgtctgagacagtagtgagctacgactgcaccactgcactacgacctcggtgatgcaatgagatgctgtctcaaaaaaaaacacacacacacacaaaacaacaaaaaa

SEQ ID NO: 521974 - DNA, 411 bp, Homo sapiens
cccataagcgccagggtctcatcccattaacaggtcaatgctaagagtgtctgcagaacccatgatgtgaatttactgaagagaaagactctccaccaggtgggctttcagccaggcaggctgtcctcagtccctcctccttcctcctcatcaacgtgcattctcgtctcctccccggcttgttcatcaaaatttctgcctcgtatggattctcttgcccattgcttacctgattctctactagttcatcgttgtgctcgcgcctgggttcgtgctattggtcatggcaaacctccactggtgttatatagctcctccccccatggcctttgtaacgtccctgtcaagtcatggaataactgcatctggcttgtgagtatgtccgaatcaacgcgttccgcgcctccgtca

SEQ ID NO: 521975 - DNA, 163 bp, Homo sapiens
ctcgtgagcgagagagtccagatcttccaacctcttgttggcggctcatccttggtcccccactgccttagccgatgtgtgagtgacatctctgaaaagacttggtgaatcaatctctagatccagaatgaacttaccaaacaactttaggccatgttgttaa

SEQ ID NO: 521976 - DNA, 133 bp, Homo sapiens
attctggtaaaactggccagtgaacagtggctcatgcatgtaatcctagcactttgggagtccgaggccggtggatcacctgaggctcaggagttcgagaacagcctgaccaacattgcaagacggtctctca

SEQ ID NO: 521977 - DNA, 993 bp, Homo sapiens
taaatctgcgtgattgctttattggtccaaaaagtttccagttaacagttaaatgtggtttttaaaaacaggacgaaaaaagctcatttgtggatagaagtgtgcttcacttaatgtgctttatttaagcattacaagaaaaaaaagttttactcgtgaccagattacgtttggaagggtttatattcaccttttaaaaacgccattaccctaggataaaaccacttgaaagccactttggtgttcaaacacaaaataaataagtgtaaataacgcctcctcctcaattagcagagaaaacagtgaatctccgttaaattcaagaagacacacattcactttcaacaaggcatgtggccccagccagcaccacacacccccaagaacagaacaaaacacaagaagacaggcagtttctcaggttacaactcttgtgcggaaaagaactcgaggaagccttgggcaaaaccgcgtgtggtaaacttgttcgtggtttcctcctttcttacctccaacttcaaccgtgaagtcgtgcacccggaccattttaagagggaggcatgttgttcccaggaggctgcactccaggggatgtgcccaagagggagccgtgcccgtgctaggcctcctctcaaagggcgcatcccaggcagaggaaacgtggcctgggttgatcgttacctccagggcccagtagagtgtggacaacccttgaggttgcccacagacaatggttgccagagagtaacgggaaagaaaacccttgaggttccctggatttcttttctctttacttcctcaaatgctactgatctctccccaaggtaccaggctcacagaaaaatccggtgtgttgaggacccccaaaattccgcaccatggccagtgccaagccccagttggtctgttttcccatctgggaaaccaggctaacaatttttttcttacaggacaggcgccctttttaccccgcgtgtgtacaggtttaccgca

SEQ ID NO: 521978 - DNA, 168 bp, Homo sapiens
  misc_feature (31)..(33): n is a, c, g, or t
  misc_feature (35)..(36): n is a, c, g, or t
  misc_feature (150)..(150): n is a, c, g, or t
tcttagcggagcatcagtaaggagcatcagnnngnntcagtaagcggagcatcagtaagcggagcatcagtaagcggagcggtcacgcctgctgggggtatgttgtgttggcaagaagaagaggaggcgaggaggtggcatagtactcgnttactgatgctccgcgat

SEQ ID NO: 521979 - DNA, 1916 bp, Homo sapiens
tatcgggtgatctacgacgaagagaactggaggatgattcagtactcaggctgtgccgagagaccacgtcggccatcgccgtggttatcgaactgcgggacacaggatcgattagatgcacgccttcgagacctgtgaacagtgcaccatgaaggtcccgtgtcacttcttggccgcttgaacaatcagctctcatcctcgattgaacgcacgtatgcagcagcgtatcattgacaccatggagaaggtaccgccgctgatgacatgaccgtgacgtgctagatgttcataggcgcgtcactggtaatgaccccggcgtacgcgagttgattcgtaatgagtgcccgcaatggagatggaacctaacccatggaacggaagagtcccgtgcttctaacgatccaccgatctgttccacttttcatcggtgtccaggtagacacctacaggtatcctagaagcgaaagcgtgcgaagcgagcaggcaatcgctcgaagtgacagaatcgcctgtagtgggcagccgatgggttcacacggtcagtatgggctataacgactggcccaagtccaaatatcagaacccgagaactccttagcccttactctaaaagccgggtgcaatggatctaccacaactgcaaaatggtagttagaacgggcggaacgcaacatccgcggattcccgtacgttagaagcccacctgtagtgagtcagtgcagagagcggaccaaaccgattgggggcacctcgatgaaagggaaagaagccttctcgaaaagttaaaaaattaaaacctctcttgtaagattccaaagtggctcacaagatacctattgggccaggtgctctcgcgatacaccggcgtccaatatgccttgtgccaagatccttgactaattgccggcccccccaagggggaccgtgccctgctgagggggaacgtggcacagcgcttggtgtgcaaaaccctaatatcggtccacacttgtgtggtgatacacccccacggtcaatctgccctgcacaaaccatgttggtcgcttgagacatacgctgtgggtagccccacacctgggcacaccggtacagtgtgcaaatccagacacgcccctccgccacgtgggtggaccaaaggttcgccattgggagcaccgctggtgcatggcacaacaaacagacacggttatcaggcttgctgaacgttccccgttgggagacgccaacagcgtggttaccgctatgagaacgccactaactaggagccacgcgtattgaataaggtacgccgaggggaacgtctcgtgacacagtaccatggtagaacgagccctactgaatacgcgccaagcacatttcataagacccagtatgaatttacaggcgctattatcaccacaccaacaccggtcagtcgagtagccaacaagagacctcgcggctattgtgagacccacattctggcgctacaaagatagacaaaacataggtggcaacaaagaggcatcttaacaaagcacccatatatgatggtggtaggtgagcacaatgtggactagtatcaatccaagcgacacgactccacgagagtgatggtgatggcgagggacgaagctccacccctgcggagatgtgcgtcatgtcgtgccaacgcatcggcgagccgagctagtgctagaggcgcgcagcaggagcaaggagtgtaggctggcgacgtgcgccccgcgcgcggctgactgtcacagcgtcaagatgattcagagacacagcagtggtgtctgacggagcacggagaggggcatggctagcagtcagtccaacgaggacatcaactgactgatcgcgcaaaccgaggcggcaccgataccagctgtgttagacgcggctgtcactcggagaacaacagaagtccatcg

SEQ ID NO: 521980 - DNA, 255 bp, Homo sapiens
  misc_feature (31)..(33): n is a, c, g, or t
  misc_feature (35)..(36): n is a, c, g, or t
tcttagcggagcatcagtaaggagcatcagnnngnntcagtaagcggagcatcagtaagcggagcatcagtaagcggagcggtcacgcctgctgggggtatgttgtgttgtggttggcaggtaaataataatcttaccacctctatcaggtctatggataacactaatattatggatcaagacctaagtttagttttggtcttgtcattatcttagtttatgattccttgggactatttttttagtgtatattct

SEQ ID NO: 521981 - DNA, 188 bp, Homo sapiens
  misc_feature (31)..(33): n is a, c, g, or t
  misc_feature (35)..(36): n is a, c, g, or t
tcttagcggagcatcagtaaggagcatcagnnngnntcagtaagcggagcatcagtaagcggagcatcagtaagcggagcggtcacgcctgctgggggtatgttgtgttgaatacataatgcttgtgtatcagacttacgttactgtcatcaccattaaaagaattgcagccttgtgccccttactga

SEQ ID NO: 521982 - DNA, 416 bp, Homo sapiens
  misc_feature (253)..(253): n is a, c, g, or t
  misc_feature (360)..(360): n is a, c, g, or t
aaggcacccgctctctgggacgggggctttttcggctggtctggggtgacctctacagcgttctcaggggctgccgtgatggttgtgttgtgcgactctgccccgctgcaaggcacccgctctctgggacgggtgccccccgggttttctggaatcctgggggtgacttcccagccgtctacttgcagttggacttcccaggccgacagtggtcaggcttctgaggggtcaggccaaaatgtggagaacgtgngaggcctgtggagggttccgtgggaagggcaggacagggccacagacagtcactttccctgtgacgcccggagacagaaggtctctgcgtggctgggtttttgtggngtgaagatggacgttctgccattgggattactaccactacgacggtgtggacgtct

SEQ ID NO: 521983 - DNA, 251 bp, Homo sapiens
ccactcttacagagcatgtctcaccaccccacctctttgtgtttcgctgtgatagatcaataaaatattttattttttgtcctggatatttggggatgatgtttgattgttggtgtgctctttgggtttatttttgtggctaattggggagagagagagagaaaaaaaaatttctaatctggggagctatatcctcaggagaaaattcattttaatcgctttggtataactctggatgaaacacacattta

SEQ ID NO: 521984 - DNA, 668 bp, Homo sapiens
ccccctttttattgaggccataaaaaaaaagcaaccaaggttttcttctgctttgagcagtgtgatgagctcacctgcgccccctcgtggagtttgacaaaaacaagctgatctctgtgcagacggcattagtcgtggatcatacaagaaggagaagtttgaggacaggtccccaaccgccgagtgcctatcagagaaggagacgcaggagctcatggcctgtattaaaaatgtgctggggtcgcgtgtcaccaacgttaaggtgaccctccgactggacacccaccctgccatggtcaccgtgctgaaaatgggggttgcccgccacttcctgcgcatgcagcagctggccaagacccagaaggagcgcgcccagctcctgcagcccacgctggagatcaaccccaggcacgcgctcatcaagaagttgaatcagctgcgcgcaagcgagcctggcctggctcagctgctggtggatcagatatacgagaaccccatgattgctgctggacttgttgacgcccctagggccatggtgggccgcttaaatgagctgcttgtcaaggccctggagcgacattgacaaccagggggccaaaaggtctgacaccacagatgacagccccccctccttgagctttatttacctaaattttaaggtttttctt

SEQ ID NO: 521985 - DNA, 154 bp, Homo sapiens
cgacctgataagaactgctcagcccagcaaatatagcaggtcttaaaaaagacgggtccagatgttggggggaaggaataaaagcacattaagtgcatgtcgcgacaccatctgctgattcccaaaactaataggaaggtctttgcaagcgatt

SEQ ID NO: 521986 - DNA, 338 bp, Homo sapiens
gcggatttataaccagatacaggcgttatacggtacgaaaggcgccatccgttcggttgttcttgctaggtcgtgacttgacaactcctcgcggagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttcc

SEQ ID NO: 521987 - DNA, 248 bp, Homo sapiens
  misc_feature (98)..(98): n is a, c, g, or t
cctccgacttctggtccaagcgattggcctgcctcagcctcccaagtagctgggactacaggcacacgccaccacgcctggctaatttttgtattttnagtagagatggggtttcaccatgttggccatgatggtcttgatctcccgacctcgtgatctgcctgcccggcctcccaaagtgctgagattacaggcatgagccactgcgcccagcctatacatttttttaaaaataatgggttttgtaa

SEQ ID NO: 521988 - DNA, 214 bp, Homo sapiens
  misc_feature (24)..(24): n is a, c, g, or t
  misc_feature (60)..(60): n is a, c, g, or t
  misc_feature (70)..(70): n is a, c, g, or t
  misc_feature (76)..(76): n is a, c, g, or t
  misc_feature (82)..(82): n is a, c, g, or t
  misc_feature (84)..(84): n is a, c, g, or t
  misc_feature (90)..(90): n is a, c, g, or t
  misc_feature (105)..(106): n is a, c, g, or t
  misc_feature (115)..(115): n is a, c, g, or t
  misc_feature (139)..(139): n is a, c, g, or t
  misc_feature (149)..(149): n is a, c, g, or t
atgtgcacgtcttgctcacgagcngttctattatacatttactaacaagtaaacacattnttacatcatnaacttngtgatntnataagnaatactacagaattnnaaaacatantgtggatcaaatcatccttgcttnaatacatcangaacttcccaactacttaaattcaaaacttccttataaaggctaaagaccttctttcccatttct

SEQ ID NO: 521989 - DNA, 348 bp, Homo sapiens
atcggcaggagtacgtcatgcatgagtggagaggcactgatccgcaggatggtcgaggacctcaagctcacgcctgatgaccggctactggaaatcggcttcggtatgggtatctcggccagcatcctgcaggagttcggcccggcgtcccataccattgtcgagccccacccacaggtgctgctccaggccgagcgctggaagggcgtacgtaagaacattcagttgcaccccggctactggcagcagcttgacaccagcagccagcgttattccgcgattttcttcgatccgttcgccgatgaaatggcggcggttgacaacgaaaacctcaggttccttaagttt

SEQ ID NO: 521990 - DNA, 153 bp, Homo sapiens
ggcagggtcaagcttgtgcccctccttccccacccccccgcagaaaccggtctacaagggaccttccggcagatcgagctgggccctgtgactcccaggaagacgtttggaacaagcttggaagggccttcgttccctccgagctggcgtctt

SEQ ID NO: 521991 - DNA, 248 bp, Homo sapiens
tagtcagaggatcccagtcagttacacaaaacaaaacattttttgtcttggtatgatgaagagcaagaatcgagaaaagaaaagaattatttcggggtctcaaagttaataaacataataaggtgttaggtggtacctattatgctcactattccaacccttttttttttttttttaatttcacaaaaggatttagggcccttttaaaccttggggacccaaaacggggttgtgcccaccccgacatt

SEQ ID NO: 521992 - DNA, 229 bp, Homo sapiens
atgctctagaaaggggagtagggtaacaaaactacttggaaagaattggggaggaaaccaacaactgccttatgcaggggtggggacaggcaaggaggtaggtgccaggcacaggagcatttcacatacactaacctaacttgtgaagctgtaagggagccatcttccaactgggcttaagacgagaaccgactggctgatggggagaattctacacggagggacgacg

SEQ ID NO: 521993 - DNA, 343 bp, Homo sapiens
agcggtcaaaaatgtgggatacaggcgtagcacgcgccgggcccgataaatttttaatacgagaaaagagaaacggtgaaccccacggaccaaagctcttcccattcgggaacccgcaccccgagtcaagattctcccctaaagaccctctcgtggttccggcacaatctgggagatacccggagctgtgggtgcagagctgcccagagagggctccaggccggggcacactcgctgccaagggaagagtcaggacgcccgggaccggcttatagagcacccgccatcttttttttttttttttttttttttttggggggggggggggggggggggggggacc

SEQ ID NO: 521994 - DNA, 199 bp, Homo sapiens
gtgtattcacgcaatgcggtgcatgccatccctggacaagtcccgtcgacacgtgagcaccgtgctgacctccaaatatcgctctacgcctggagccctggtcgcacgctgtattcaccactgcgcgcgcatgcctccctgtacaagcttccgtcaacacgtgagcacccgcgctgacctccaaatatcgttcagctgg

SEQ ID NO: 521995 - DNA, 406 bp, Homo sapiens
  misc_feature (274)..(274): n is a, c, g, or t
cacgtccttagatgggacgactcagcatctaacgatcagggatgagtctttatgcagctctacaaccctatcgggtttacctccaataagaacaactctgtcagtggaatgaggacagcgtacctggagaagcttgatggtgcgtatgagtgtcctctcgaatttctttgattttagcagcctttgatccccgataattcctcctgctagactctgatgattcaacagcctcgagctctggcatgtccaagtcacttcctttatagtgttcgtnattgtagcattccacagtcatctgattcgagcggtagctggctggttgcagtgggtgatggcgtctgccggccctcttcctaggtagggatgattttcttcagaatttctccaattgtttcagtatccgtac

SEQ ID NO: 521996 - DNA, 121 bp, Homo sapiens
agaggatcccctcgctattcatcggcactccctattcatctgcaccattcgctctagaggtccatgcattcttcatattatacttggtgccgatgaatagcgaggtgccgattaataggga

SEQ ID NO: 521997 - DNA, 3201 bp, Homo sapiens
  misc_feature (56)..(56): n is a, c, g, or t
  misc_feature (64)..(64): n is a, c, g, or t
  misc_feature (224)..(224): n is a, c, g, or t
  misc_feature (2850)..(2850): n is a, c, g, or t
  misc_feature (2960)..(2960): n is a, c, g, or t
  misc_feature (2966)..(2966): n is a, c, g, or t
  misc_feature (2970)..(2971): n is a, c, g, or t
  misc_feature (2992)..(2992): n is a, c, g, or t
  misc_feature (3002)..(3002): n is a, c, g, or t
  misc_feature (3008)..(3008): n is a, c, g, or t
  misc_feature (3013)..(3013): n is a, c, g, or t
aagatcactcacattaggccagaacaccatggctcatgcctgtaatcccagcactngggaggcngaggcaggggaatcacttgaacctgggaggcggaggttgcagtgagccaagatcacgtcattgcactccagcctgggtgacacagcgagactccatctcagaaaaacaaaaacaaaaacaaaaacaaaaaaactgtacagtctgatccaaactgttgctntattgattcctcctcttgcttactgcctgctgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtntgcggatcatgatgtcaggagttctagaccagcttggccaatatggtgaaaccccgcctctactaaaaatacaaaaattatccgggcatggtggcatatgcctgtagtcncagctnctcnngaggctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 521998 - DNA, 2892 bp, Homo sapiens
  misc_feature (56)..(56): n is a, c, g, or t
  misc_feature (64)..(64): n is a, c, g, or t
  misc_feature (224)..(224): n is a, c, g, or t
aagatcactcacattaggccagaacaccatggctcatgcctgtaatcccagcactngggaggcngaggcaggggaatcacttgaacctgggaggcggaggttgcagtgagccaagatcacgtcattgcactccagcctgggtgacacagcgagactccatctcagaaaaacaaaaacaaaaacaaaaacaaaaaaactgtacagtctgatccaaactgttgctntattgattcctcctcttgcttactgcctgctgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcggccactgggaggtttctaagggactaactcgcctcttcacttgctatagatgtactgaatttcgttctggagatcag

SEQ ID NO: 521999 - DNA, 2950 bp, Homo sapiens
  misc_feature (56)..(56): n is a, c, g, or t
  misc_feature (64)..(64): n is a, c, g, or t
  misc_feature (224)..(224): n is a, c, g, or t
  misc_feature (2741)..(2741): n is a, c, g, or t
  misc_feature (2751)..(2751): n is a, c, g, or t
  misc_feature (2757)..(2757): n is a, c, g, or t
  misc_feature (2762)..(2762): n is a, c, g, or t
aagatcactcacattaggccagaacaccatggctcatgcctgtaatcccagcactngggaggcngaggcaggggaatcacttgaacctgggaggcggaggttgcagtgagccaagatcacgtcattgcactccagcctgggtgacacagcgagactccatctcagaaaaacaaaaacaaaaacaaaaacaaaaaaactgtacagtctgatccaaactgttgctntattgattcctcctcttgcttactgcctgctgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcagctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 522000 - DNA, 327 bp, Homo sapiens
caatgaaagcccaaattttttgggggaaagtcccctccacaaaagtggaatgttggtgtgggagcaggcaaccaagcggttcaaaaaccccgattacaatgttttttagggttttattaggtgggggcaaaagtaattgcggtttttgccatgaataacctaaaattttataataccccaaaagttttttaaaggcctccaatcctttgaaggactggtgcacaaccaatcagaggctgaagtggagacttttgtcttgttcccacaggattgaggacgtggcctgtgtgctgcctaattttgcctaaaactagctgcaccggctgt

SEQ ID NO: 522001 - DNA, 3783 bp, Homo sapiens
  misc_feature (3432)..(3432): n is a, c, g, or t
  misc_feature (3542)..(3542): n is a, c, g, or t
  misc_feature (3548)..(3548): n is a, c, g, or t
  misc_feature (3552)..(3553): n is a, c, g, or t
  misc_feature (3574)..(3574): n is a, c, g, or t
  misc_feature (3584)..(3584): n is a, c, g, or t
  misc_feature (3590)..(3590): n is a, c, g, or t
  misc_feature (3595)..(3595): n is a, c, g, or t
tgtccgcttttttgtccgtcctctctgctttgtcttgttttctcttttctctccttctttgttttttctcgcctgtctcgcgctcgtgtcttctttctcttctctttgtcttgtcttcgttttctctcttgctctccttctcttctctctcttcctggctctctctttttctctgttttccttctcctgctttgtgttgttcgtttctgtcctttctgttcgtgtgttttctcccctggcttggtttctcttcagtctgtagtgctcgtcctttcttttttcctgccttgtcctcttgggtttgttgctcctttcgcggctctgttgtcctttgcgattttcttcttcttcttctgtcttgcttgcactcgtgtgtcttgtgccttgttctcttcgtggtggtggctttccctgtgctgttttatgttcgttgccgtttcgtatctggtctttgacctggggcgctctggtgcccgtctcctccttcgcgtgaagttttcctttgtagatgtaatcattgccacttgatggcctggacaagtgcgaacctgtaccatcatctctccggggtaagttgttcgtggagaattagtcatcccgcttgaagggttggaaacggggagttgacccagaacaacttcggaaggtgtctttgaggctccagggagttatcacgttatagaatgttgcttgaatttgggacggaaggctggccttgttggccccatcgctggttttggtaaagtttccagcttgtcgagctagggcccagttagggcaatccctgaaagaaatgaacgatgcttccggctgcccgcccagttctggaccccagttggccaaaagagcctttccttgcagaaaggggggaattttgcatttgttggtagttcctctgcttcgccgcccgcaaccttcttgccgccaccgttgaaaccatgtttcccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtntgcggatcatgatgtcaggagttctagaccagcttggccaatatggtgaaaccccgcctctactaaaaatacaaaaattatccgggcatggtggcatatgcctgtagtcncagctnctcnngaggctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 522002 - DNA, 2426 bp, Homo sapiens
  misc_feature (2075)..(2075): n is a, c, g, or t
  misc_feature (2185)..(2185): n is a, c, g, or t
  misc_feature (2191)..(2191): n is a, c, g, or t
  misc_feature (2195)..(2196): n is a, c, g, or t
  misc_feature (2217)..(2217): n is a, c, g, or t
  misc_feature (2227)..(2227): n is a, c, g, or t
  misc_feature (2233)..(2233): n is a, c, g, or t
  misc_feature (2238)..(2238): n is a, c, g, or t
atcgagtcggtacctgcagctctctctgatgctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtntgcggatcatgatgtcaggagttctagaccagcttggccaatatggtgaaaccccgcctctactaaaaatacaaaaattatccgggcatggtggcatatgcctgtagtcncagctnctcnngaggctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 522003 - DNA, 170 bp, Homo sapiens
ttttgttggaaaacagttgaaaaatgaacgccccttttttgattacaacatccaaaaagagtccattttgcattggttcttgggtttaagggggggtttttaagtttcccttttaaaggtttcaaaaaatttcattgcattttcttttaaaaaaagttgtggctttccca

SEQ ID NO: 522004 - DNA, 209 bp, Homo sapiens
gggaaagcacaggctctgctagagatgttaagtattctctctccctgaaagctggttcctctgaaatcaaaatattcaggggtgctggataagaggttcagggcatctgaattccaaaggactagtgtttttttccactttttttataactgcactccctccaccttacacctaacacaaggttgaagagccctgtcaaggccatctaa

SEQ ID NO: 522005 - DNA, 2423 bp, Homo sapiens
  misc_feature (21)..(21): n is a, c, g, or t
  misc_feature (2072)..(2072): n is a, c, g, or t
  misc_feature (2182)..(2182): n is a, c, g, or t
  misc_feature (2188)..(2188): n is a, c, g, or t
  misc_feature (2192)..(2193): n is a, c, g, or t
  misc_feature (2214)..(2214): n is a, c, g, or t
  misc_feature (2224)..(2224): n is a, c, g, or t
  misc_feature (2230)..(2230): n is a, c, g, or t
  misc_feature (2235)..(2235): n is a, c, g, or t
tgttctagagtatcccctgcngctccgactgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtntgcggatcatgatgtcaggagttctagaccagcttggccaatatggtgaaaccccgcctctactaaaaatacaaaaattatccgggcatggtggcatatgcctgtagtcncagctnctcnngaggctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 522006 - DNA, 2035 bp, Homo sapiens
  misc_feature (56)..(56): n is a, c, g, or t
  misc_feature (64)..(64): n is a, c, g, or t
  misc_feature (224)..(224): n is a, c, g, or t
aagatcactcacattaggccagaacaccatggctcatgcctgtaatcccagcactngggaggcngaggcaggggaatcacttgaacctgggaggcggaggttgcagtgagccaagatcacgtcattgcactccagcctgggtgacacagcgagactccatctcagaaaaacaaaaacaaaaacaaaaacaaaaaaactgtacagtctgatccaaactgttgctntattgattcctcctcttgcttactgcctgctgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaatgccaagtgtgtctgtttttttgttttgttttgtttgttttttagatgacatctacgg

SEQ ID NO: 522007 - DNA, 936 bp, Homo sapiens
ggcaattcggatttgggttcaggagcgcctgacacaggatgcatgttgctaaggcaaaattcaaacaaaagagggcttacctgtgtgctttagacaaacatatcctgggttttggaccacaggagatgcagttcttacatgaacgctgctcaaattctgcgaatgtgctggcacatagaggagctcagagagctacagacaaaaatcaacgaagccatagtagctgtacaggcaataatggctgatccaaagacagaccacagactgggacaaagtttggacgaatgaaacacttgaggacttcacgcttctcacctacttagtaacagtcggggaacccatacaacttctgggcatgtcgggaattcaaaatgtgtcaacattctcggagggagagaagcccaagaaacatggggctatggtcctagcagacatttacccaaccatggcattatgggccttagcttctctcttcactaacaggctctacggacagtaagaaatttcacactgatcttagccaaacaaagaaaccatcacataatcatgatttcacacaacagtacctatcacacactaaggaagacacaatatactatctaagaacaaacacactgtatgttgtacacagttgtcccatctctgacgatatatgtgcaacagtagagacaactacatgttactctcaaaagaagtagtcatcgcgggaaatagcaaaatcacacgctatgagacattataaagcacccgattaatcaaacactagtctcctctgatacacacggcacgatcgattataataacaaatcgatcaaatatgagtgacttcagcgacggcacaccacgacgggagacataatacacgcgaggcgaccaaaagagaatgctccaaatctataatatcccgctacgaaatatgtgtacacacaactccca

SEQ ID NO: 522008 - DNA, 1277 bp, Homo sapiens
  misc_feature (56)..(56): n is a, c, g, or t
  misc_feature (64)..(64): n is a, c, g, or t
  misc_feature (224)..(224): n is a, c, g, or t
aagatcactcacattaggccagaacaccatggctcatgcctgtaatcccagcactngggaggcngaggcaggggaatcacttgaacctgggaggcggaggttgcagtgagccaagatcacgtcattgcactccagcctgggtgacacagcgagactccatctcagaaaaacaaaaacaaaaacaaaaacaaaaaaactgtacagtctgatccaaactgttgctntattgattcctcctcttgcttactgcctgctgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcagagagagctgcaggtaccgca

SEQ ID NO: 522009 - DNA, 157 bp, Homo sapiens
acaggctatacaaaatagataaataccttatcatcaaatagacaaataaatatgtacataatgactttcagaataaaatccaaattccataagaggggatcaaagaacttgaggccctggtcttgactgatttaaattcagtacaacctgccggtgg

SEQ ID NO: 522010 - DNA, 2144 bp, Homo sapiens
  misc_feature (1793)..(1793): n is a, c, g, or t
  misc_feature (1903)..(1903): n is a, c, g, or t
  misc_feature (1909)..(1909): n is a, c, g, or t
  misc_feature (1913)..(1914): n is a, c, g, or t
  misc_feature (1935)..(1935): n is a, c, g, or t
  misc_feature (1945)..(1945): n is a, c, g, or t
  misc_feature (1951)..(1951): n is a, c, g, or t
  misc_feature (1956)..(1956): n is a, c, g, or t
gagagtctttgactgggcatcgtgatacaaccaggataaagagcttttactgggagaagtattacagacgaggaaacagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtntgcggatcatgatgtcaggagttctagaccagcttggccaatatggtgaaaccccgcctctactaaaaatacaaaaattatccgggcatggtggcatatgcctgtagtcncagctnctcnngaggctgaggcaggagaatcncttgaacccnggaggnggagnttgcagtgagccaagatcacgccactacactccagcctgggtgacagagtgagattccatcccccagctccaaaaaaaaaaaaagaaagaaggaattggtcaagcgggctttttacaaattacaattacggttctcccaaaagtttatccccagtctattaagaaaaacttcagacaatttccagtaa

SEQ ID NO: 522011 - DNA, 876 bp, Homo sapiens
gttcacggatgtggaatgtccgttgtgcctgaagcaatagactgagcaataacaatagtgggtgatgtaagacaaaaagtgcgagcatatgattggaatttataggacgatgtgccctcgttagtccatgatccgatcgaaatatcgcgcgaaggtgatggccactaacacgtgtgccgaacatcatctcattaggctgtcctatttgcgagcaggatggacaggttcagagagcacgcttgtgtcattacatcgtgactacaagatcgacccaaattaaaaggcaaatggtgggacaaatacgctcgtaggggcgtagaagagaagttcgctgggatcggctgtaattgtcggtcacctgccgtatatgaaacttacgattccacgcttgagaaaatcatctataattggcaattctccatgttgctgtgaaatattatatggaaataacgcgatgggactcggggcacgagctgagtcatggcggtactcgtacaggggaggataagctaaccttaagtgggaggataccatttgatggggcccccattagtcggtggactctcccatcaacattgggacacgaaagactggccacttatgtggatccttttttaatagtgttgggaccaccccgttgtcaaatagaattctccactattcaaggcaggaagccacacgaagttgactgtataatgaacctggactaggaaataacttcatcgaatcgggaggcagggtccttgtattttcaacaaaattttaaggaaccttgggcgtggctggcttgctaactggaactacgtggttgcaagcctttctttgcaagctcctccacctcaggtacgaggtccacacttccagtcaacaatgggg

SEQ ID NO: 522012 - DNA, 1758 bp, Homo sapiens
  misc_feature (880)..(880): n is a, c, g, or t
  misc_feature (1680)..(1680): n is a, c, g, or t
  misc_feature (1758)..(1758): n is a, c, g, or t
gctgggatcatggataaatgtgaagccctccttatttagtcctcttcgcgcaggaccctggtcccattaaccacatgacgcatggggcagggctcccatcatccgttgaaaggtatttaccacgagcatatccgtgtcccgggccctgcgcctgcggagtgagcccgcagcattcatctcttgtcgtgggctacagtaggacagacacccacgtttcggtggctgcttcgatcggacggacggcacagcagagatccggaaggtagtggttgccggctgggcagccagttgtgatatggtcagctagtgcaggggctcatgagtctattgggtactcagggatgacacgtgacccgcccagggactaacggctactagggatatgcctgaggtgaactctgtcggacggctgtcgatgggattagctacaagtcatgcatgcctgagggccagaagttctcaaaatccccttgcgaaggtggactgacatggacttgccgcaagctgtggcgcccctgaaagagcgcggcgtttgcctcacgacggggctaatgatacctacgtgtcagcccttacggacagtgcaatgggacttcattcttcacaccgttggatattagaagtgacacttcgtgtggctctcctagagatcccgcagggtggcgaccacgagggtcgagccttcaaggatcctacccgaggtcaaaaaacgtccaacactagtattgcccttcatagatgcgcctggggacgacagaccaaagatacgcaagtccccataacccttgaggaaagacaccgagcacttggcggttcgacaccgattggggcttcgcaaccgaaatataaaccattggtgaaggagaaagtgggcacatgnggaagaaacggcttaggatttcaaaccattgggaaaggcactcgcacaacaatgttaaagcaccgttgaacattcgatcgcacctcccaatcttccatgaacccaattgcagaggggccaacccctcaatgtaagatgctcactttagtagcccccttagggtgcagtatcattaagcacccatatgtagagcagacatcacgatatcttggactcctttagcgcaagaacaccggaaatctgcacgcacagggggcccatataaccccaacacggaacaacgcgagaacacatcagttggaaagacccaaagggccatggccacgaggtcaatggtaccccttcccacaaaagttgagccacgacatgacattgaagacgaccaacagtgacagaaagagacaacaggcagacaaccgcggtacccacaggtcgtcaacacagacaagcgggcgcatacacccgagaacctgagataaccctcgatgaaagggtgacgacaccgattccacaagaaacaacaacacccccacaaggcagggccatccacggcaggagcgcagagcaccaccagtagacactagccgaacatcagagaaagaggagatgaacatgtaacataagagaagacagaaaaatcagacgataaccaagctgataccactagccatcaagtcccaccaaccacgctagcaacaccaagaacatacacgacaagaagacaaatacagactagcagaacgactcccagctaggagctgtgcaacttaacacaatgacctcctcgctagtacgacctntccaccaaacgaccaacgcaacgacaagcaacagagaacagctaagagaaagacaggacacagcaaagacgatagaan

SEQ ID NO: 522013 - DNA, 1287 bp, Homo sapiens
gatgcttccagacagaggtactactacacgaccacatccagaccccgacgcccctcgaccgcggcacctcggagcgtactgcgaccgcagactgccgcccccgacctctttggagtctctcgcggcctcaaagcgcggcctgcgtcgcttccggcagttcccgaaccgcgggcgatggctgccgcctgggggcgcccggactgctgcgcgccgcttctgctgtcctcggcggcccggccggccggtggctgcaccacgctgggtcccgcgctggatccagacggcctgctgcggcaccgggggccgggcgggcagcgcggcaggccaccggtcgctgcagcgtgtcggcgctgggcccggcaccactccacaagcataaccatccaccagtccactttatcaaaccgtgcatggtgcaacattcaacaaccaaaggcaacacagttggtgcattctctgctcagcatgtaagatggttgcaacacatcaatctcagcatattgcatggctataggtgccatgtgcagggcaccctggcttgtccacacctagtcacctccatcttttgcacagcatcaccatcatctggcagcacagttcagcatgcacatccaactgatgcagcgcagcaatgcaccatgctcgcatctaggccatcatggcactcaaccaggacagcatccacgggaagggagctgaccacaatactgctttgacaaacaactctaatgagaccacataatgacctgataaagacgttgccttgcaaaccagttggactggactgccagacacaattccattgcatgtggggacactgacacttactagacaatagcaccacaaatcgggcatattttccacgcgcattttacccccaacatttacaattaccgcaattacatttactatcaaagctgcaatataccttagcaaacaccttgaaatacataagcatctccacaaataatacacacaaacgcatcaaagacactacaagcactacacaactgtgattcagcaaataaccaacataaatactacccatgttgcatacctgctagcacccaaataataaaactagagatcaataccacaaaaaacactaacacacacatctctaacacacaactgaccttttacatacatccatcatctcaacaatactaactcgaccgaaccgaccgaaccaaaactatacatacactcctacaccactccattccccaacctactaaccaaaatatatatacaaatatgatacagaaactctaaactaatcaaaaa

SEQ ID NO: 522014 - DNA, 399 bp, Homo sapiens
acatattgatgaaaaacatgatttaaactttaggaaaataaaacttttaatacttgtgagattcacattgatgcacacgttgcttgttggtctgactttccaggactaagaccctctgtgaatcattggggctcggtgacatggtgtaacctgctactggggtgtggtcttagacacaaaatcacgctggaagttggtctacagcggcaggtttctctcattgtcatagcattttccggagaagcctttgcctttgtcacacatttggctttacaaatcttcattgacaaatagttcggcaaagagtaaaggagcacggacacgaagagcagcaggataagcaggaacagcaagccgatgatgacccacttaaagcggcaccacacgatgaacttcatg

SEQ ID NO: 522015 - DNA, 1728 bp, Homo sapiens
  misc_feature (1578)..(1578): n is a, c, g, or t
acgcctctttacgtttggtggtggccgcatttgtgttgttgtcacgaaggggtttcgcgtctgctcctatagtgtatcatgttagcgtgttttgtttttctgcttcgttagtatttcgggactcgtgcgtgttttggtgtgtcttcctccttattgtatctcgttgctccattgctagttggtcgttcctccacttgctttctcctcggtaacacgtgtgtccttctctgcttttggttagattattgtttctctcgccaccatgattgtctgcgccgaggaggtggtgtcgtttcctctgttcttcgcactcgaagggcgcgtgggtgtctcttttttaatagagttttctccacggtgtcccgtggcacgcacggtttcagaggtcgccccgttgtgggtgacggggggcagcagatgtggtgtaccgcaccccaccacgtggcgcatgacggttgttctgctgtgtatttaatgtccctgatgtggccacccccggtggttgtttgtttgttggcgcccgtctcacccgtgttgtagaccacccccacttgggggtgtatataattctttctgtgtttcacaggataccggtggtcttctcgtttgtctaaaagtggtttcctcccccgtcggacccccctttgttggggggttggtttgtaaaaacaccgggcgtgtttctgtctggccttctctcgcggagatcgcccacacggtgtataaccctcggccctttttaccctctgtgaagatataatccccctcccgcgtcgtgtatacaattttttgtggggggtggggagatatatcccccgcgctttcacccctctggagttatctctgttttcatcacgcggagagaggtggtgccccaccgctcttttgtgtcccacacatatgaccagcgcttctcacatctccatttctccgctgccccaacgctttcccccacttgtctctatatagagagactctctggcccgcgcatttattgtgaggctcgtattagagagggcccacctctctgtatagcgcgtctctgaggaggctcttttttgggggggtgttttttgtgtgaccacaccacgcacacacgctgtctcactctgtggagataagagaatacacacgcgtgccctctgtgagataattatacacacagcagttctcacagcagatatgtgtgtcacacacactcggggtgaattatactcttgtgtgtgtgagacacacacagggagaggcactcgagagaggtgagacgacacacagaagctgctgcgtggtggtttgttcacacacagagaggtgtgttgtgtctagacaccacacacactcagagaatgtgtgtgtcaacactcgctgtggacacacacacccgagcggcccacagcgcgtgtgtgcacactcggagacccacaaagggctggaagcggttgtgccactcttatgcactttccacaacccacaaattgtttccccaataaaccactctccctttattgtttttatattttatatcctcgggtgttgcctcccacccctgcgagagaatataggagagaagttcttctngggaactaagctgctcgtataccacctgcccctcacatcccgcggcacacttataatggagagttttggagccccttttttttttgggaaataccccgcccccccccctcccaatatagaagagatgaaaccttttaaaagggaaaaaaa

SEQ ID NO: 522016 - DNA, 841 bp, Homo sapiens
ggaagatggatctactgtggatcctgcgctccctgtgggttctcctgcttggggggccgtgccttgtctgaagacgccatggaatgaccaccaggtgccctaggacccagagggaactggagagccagcataagtcttgttcctgccttgccccagctggtcggccgtgagtctccaggaagggtccgtggcgagacgaagggagccccatggtccatcataggggcatccgggaacaccaggcaagagtggggcccaggggtgagccaggagatccaagtgaactcgtgttccgtgtgcactggatggccccaagaagcttgtcgtgtgagcttgttagagcctagggctgccaacattggagcggcgtggataccatctgttgcctaccttgcaggggcagggccacatctccagatctgtaggtgaggatggtacaccgagggggcgagcgggttggcggggtgtgttcatatgcgccaggactggattcatgcggagtaccttgtccgcagtctagggtcctccttacggaaggcagcgtcagtggagtaacctagagagtctgaagttcttggcttggagatctgaggaattcgcgacggagtttactcttccaggggtaacatggggagctgctggcgtagagcttggcacgacctttgatggtaacacgtaactttcgcccaactattgcgatctttccgacatcactcgggtgaggtcagatcatgtaccagcgtgagcactggggcaagattcgcacgagggtcactgaaggggattccctgaggctcgcaacgtgggcaggccctgaccacctatgacgtggacacgatta

SEQ ID NO: 522017 - DNA, 1643 bp, Homo sapiens
gtcctgacgatgggttgcgacgggggaacaatccccaagaggcatgaatctggtgaagtgggccgaagaaggttgagactgtcgacaaagatgctgaattattggcctaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggaaaagaaaacaaagaaacccaaggcagcagagtctgtttcaaaaccagatgtcagtgctgagagcgaagctggaaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctaccgcttctgaagcccgcactgccaccgctcctgccccagaaggttgtttagtttccacgtaggcaggtcgctttgtgcctctgagtgcgcttgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcccatattaattaactaaaattttaatgatcttgctaccagcaataaatcaagtaggccaagtgaaactgggctttaaaaaggatggatttcaaatacactgtgccccctagaagcttcgaagggcctcgtccctttgctacagccctgggaggagccaggatccttgttggtctagctaaatactgttaggggagtgtgccccctctcatcatttcgaagatagcagagtcatagttgggcacccggtgattgggttcaaaaataaagctggtctgcctcttctcaccaaaaagaaaaaaaaa

SEQ ID NO: 522018 - DNA, 1412 bp, Homo sapiens
  misc_feature (208)..(208): n is a, c, g, or t
cttagtggtggggtgttttcacacatcacgcccgcacaatacaaataccgagggttgtgccgctcgttgtagtacacgtgttgggctggcatagttttcttctttcgaacgataaagtgtgccccccccggtcgcgtccatcactcctgttggtcgcctaccagctcatccgacccgggtgcagtgtgtcacccccgcttggtgtctnctccccccccacgacgtgagaggatgggcgtgctctttcatggtcctgttttcctatagaacgagcattgctttgtgttcacacactcacacccacccgcctttaaagttggtgggagccccaaaactgcgtgttgttgcttctgccaccccgtttcgtttattgtgtgggtggggcccccccttctttcctctggggaagcagctgttgttcctgcgcccgcatggtgacctttctggctgtatgggttgtgttttgttcccgttcgccgttgcgtgcttaaagattaaaggagcgtcatacgtcaatcgtgtggggggttgacccaaccgtttataggaagaggcacccgtggtgtgttgccccctacttggggggagccccccaaccatgccccgctctggtgttcaacaagaggcctctcttcgtgtgttttgttttgtcgcccccacccacatgctcgtgtagaataattagtttagaacaggcggccctgttgtctcctcgggggtattccagcaacaagaggaggggcgagaagacaacattggggagaaatgaggggcgcttcttgacgacgacacacgattgggtgccctcagagaggttcaacatggtcacttttggcccttttctacacacacgctgacacagtggtcgccacatgtttggcgctcctccctttgtcacaccattgggctcacagtgaaacagacccccgtgtgtgtgggcctagtcaacacgtctgtgtataaatggccttttgtcacagtataaccacacagagagacgactttccacagaggtttccctccacaccgctgtggcacagagagttttgtgcaacacacatacttctataatgtatacctagaaacattttctaaatgagttcttgggtacaccaccgcacaataagaatcacaagtataggccacaagtgaacaactcgggcgtttataacacaagagagatggagatttcacaaataacacctgggcccacactatgaaagcttcgaagggcctcgtccctttgctacagccctgggaggagccaggatccttgttggtctagctaaatactgttaggggagtgtgccccctctcatcatttcgaagatagcagagtcatagttgggcacccggtgattgggttcaaaaataaagctggtctgcctcttctcaccaaaaagaaaaaaaaa

SEQ ID NO: 522019 - DNA, 1569 bp, Homo sapiens
gtcctgacgatgggttgcgacgggggaacaatccccaagaggcatgaatctggtgaagtgggccgaagaaggttgagactgtcgacaaagatgctgaattattggcctaatggaactattgtactctaagtcaggaaatattaagacgaccaatagttgcctgtgaacttggcagactttataacaaagatgccgtcattgaatttctcttggacaaatctgcagaaaaggctcttgggaaggcagcatctcacattaaaagcattaagaatgtgacagagctgaagctttctgataatcctgcctgggaaggggataaaggaaacactaaaggtgacaagcacgatgacctccagcgggcgcgtttcatctgccccgttgtgggcctggagatgaacggccgacacaggttctgcttccttcggtgctgcggctgtgtgttttctgagcgagccttgaaagagataaaagcggaagtttgccacacgtgtggggctgccttccaggaggatgatgtcatcgtgctcaatggcaccaaggaggatgtggacgtgctgaagacaaggatggaggagagaaggctgagagcgaagctggaaagaaaacaaagaaacccaaggcagcagagtctgtttcaaaaccagatgtcagtgaagaagccccagggccatcaaaagttaagacagggaagcctgaagaagccagccttgattctagagagaagaaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctccgccaagcgctccaaggaggagtctgcccactgggtcacccacacgtcctaccgcttctgaagcccgcactgccaccgctcctgccccagaaggttgtttagtttccacgtaggcaggtcgctttgtgcctctgagtgcgcttgctgtgtgttctctctatagttctgtgtcataaagctgtcctggccagccttcaagctggtgtggccactcttgatgtgaggcgtgtcggttccaggggggacatgggaggggctgcacagtggcccgaggtcatgcttgcttccacctgcaggtgcatttggtcctttccatggccaggaagccctgtgggctgcactttttatgcttgcagtaacaagagactccagagtcctcaccggtgcagagttggcccatattaattaactaaaattttaatgatcttgctaccagcaataaatcaagtaggccaagtgaaactgggctttaaaaaggatggatttcaaatacactgtgccccctagaagcttcgaagggcctcgtccctttgctacagccctgggaggagccaggatccttgttggtctagctaaatactgttaggggagtgtgccccctctcatcatttcgaagatagcagagtcatagttgggcacccggtgattgggttcaaaaataaagctggtctgcctcttctcaccaaaaagaaaaaaaaa

SEQ ID NO: 522020 - DNA, 161 bp, Homo sapiens
tccatcatagaaattctgcaggtgcaagcattgccctggggatgacccatgttgggtgttcagcaacggtgccttcctcggtagatgttggtaggtcactcagagccttgtagacggcagccatggatcttctcggtcactatatggcagcgcatatcaag

SEQ ID NO: 522021 - DNA, 148 bp, Homo sapiens
ctcctccgcaactcctcggctgcacacccagctctaagagcgagagtgaacgagagagggagggagagagttagagcgagctagatctttggagagatttttttttttgcctcctacttttgttttgaagccagaaaatcgacttcag

SEQ ID NO: 522022 - DNA, 280 bp, Homo sapiens
gtgggggaatggtttcaggataatcaagtgcttacatttattctttggctatatacaggagttgtgcaaatagacacctcacatgcgcagttcacaatagggtcacgtgcctttgagaatctaatgccaccactgatctgacaggaggcagaactcaggtggtgatgcttacttgcccactgcagctcaccttctgctttggaggccaatttccaaacaggccatagactcttgggtagggggtgactgaggacccctgctataaagcattaagcccctt

SEQ ID NO: 522023 - DNA, 385 bp, Homo sapiens
gctcgacgggcacgatcagcaccggaaccttgacgcgcgtcgagggaactagacccacgacgacgacagacatcgttgagaggcttgaacgggatgggttagtagcgcgacaacgtgatccccatgatgcgcgcagtcgtctcgttgagattacggatgccgggcgtgagtactgccgcaactgcgaacctgtcggtgggggagttcgtcgtgccggcgctaaacatgttgaacgatcaggatcgaaatcttctgatgaaaattttgcccggctttcgccgggctgtccgagttccttccgagaatgattagagggccgaccaaggattgtaccattggttaagaggccttgttgacacgggccggaatttatgtaggaaataag

SEQ ID NO: 522024 - DNA, 179 bp, Homo sapiens
gaaggaattgtgcagtatgtatctagcctggctaacttatgaatttctgtctacctcattttcgtattagagtttgcagcttctgtaggtaggaagagaacatgtttgataccagtatattataacctcactgcttctctccctcagaaaaaatctcgattgtttatatcactaccata

SEQ ID NO: 522025 - DNA, 162 bp, Homo sapiens
agctgaaatacggcttggtcagtgtcataggagccagttgctagaagtagagggagcgatcgtccagtggagagcaggatgtacggtgatcaggcctaggcacttacgggcacagacagccagccctaatcacttacttaggggggcacctaggatacacct

SEQ ID NO: 522026 - DNA, 112 bp, Homo sapiens
taaaccttccttaaaaattctttggatgcttggctctatcactggtaaaccgggtcttttcccccccagttttttctttttaactttcggggttgcgggacacaattgttca

SEQ ID NO: 522027 - DNA, 184 bp, Homo sapiens
atgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagtggcgctg

SEQ ID NO: 522028 - DNA, 982 bp, Homo sapiens
  misc_feature (52)..(52): n is a, c, g, or t
tcatgggacgaccggtgaggcgggagatggcgtgaacctgggagcggaggtngcagtgacccgagtttgcgccgctgcactctagcctgggggacagagcaagactccatcttaaaacaaacaaacaaacaaacaaacaaacaaacaaaaaacagtatcttttgttattcctgagataattccaagagaagaggaatgttgactatatcctatggcatcattattgtttgtctgattggacccaggctagaaatcttaaagatatttgtgaaaaataaagctcatattcaagatgaaacattaaaccccacagtgaaggtcattctcattctctctggcttgcccctctttctttctcacttgactttctcataatttttttcaacaacgtctttggaccccggttcattaaactctccctccccacatctgatttttccccaagaaagtgcattctggagagggcagggggagtgactattcatttgtctacacttcccaggctcaaaggagctgtggtcactatagcttccaaaacattcctttgccataatcctgcaaaactgtatgatcccatacctcccagtgaaattcccatagaccatattctaccctttttcctggctgtcttattgtatccctgttacttcctctggtcccatgaaggctcagtcccttggctcatgtcctctttgctatctgaactgccaccatcagggtggtcttcagcatctgcgtgtgcaggaaatatccagtgacttagcttcagagttgcaagacttcatccccaccatactttgccagctcagtcacattgcccacactctggccttgtcttctgtaatgtctctgcttccagaacattaaactccagtgtaaccatatctggttataccctcatagcctctctgcttgctcccctactctccctttttccaagttcattaaccatgttttccctcacgccaggtattcccagtca

SEQ ID NO: 522029 - DNA, 231 bp, Homo sapiens
gctctctttgtgagcttaccaggagggactataaagcagatacctgtattctcctgtacttcatggattttgtataactatgagtctcctgagagccagttgtggtatacacctgccatggcgtcccagcatcagcatcctttctctcttccttgtctcacagcaccctgattcatctttgggagaccaatgctcttgtactctcagatctttggatggggctaacctgct

SEQ ID NO: 522030 - DNA, 422 bp, Homo sapiens
  misc_feature (165)..(165): n is a, c, g, or t
  misc_feature (389)..(389): n is a, c, g, or t
accggtctatctaaggatcactctaattcttttgcttgcgggtgatgcctgttgggggccagtgccctcctaattggggggtaggggctaggctggagtggtaaaaggctcagaaaaatcctgcgaagaaaaaaacttctgaggtaactaaataggattatcccngtatcgaagagcctttttggacagtgtggtgtgttggtggccttgagtatgtgctttctcgatgttacattcgcgccatcattggtatatggttagctgtgttaggttagtagagcctagatatgaaggagcgttatggacgtggacagtgaaatcacatttgctagtgccggagtgtcacttaggaggggctggagagggcccctggttaggggtcatgggcntgggttttactatattggatcctctagagtcga

SEQ ID NO: 522031 - DNA, 383 bp, Homo sapiens
aggaggggcctggtgtggaggaggtgaggagccgtgcaatccaaccaggatgtttagcaccccatcccccttggcccttcctcatgcttttgaagtggacatattcagccttggggaaaagctccgttgcacgggtttccccttgagccccttttacaaatgaggaaactgagtccggaaaggaaaagggacatgggtcccgtgccctagcttgttacagctgcctctgtccccccatgggggggccccttttccagtaggattcggaaaaaattggacatatgggaggagggggcaaattcctggccctccctccccagacttgaaggggggggggaggttggttgttcagagttttcccaataaaaatgggtttttgagca

SEQ ID NO: 522032 - DNA, 1372 bp, Homo sapiens
  misc_feature (990)..(990): n is a, c, g, or t
gatggtgctcgggcttggctggttgttgggttgtgtgtggcttgctgtatcgcgtcgtgcgtggctcgggtggtgggtgcgtcgatagctaggtaagcgcagatcaggtgtgatgtgagacgtgagtattggtgtggcatcccggcggtgtcgttcgtgtgtcctgctgtgcttgagcttgatccgccagcggacccccgatgttttacacacaattgtggtctcccacccaggaccgctagttttttggggggcgctcccccattcttggtgcgcacaccattgtggggcgctctgccgtgtccaccgaataattctcggtgtttccccatatctcccccgggggtccctctcgtcccagattggggcccgcgcggggtttcctcctgcgtactctgggcacaaagtggcgctcttctccgcgacccgtctgcgggtggccagttgtagcgccccccgcggtactctcgcggtgtttcgccgctttggaggcgccctgcggttccccccgccgcgggggagcctttctcccgcaccggagggggcccgcctctgtgtggaatgggcatgcgcgtgttctgtttctttcgggcgagagcggtgtttctcattctaggtggctgccagaacaggttgaacctcctctgtcctcctagctagttctccccccgcctctcggggtgtttgtatgccgttggaaagaggaatttttcgcgccgcgttctctctcctcgccagcgcatttatagaccgagcgatgtctctgttgcccaccccccccggggcggaacaactcttctcacgaggcgtgtaacctatgattgcgccccccgcgtgaaattaggtcgctcacgagcgaggtgattgtctcacagagcactcttccatcctccacacggcgctgtgcacgatcggtagtctctgccgccacacattttgtctttcttcaccagaggatgcacaatatatctttgtgtcgcgcacgggganatatagtctccatagagagggtgtacattatatatagacaggcactcatattgtggagatatcccctgagtgagacaatattctatgattgcagtccacctctctcccacaacgcgtgcaacatcctcttgcggggagaaccccctccacctccgtcgatgggggagtgagaagatacacacacacggtcggtctatgactcgccagagatatccttcttggctcactgtccatctgggacaccagagggggggccgcatactattctcgttatatatagctccctcgctttgtgtgtccagggtagatctgagcaggcggccacaaccacaccgataaagccgatgggcacccggagggataacaaaagacaaagaaaata

SEQ ID NO: 522033 - DNA, 429 bp, Homo sapiens
  misc_feature (76)..(76): n is a, c, g, or t
  misc_feature (86)..(86): n is a, c, g, or t
  misc_feature (183)..(183): n is a, c, g, or t
agaccaagatccccaagtcctgcccttaccaaggatgtcaaggccgctgctaatcaaatgggcaacttcctggttngaaccccccncccccttcgcttggaacctgggaaaaaaaatttgatcatgggtttggatggggccccctatgaccccaagggacccccccaggacctgttggactcnaaaaattggattgaggaaatgcccttttaacgcctgtgccggagcaccccccaacgggcaacctggggccaagtcaaaaactttccccccggagtatggcccccaggggggccaggtgtaaggggtgccccccccccccccctgggaggaaccttaacctgggaaccattaaactggaaaccctgctggggcccctttcattaacccaacctggggccagggcaaattaaaggcttttggccccca

SEQ ID NO: 522034 - DNA, 489 bp, Homo sapiens
agtaagaggaccgtaggactcttcctggagaacaccgacatggaccgggacatatcccgacgggtccgacgacgacgcaatgctacgaccgacccatgctggatgtacgacgctgttgagagactgctacgatgtacagacccgacaggcgagggagtacgcgagacgagccgtggaacccaagagggacctaggtgcacggacggacctccacggactggcacgaccgaataaccaaacccggcgaggcacgacggacgacggcagtgagacccgacatatcgggcacaacacgatcatcccgaaccatgcagagcagactactagggaacaaaccaaagtcaatcacaacggacatgagaagagacagggaagaagaagggaacgagaacacataacagaacgaaagcgaacaatcatacggcatacgaaggaggaaaagagagccccacacaaaacagcccgagcaaggagaaggatgcactaaag

SEQ ID NO: 522035 - DNA, 598 bp, Homo sapiens
gtccagtatatggagactctcgctctctctccttggagatgcatggtaagtgctgatgcacttgaggtggtagcattcgcacctctctaagtggtgtgcaatacagagagagaaacgagtacaagtcttatatgtaatagtgacatgtccgagtagtgatacatgaaaagtggacggaaaaaggtggaattaacgtgaaagtagatatatccagtaaaccaggattgcagcgattatgtgctggtctcagggcgcagaaccagaccgatgtgcagggctcagaagcggcgtgcagttgtggccgtcatattggatggcttagttctcagatgattctgggcctttgcagccatgacgtcaggtcgttttctactgttactgagtcagggaggaagtttttttcttctgtttattctctgaaaggtaaggccttccttggctgcacagctgcagctgagaagcggattctgaaggggcagggtctctaatctctagggaagctcccccagcctccacagtggggaagccctctagacaggattttgggctgagcctggatagttgggggggtgggggagtcaatatcccgagggccccg

SEQ ID NO: 522036 - DNA, 606 bp, Homo sapiens
tattgacaagatgtgttgtgcgctatttatgaaattaaggagttatggccactgtgcatgggaactttggggttatagttgatcgatggtagtatgagtatgagcgcaaaatcgttatggaaaataggaagtatatgtgaagatgctgattatcgttagattatctcgatagtagtatggtcggattgcagggcaaggaaatggcttgaatgtggtctagaatatatggctagatgcttttagtaaaaatatgaatcgtaattgataatgaattaaagtgttgatattcgatgggaagcaaatgttcttatacattgttgagatagaaggcacgaagacggttaagttttcccttagatgctattggcaaaagcatgggatttgagactttcgcgcgcatatgtagcccgtacactgcccgaactataactagaggctgttgcactaagtaacacgtcttatgtactggcaaactcgggcacacagttgacctttccaccttgaagataaaaaagtagggcgaaggagtaaccttcgtggactaatgctccttcggccgtttggacttttttcttcccgaacgggaattacacattaacttccaag

SEQ ID NO: 522037 - DNA, 439 bp, Homo sapiens
tctgtctgttttttgagacagagtctcactgttacccaggctggagggcagagcacgatctccactcactgcaacctccaactccctggtccaagatattctactgcctcagcctcccaagtagctgggattacaggcacgcaccaccacatctgactaatttttgtatttttagtagagacagggttttaccatgttggccaggatggtcttgatctcctgacctcatgatctgaccgccttggcctcccaaagtgctgggattatgggtgtaagccaccccacctcaccaaagttctgttagtttttattttacgtgttttcaagtttatttctgggtacatgttatgggttgaatttggtttccaaaaagatatgttaaagtcctaacctccaggtacctatgaatgtgaccttattcataaatagggtttttgaa

SEQ ID NO: 522038 - DNA, 232 bp, Homo sapiens
tacctgtaacattcgtgtcctttcgtacaggcaggaattggagtagatagaaaccgacctggattactccggtctgaactcagatcacgtaggacttgaatcgtctgaacaaacggacctttaatgagcggactgcaccgatcggtgatgtccgtgatccaactatcgaggtcggtaaacccttattgttgtatatgtgactctagtaatagggattgcgcttgttatcccc

SEQ ID NO: 522039 - DNA, 247 bp, Homo sapiens
  misc_feature (247)..(247): n is a, c, g, or t
tctccatgcctgggtgtgcgctcttgtctttgatctgtttacatgggctcttttgcgttattggtattctgtcgtctgtcatcctgagcccatgtattctatcccttcagtactgatttctgtctcacatcatgaaattgctttagaggtatcatcttaatgcatccttgaatttgggttgtgcgagcatcaaggacgctacgaggatctatgttatcattcccctttcctgagggtaatggaagtn

SEQ ID NO: 522040 - DNA, 257 bp, Homo sapiens
catggttcaagcaaattctcttgcctcagcctcctgagtagcaggattacaggcacctgccacatgccccactaatttttgtattattagtagagatggggtttcaccatgttggccaggctggtcttgaactcctggtctcaagcgatccgcatccccctcaccatgaaccaccgcgtggggactcagtggataaatttctgttgcactttgcaaccttgggtgacctatttgaactctgttttctcatgagtaaa

SEQ ID NO: 522041 - DNA, 350 bp, Homo sapiens
ggtgccgccaaagccagtgctctcatgatgtctggcacgctcttggtcatctggactctggcgccagttagatgtgccgtccttctcagatcccgtttcaccattgctcaaattcatgtatcacatatggacatacgctccatactgtgaaaggccttaatccatgaagtcaagtagatcctgtgtagccttttcaccttcgcattatcaaaacgtgagatcaggctactgatataaagcctcctacaaaaaagcggctgcttagctttctacctatagcaaacaatatcttttaagtcccatttgtctctcagcatagactgagaatgaataagtacggcgaattaaag

SEQ ID NO: 522042 - DNA, 272 bp, Homo sapiens
gtagaggacactctctgctcccagattcatattccccactaatgaatgaagaggaggctgggaacgggctcatgcattaacctcagcacttttggagactgaggtgggcagatcgcttgagaccaggagttcgagaccagcctgggcaacatggcagaaccccgtctctaccacaaatacaaaaattagccaggcatggtggcacatgcccgtagtcccagctactatgggaggctgagacacgagactcacttgaatctgggaggcagaga

SEQ ID NO: 522043 - DNA, 137 bp, Homo sapiens
cctcttcagcagtataagccacctagtaatataaagaaaatgcagcaaaatctgatttttaccttggctaccactttcataaatataaagtaacttaaaatatttgttgttgttgttgtacttgtattgccagttcc

SEQ ID NO: 522044 - DNA, 363 bp, Homo sapiens
atactcgatggtcaacgtcaagaattcacaggtcgcctggttctagaaataatggggcaagtatgtaggagttgaagattagtccgccgtagtcggtgtactcgtaggttcagtccatgtggtggccaattgatttgatggtaaggaagggatcgttcacctcgtctgttatgtaaagcatgcgtagggatggtaggtcgatgaggactaggatgatgacggccagaatagtggtgtgagtgttaggtaaagggcatacaggctctaggaagcagataaggataatgattatgagggcgtgatcatgaaaggtgatgagctcttgtatcatagcgagaggagcgtcgtgtaggcgtacatgcg

SEQ ID NO: 522045 - DNA, 373 bp, Homo sapiens
  misc_feature (63)..(64): n is a, c, g, or t
  misc_feature (68)..(68): n is a, c, g, or t
  misc_feature (72)..(72): n is a, c, g, or t
  misc_feature (75)..(76): n is a, c, g, or t
  misc_feature (273)..(274): n is a, c, g, or t
  misc_feature (276)..(277): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (288)..(288): n is a, c, g, or t
ataagtgccgatctacttcttccgaatgtcatcaacgcaacagtacccaacgtggacacccanncagnttgnaanntttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggattgactttctaaagactnntnngggncntnganttgagaaaagaggacctacccatatttagtttttatgcctgattatcgcatttgatttggggcgctgacctcttgaaatgttaat

SEQ ID NO: 522046 - DNA, 390 bp, Homo sapiens
  misc_feature (81)..(81): n is a, c, g, or t
  misc_feature (290)..(291): n is a, c, g, or t
  misc_feature (293)..(294): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (305)..(305): n is a, c, g, or t
cttaaaaatatgaacctcaaactgtatcctctaaaggccccatacaatgaagtagacattggtggaaacatttacacccantgggctgggggagtgaaaataaaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggattgactttctaaagactnntnngggncntnganttgagaaaagaggacctacccatatttagtttttatgcctgattatcgcatttgatttggggcgctgacctcttgaaatgttaat

SEQ ID NO: 522047 - DNA, 350 bp, Homo sapiens
  misc_feature (1)..(1): n is a, c, g, or t
  misc_feature (342)..(342): n is a, c, g, or t
ncgaagtgttgtgattaaaggtgtgagccaccatgccagccaagactccatcttttaaaacaaaataactaactaaattgctgggactctcacttctagccaagaccaagtaacaaaaaccagatttacccactcacctaaaataaaaagaaacaaactaggcagcaaatatgaaataatggtttttgaagacactggataccagggcatcaaaggacaatgattcctaaaagagaaggcacaaatgcagggagctgggagattgtcccagtttattggccttggggatgtggtccaagttggcagcacagaaacgggaacaggagtaagcctgggtggganttctttgg

SEQ ID NO: 522048 - DNA, 328 bp, Homo sapiens
acccttcccccccttttcccccccaggtaaaagggcaattttagccccccttggggccccccataagtttccccagggggggggtttggtgaaaatgtccaccgggtgaccagtttggtttccccccccccgctagttgggacccaaaaaagaccaaaaacttttttttgggtttttaaacaaaaagctttttttgggggccaaggctttaaaaaaaattgttttttgtttttttcccccaaccccccagttttcccctaaaagaaattggaaaaaataaaggaatttttaaaaagtttttcccaaaggaaaattaaaggggccccca

SEQ ID NO: 522049 - DNA, 499 bp, Homo sapiens
  misc_feature (60)..(60): n is a, c, g, or t
  misc_feature (88)..(88): n is a, c, g, or t
  misc_feature (129)..(129): n is a, c, g, or t
  misc_feature (147)..(147): n is a, c, g, or t
  misc_feature (169)..(169): n is a, c, g, or t
  misc_feature (247)..(247): n is a, c, g, or t
  misc_feature (250)..(250): n is a, c, g, or t
tagttagagggaaataacaaacgggggaaatcaaccccaaaaccccatttgaaatcaccntcttcaagacccaaaggtagttaaattnacaaagatggggaaaaaacagagcagaaaagctgaaaattntaaaaatcagagcgcttnttcctttccaaaggaacgcagntccttaccagcaacagaacaaagctggacagagaatgactttgacgagttgagagaagtaggcttcagacaatcaaanttntccgagctaaaggaggaagtctgaacccatcgcaaagaagctaaaaaccttgaaaaaagattagatgaatggctaactaaaataaccagtgtagagaagtccttaaatgacctcatggagctgaaaacccagggcatgagaactacgtgatgaatgcacaagcttcagtagccaattcaatcaactggaagaaaggatatcagtgattgaagatcaaaagaatgaaatgaagcgagaagagaagtttag

SEQ ID NO: 522050 - DNA, 195 bp, Homo sapiens
  misc_feature (136)..(136): n is a, c, g, or t
ctggctacttacgctcttttttactgtacgaacacacttgacgttaactggggtggacctggcgttgggaacgaccataccatttcctaactgtactttactacgacacaactaacaaactactttttactgttgnccttcttacaacaacaacacaacaacacacacacacaaacaacacacacacacacacac

SEQ ID NO: 522051 - DNA, 124 bp, Homo sapiens
atgccaattaggttaaggattattgttgtcagttatacgactctacagaaaggacattgaactcattaagcatagcagactccaaagttatgtggttcaaataaagctaatattaccagggagt

SEQ ID NO: 522052 - DNA, 83 bp, Homo sapiens
tgtcattctctggctatggagtgtttgtggccttcacagatttcacaggaaccaataaatccctcaaagaagtaaaaaaaaaa

SEQ ID NO: 522053 - DNA, 176 bp, Homo sapiens
  misc_feature (118)..(118): n is a, c, g, or t
  misc_feature (138)..(138): n is a, c, g, or t
  misc_feature (152)..(152): n is a, c, g, or t
tggtctagaggatccctttgggtgcctttccacacagactcgtactgtctctggcattatccctctcctaggtcactagctggtgagctgagagacaaattcctggtaggattttaantggctgaataaaagttaganccaagatctttggncatcacttgtatttatactggagg

SEQ ID NO: 522054 - DNA, 328 bp, Homo sapiens
ctacaccgcgcagaacctattaatagggctctgtatagttgaagtacacatttgaatctagaccatatttcacttgataatctacaaatatttcattatcagggccccatccattacagggtaaccaggaggcaaaatgaatctacataaatatacacatgaaaatagtaacttacaaaaagaaaaaaaataaggcagcttcataacacaattatacatttacacttataacaatataactactcccgtacagaataaatatacacccaatgtatggagcaggattcaaagaggatagtgggggtcagggtgagggtacgcgggatag

SEQ ID NO: 522055 - DNA, 263 bp, Homo sapiens
  misc_feature (152)..(152): n is a, c, g, or t
  misc_feature (173)..(173): n is a, c, g, or t
  misc_feature (214)..(214): n is a, c, g, or t
  misc_feature (234)..(234): n is a, c, g, or t
caggcatgcaccaccatatctggctaattttgtgtttttagtagtggcagggtttctctatgttggtcaggctggtctcaaactcccgacctcaggtgatccacctgcctcagcctcgcaggtgctgggattacaggtgtgagccacctcgnccggcccaagatctggttttnagatggaattgaccaggcttgcttatggattaatgtggggngtaagggatggaggaatcanggatgagtctttatttcttgggttgtgga

SEQ ID NO: 522056 - DNA, 294 bp, Homo sapiens
  misc_feature (17)..(17): n is a, c, g, or t
  misc_feature (172)..(172): n is a, c, g, or t
  misc_feature (253)..(253): n is a, c, g, or t
ggagagacccgagtgcncgtgtggagaagcggcggcacaagcgcggcggcgggagacactcccgcccccaccaaactaaagcgtcaaattcgagttttgtggccttcgttgctcgcacagctccctgtctttgctaggaggccggcttgcggggttgagtggcccgagctangggtgcggcgacctaagggcggcgactacgacggcgttgctatcggtggtatcgacggcctccgcaggcggcgacgatgantggtcgccggatcgtgctgggtgatgtgccccctcacccct

SEQ ID NO: 522057 - DNA, 1338 bp, Homo sapiens
  misc_feature (9)..(9): n is a, c, g, or t
  misc_feature (79)..(79): n is a, c, g, or t
  misc_feature (81)..(81): n is a, c, g, or t
tatgaattnaagtagagagacagcgcgaatactctaggagcttctcgcagttggcttcctcggtaggcttccagcacgngnagcatgcccgagagcctggaccagcccaacctctggcagaccaggggttaccagcctcacaactgcagctgccttcaagcctgtaggatccactggcgtgctcagttcccaggctggggggacggggggaaaaccccagggaggggggggggtgccactcggcggagggaaggagtgccgaaccgaggggacaacattataccacggataccacccgaggggagccagggccaactccacaccttgtgggggggggagaaggagaacaccacctgtaaccacggagcgaaccacactataaatggcgcataagcacaacattgaagagaacagattttcacaccccaagggggggaagaaggagaaaattacccacatgattgtaatgggccccattgggagagaccacaccgcgccatccctcgacacagaaggccacgaatcctctaaaatagggcggcccacggggggggcaagaacgcaatggggggggtgccccccccaacgaaacatgctacaacccaggaggagggcgcaccctggggggggcaagagtgatccacaacatagggggcgggacccacaatggggggccgaagatggtgagacaatgagggagcaaacacgagaagacgcccccgcgggaccaatgtttggtaagcccagatggggggtatatgtacggggaccaatccttatatggaaaacccccccgaacacgctgggggtggcggccatgggcccaccacacggaacagaaaaacaccttcggggggagaaagagtcattcccacaaatggccgtcttggatagcgacacaaccacatgggcgacacggttatacccacgtcttaacgatcggtggggtctggcctgtctctgtcaactgtacgccacacttcgcaaccccagccacttgttggccactgccacggaggggcgggggggggggccgacacccgcttccctgccgcaggccgtgggatatattactgcccccccgggggggacagtttttcccagggagcttgtggaatttccccttttgaaagtcgggtgaccatgttcttggggaagcctctggggtaaactctgggcatggacacctgcactggatgccccggggtttggaaaacacatttcagacaggggacacacactttccccccagaaaagagaaaaccccgcgtgttaacacacaaccacccggagaggaatgcagtaacaccacgacgtacatagggaatttacacactg

SEQ ID NO: 522058 - DNA, 175 bp, Homo sapiens
gggtgcctagaggatcccggaatcgtgctggtgcttacttttatgactctgggatctccccaagtctcattgcctattcctggagtgatggagaatacatatgaagtcgctggagcaccaacacaattcccttagcaccagcacgaattcccttagcaccagcacgaattccctt

SEQ ID NO: 522059 - DNA, 168 bp, Homo sapiens
  misc_feature (46)..(46): n is a, c, g, or t
  misc_feature (52)..(52): n is a, c, g, or t
  misc_feature (93)..(93): n is a, c, g, or t
  misc_feature (158)..(158): n is a, c, g, or t
atcaagttaaagagcagtgagctgcaggccatcaagacggagctgncacagntcaagtccaatatcgatgccctgctggccgctttgagcagntcgctgcggagtaaaggccaatccagatggcaagaagaagggtgatggaggtggcgccacggcgncggcggcggt

SEQ ID NO: 522060 - DNA, 101 bp, Homo sapiens
tagtggtcccacggcaggtgtctctcaatcgacaacattgatggaacccccgtacgggtatgaacggagtgggacacccacccagtacaacctgccggtgg

SEQ ID NO: 522061 - DNA, 201 bp, Homo sapiens
gagataccgtcccactgagcaagggcagggaccgaacccacaacttcatggttcctagtcgggttggccaaccactgcaccacgacgggaactccccctttcttaacttttcaatgcggagccttttaaccctatatatggtactctccggaactcctgccattgtgaggaaacagtctactcaaattccagctccaccac

SEQ ID NO: 522062 - DNA, 362 bp, Homo sapiens
cgattctgaggatcccccagcactatttattaagtagggaatcctttccgcatttcttgtatatgtcaggtttgtcaaagatcagatggttgtagatgtgtggtattatttctgagggctctgttctgttccattggtctatatgtctgttttggtaccagtaccagcctgtttaggttactgtagccttgtagtatagtttgaagtcaggtagcatgatgcctccagctttgttcattgggcttaggattgtcttggcaatgcgggctcttttttggttccatatgaacattaaagtagtcttttgcaactcttatcagcccagtttaatattacctatttattataatgtaatgctgctc

SEQ ID NO: 522063 - DNA, 117 bp, Homo sapiens
catatccagagtcgcactgaaatgtaggtttactggtatattgttgttgtatgttgttgtttatgagacagagtcttgctctgtcgcccaggcgggagtgcagtgccgcgatctcgg

SEQ ID NO: 522064 - DNA, 166 bp, Homo sapiens
gctggactactgggtcgtacacggagctggaggggagggagaggcaccccagagtcaggattgactggcactgcctgacagatggggtgggtgtgagcaaaatggatggccccaatcatgagccctggcaagtggggcctgagcagcagggatgggcagtggaggc

SEQ ID NO: 522065 - DNA, 410 bp, Homo sapiens
  misc_feature (159)..(159): n is a, c, g, or t
ttgttgttgagatggagtcttgctctgtcacccaggctgggattggaagcaggccccctctgtattcgtttgctggggctgccataacaaagtctcacacactgagtgccttaaacaacatcaatttcatatcttacagttctggaggccagaaggcanagatcaaggtgcgggtggggttggtttcttctgagggtcataagggagggatctgtctcaagcctctctccctgggtttatagacggccatcttctccccatgtctttacatggtcttcatttctgtgtgtgtctatgtcctaatctcttctttttttgttgttgaggatgggagtcttgctctgtcacaataaataaataaataaataaataaataaataaaataaataaattaaataatgtaggggatg

SEQ ID NO: 522066 - DNA, 1022 bp, Homo sapiens
gcggcagaagcagctggtgggaaatacagaagcacagtcagctaaaagcaaagacccctcggggctgctcatcatctgtgcatcaggcactcatgtctcactcagtgcacgcatgtcgcaagcaccagggcacaaatgcaaacagggtcagccttgcaagcaagcctcacgcagcaaatgtagaccgtgcacctggcatgcaattgcattgtacagccactcacacagcaattgacgcacagcccattcgcaccataccagagcgaatcacagcagcgcatccactaactcccgaacataaacataacagccaggtacaaagagaacctgctttcatgcacagatgctgctgcacatgcaaaacgggcatgcagcttcgagaacactgtggattgcacaggcaattgcagccatcaagccatgtcactgacacttgtatggatgcaacattgagacatcatcaagcaagatagcctcaaacagctgcgaacaagtgcaatggcccagacaagcacatatctcagatgccacatgaacatgtaggatgtcagcagttgagtcttatggagggccccctgcatccaggatggcaggactgagtgaccttcgactagagcttcacagcacgaagatgaacttcaacttggttctcatagatgaaataaaacggcactgtacatcaaatcagactagacgaagtagtggcaggcgtcacaaaggaaaaaggggaaaatcaagatcctcgtggaaagatgcttgatgtacatatgatagacgttaacaaactccctactacatcgaagacattcctgacataacgaatcacaatgataacgacgtgaagccccaatgaccaggacaaataactctgcggaacataagaacgactagaaagggatcaaagaaatcagaacaccgagaagagaacacaacaaagcatgagacacgaaaaaaacaaaaaagaaggaacaaaaggcgccctcgtaaacaagatagaaaacaaacagacaagggcaaaagag

SEQ ID NO: 522067 - DNA, 178 bp, Homo sapiens
cagtaaggaactatgttcacaagaaacaacggcgagacagtggcttattactagcctctacagttaataggaaaaacggaagaagttaccttaagctagatagatgcgtccacaaagtgagcatactcccacactattggtagcgcggcgaccacaataaaattcagcctaaaatagt

SEQ ID NO: 522068 - DNA, 481 bp, Homo sapiens
gttagctgggattagagtcacccactatatcacagcgtaactatcgatagtattgatgatatcagatggtgtcactcacatgtagcttacgctggtcttgaattcctgggagcatcaagtcgacgccatgcgcgcgcatcagcctgaagacctttcgcagtagtcctaggattataggcgtgaaccactgctcctgggccttctttctcttaaatgtaactgtaggtagagattttggaagaattattggttctcattacttattaatgctaggcaaaaattaagtagtaacagaactagtattgtaaagcattggggtcttcaacgtcttatggaaactatgaagcaagagtttaagttaccaactgttccagacttagcatggtactgtatattcaggcaaaatgatagagaaaattatgtttgaggatacttaattcaacgtgttgtatagacattttttatggtacaagggcgggta

SEQ ID NO: 522069 - DNA, 231 bp, Homo sapiens
  misc_feature (26)..(26): n is a, c, g, or t
tctgtcgatgtgtggggataataatntgagatgaggtttgggtggggacacaagagccaaacccatatattctgctcctggcacctcccaaatctcatgtcttttatatatatttcaaaaccaatcatgctttcccaacagtcccccaaagtcttaactgattccagcataactcaaaactccaagtccaaagtcttatttgagacaagtcccttctgcctatcagcctat

SEQ ID NO: 522070 - DNA, 943 bp, Homo sapiens
ggaagagacgagcaactacttctcgactttcatccgcctccttgctggcctgcaaccgtctccgatgtgcgccgtactgcgcgacagaacgcaggaacatcctggcagggtgatagtctgccgagacgacccttgaatacatacatccggcttaacatgtagaatacctcccacctgtcattggatcagcctgttggtgccccaggcatgtcagacgcaggcgtagagagacatctccgaaatcatcagcaatggattttacaggaggaaccacaggaaggttggtgtgaacgaggcaagaataattgcgcacgcagaccgcaacattgcggaacgctcactgctttttgacgagaatagtgccgaacagctaggcagcgctaactcatgtaggatagattaacacactgaggcaataacggtgtaagagttgtctacaaagtaaaagttcacaagacaagtggggtgctcactttgtgcgtagcgaaaatgggccccatgatgtgagtgacagataccccgatgatagttgcacgtgtgtaaaacacaattgatgttttcacagaacgtgttaagagtccacaaacttccaatatgtcatttacaagaccgcgaaatccatccgcaaggtactttcacccaaggcagtgagtataccatgtggaaaactcccgtaagagggaaaggaatactgggggcccacacaaataggaagagggtctagtgagagctgttacaaaacaaggtattcctcaggagattggtccgccatattcgcgtagcaaggggaaaaatgtggtgaaaggaacaggtattggggagacaacgggtcatccttcaagaggccccaattaaatcgagggctccaaagagtagttaacaagaactagtggaacaggggttaaccgcgagtaagaaaaaggcaggctaagaagtcccccag

SEQ ID NO: 522071 - DNA, 137 bp, Homo sapiens
aggaatggaaagcaataatccttcacatttagagtaaattgtgattgtggggtagaaccagaggaaaacaattgttttccttccattttctgactttctttaagtattggggacgatactgttattacgagaaaaca

SEQ ID NO: 522072 - DNA, 496 bp, Homo sapiens
tgactgcttggtttgagccttgtggagcgagcatttaattgtttcaacgattttcaagtgctgaccggcgaagacaatctattagtcttaaaaaaggcttatggcctaatgggagctacacctcgggtaagcgaggacttgtgacggtgtaggtactcaggggctgcgcacggtgatgaacagcaagccttaaacttcagataccaaaacaccggctctaaatcttaataaccaggtcagagcatgccacattcccagaacattgatataaataatttgaacaactacgacactaagcggactaaatttcgtctatcggctggaccataggctataggtggcggcaactgcgaccaagagcgtatggatttccaaataaaaagtgtccaccccgtattcccggaaaactactcagctatatgggacgaactctgacacctacagggcaggactgtctgagccgcactgcttacttgctacatgcttcagaacgggt

SEQ ID NO: 522073 - DNA, 315 bp, Homo sapiens
gagacacagatctaggtccccacggtgacatatgatagtgacatggatccggaagcgggtgagtgatagcaccatgtgctcctatgtcttatgccaagctaatcaggcttaaggttacagtggaaattgagagctcacagaggagcggacatgcagcaaggctgacgcaggtcaagcagcgaggggtggatgacccagggagtggctcagttcgcgaaaagctgagctgcgtgaactccacgtagtcaaacgcggtggggagctcgcggcccttgccgtccacgtagggcttcatgtgggagacgcagtagtcgg

SEQ ID NO: 522074 - DNA, 2056 bp, Homo sapiens
acttggttcccgatatggatgatgaagaaggagaaggacgaacgacacgactgactgactgactgactgaacgacggacggacacggacttacgacacgactacttgaccgacacgaccggggactgacggactgacacggtgacacgaacgactgacacgactgactgactgacacggggacggaccggacgacggacggactgaccggacgaacgactgacataaactacgaacacgtgaatggacttccaacccattccatttatttataaaatattatcctccaagatcaccatgggacagcaagattggcaagatcattatattatttatatattattctattatattataatctcacacatatgtgtgagtggcactcgagagtcagacacacagtgtgatcactaatgtgaagagagtctcctcttatatatatctactctatcctactctccaagacggatgtctactcatccaacaattattatatatgtcagtgagaggaggaagaacaaccatatcaacggctctgtgagacgctcacaacaaaataataacaagaagtgagacgtaacaaatagggcaagtaatgatatctaattcacagcaacacatattataatcagtggtgatcacgagaagaaagtcgtcaccactactaatgcagacattgcctcccgctatgcaccagctggtgcgatccacgtaggaagacacaccaaactacagcgaacagatgaatataagtggcgaacactcaacaacagcaagcacccacacagcaccaggacagccaccgagcagatgatgagcagaacaacaacacaaaccacacagagaaacaaaagcgcacgtggacccccccccattcctgatgacccacccgacgacgagtcggcctaccaagcaccgatgaacgcaagaggacgagacgcacatacacgacgcccactacccgaggaggcgatacaaagaaacaagaagatcgaccatatccacagcacgctcttataccacaagccacgagtatagctacacacactccacaccacccctatctaatcacccatgtggacacatctaacaagtcgggaggagaacctacacatgagcaagacacatcacacacaccaaagagaggacgaagcaccacacacacacaagtcgtaagccaccgaacatcatctgccgcacgcacacactcaggccacaccgacccgaaaggcacacaccaataacgacatgcgaaatcatccacggggccagacaacacatacacccacaatgaggtcacaaccacacagccaacaagcacacaaacacacacaacacatcgtcccaccaaccaccaactacgggaagcgttgattacacaacaagaacaaacgggcctacaacaccaacaccaacacaccgcacggacacaccgcaacacaccagaccacgaacgagcaagagtacgatggtacatctacaacgcatgcaggccaccgcacactcggataacagaagcaagaggtgggcatagatcccacgcaatcgagtgcaaagagtctatactgaacaacgtggagcacaactcaatgcggacaccagcgtacacggcgacgcgtgcgtcgaacgatcgtagagcatactgccactcagcacgtctcaacacaaatagacagatacagtgactgacatccactgcgctgcagtcgtaagccggagagccgccggctgcacatgcgactggcgcgagagacatgacacgaagacacacgcggagtcacaagcctaactacggacaggcgtagcatcagcacagctagagcaatcgagggccacgagcaaccatgtcacagacgcgtaaacgacgctaatgcatcgcaagcagcacgcacaaagcaccccagccacataccacagcacagagcacaagagcgcagcgagcaaccacaagagccactaccatcacagcccaccagcacgagcagcatacaacagcagctgaacacagacaaccaagcacaccgtcgcgcccaggccgcccactcaacacacaccac

SEQ ID NO: 522075 - DNA, 117 bp, Homo sapiens
gactctacgagtgatccccactggcggtgaacgacgctactctgatgaccgtggcttagtcctccaggaaggctcaggagccctacctccctgccattatagctgctccccggccat

SEQ ID NO: 522076 - DNA, 555 bp, Homo sapiens
  misc_feature (131)..(132): n is a, c, g, or t
  misc_feature (170)..(171): n is a, c, g, or t
  misc_feature (189)..(189): n is a, c, g, or t
  misc_feature (204)..(204): n is a, c, g, or t
  misc_feature (206)..(206): n is a, c, g, or t
  misc_feature (286)..(286): n is a, c, g, or t
  misc_feature (292)..(292): n is a, c, g, or t
gggtctaatctagatgatccccacgctgcagctgggagtaccaaccggttcgttcgcttgggtattgtgagttctgtgcatccccattctgttacatgcacatgcaacaaaagaacattgtgcttggcacnnccttttttcccccttttaataatggtatagagagcttnnagtcttggggcagatttngaagctgtgtgtggnanacagtcacagatgggacagtacagttccctcacttaatgcttctgtgccagcataaaattatcagagggacttcagttgnggtttnactcaggatgaattgcctggctggatactaatcctaagaatttcccgtataagttcaaacattaaacagtttcatgccagtgggacgaaatttgcctctgctttggaattccttcattgtgggtggttggaagcctgtttagaggcggggtcctggaggtacaggtctgctattctagttgtacagcttgtgtgtggactggtgcccttattgctgaagagggggtggtacctggaaatggagtgcaagctcacttcagctgc

SEQ ID NO: 522077 - DNA, 230 bp, Homo sapiens
acagattggtgagacatacatgttcatagatgggaagactcaacacagtaaagatgtcaattcttccaaagatttgatgcaattcctatcaaaatcacagcaagattgttttctacgatacagaagtagtgtatgctaaatatttatctagaaacagacataaggaactatgaataaccatgaaacaattttgaaaagagaaaataaagggggcaatcatacagtgtacc

SEQ ID NO: 522078 - DNA, 793 bp, Homo sapiens
gtggcatgctgctaaagtcagagccggatgtatccggattgagggcctcaggccgaagctggaccctggaggaaatgaaacggaagatgcgcaggagtgaatgatgatctacctcgcatcacaggtaactttgctcatctgacgtggcgctctcctgtcagaggtctacatccattctatctctaatagcataatatgtgcacaatgactactatgaaatggacggaggtgacatcaccatcatagagatttgcgaactgcatgagtgcaatgcagccctgggttgacaggctctgtctgatctcctgcgtctggcaaggtgacatacggacccaagagatacggttagtatagaggcatcgtctttgagaatgggagcataaaactctctgctgtgttacatgaactaagttcggctctggctcacatgtgaccttcagagctaagatataaggctatttggagcaagtgatgacatacgcatcgctgctcgtggatcttggatgtacccttatccctgatgacgtttggcctctgacaatactggtagaattgtaaataatgtcaaactccgttttctagcaagtacttaagggagctgtgtctgaaatggcactgtcttgtcagtcagtttctgtttacctttttcttctgcccagagtgtatcgtgaagagtctcttatattatgtggtggaaatcagcagcacaagcacaatgacatttaacgcacaggatcatcactagtctatgtatgtaataaacagttcattaagaaaaatatttcccacggca

SEQ ID NO: 522079 - DNA, 301 bp, Homo sapiens
gcattaacccactcttggtgaggtggcccagagtaactttcaaaactgcgtactcagctttgctcggatgggatgatggggttaagatacacatcgttataccccctcctttgctaaccatgatgaggctttcttccctaaggatttaacagaaaccagccctttcaaagcctccaccactgatatcaacctctcctttcttgcctgataagagaccacccacgatggagaggttctggccagcgtacagaggatgcacagagcgagttttcatgtcctctgcttcgtctaaatgcaatca

SEQ ID NO: 522080 - DNA, 501 bp, Homo sapiens
cgggcccaaccgacggactgcgcagccccgcggtcaaccggtatgcttgcccggtttcccgccgtaggtcttcctcatgcgcatcatcagtttcaacgccaatggcatccgttccgccgcgaccaagggcttcctcgactggttccgtgcccaggatgccgacgtcctgtgcatccaagaaaccaaggcccaggaagaccagctgaccgacccgatgttccgcccggacggccaccactgtttctaccgcgacgccatcacaaagaagggctacagcggcgtggcgatctacagcaagcgcgagccggaccaggtcatcacctcgctgggctgggccccgttcgacgacgaaggccgctacatcgaggcacgctacggcaacctcagcgtggtctccttctatatcccgtccggcagctcgggcgacctgcgccagggcttcaagttcgaagtgatggaatggctcggccgatcctggaggagtgggcacgcagcggccgc

SEQ ID NO: 522081 - DNA, 954 bp, Homo sapiens
cctcgtcatctcgactcaccgatagtacacctctaggtttctgaatgctctgagtgtgaaccataagacgacggtctggcgactagcgttcactaggacgtgctaatgactcacgctgcacacactactcacgcgtgagatgtctactagcgtcaggaggggggcaaaggtgtgtaagatgctgcactgccctaccgctgaaggcgcgtctgtccgggtctctcaacgtggtaggacacgcatttgtgtccacgtgggcgtcttgacaaaaagttgatttgtgtagtcgcgacaattgttaacaggaggacgatgctgccatcttctaatcactcgtgtttaggacacgaaatgggattggttggaacagtgtctaaaggcgctcacttgcggtgtcacagaagcaataaacgacgagtgacccgtggccatccgtagtggtctattactgtgcttgaggaagtgaagtggctcattcgttggtgcactgcaatatgactattgaaattcgcactcctgaggaaatcccgctaatctacttaattggtatgatccttagtgatactcctagtgcaaaccataaaacatagattataaaccccgtgtggacaagtttggactttacatggaatccagataagcataatgcaggcacagacaggaactgcatctggaataagtaatagtgcccaagaaaatgcatgtccgtcgtgctaaccacccgttgtagagctataaaagaggtctatgttgaatattaatcataccatatgactgcttctacatctatagaagaactaaactcctttacaaggaagcagactatcagccaagacaaacaagtcgccaatgacgggtactttcattaggttaaaccctgacataatgggcaaaaattatttaaaaatcctaacgtaaggctgcaagcaaaaaaccgctgttcaattagacaaa

SEQ ID NO: 522082 - DNA, 1365 bp, Homo sapiens
  misc_feature (1057)..(1057): n is a, c, g, or t
ggggggctcagcccatagggtctcccagggacgatgcctcaccccccactgaacagatcttcctacactgcgtgctcttcggcccgatgaagtggccaatgagatctgcagcacactggagcatgaggacctgtgaatcgagcccgggtgactcggactacgaatactggactctggtccttcccggatgccacctgttgcggtgtcatgtagacacaatcaggtgcacatgcttctcctgaggcaggtgaggaacttgccaggacctcaatcaggcgtgctcttgcaggagcatatgagcacgaaagttgtagaactatgctggaactagtaactttggactcattttccttgcccgttccaagaggacaatgacttctacacgaggagcaacttgtttaacatggctcgtggcccacgtcttggggcaacgtggaacccattcatagttacgtgctccgtgttagacaggggcgccttcacttgtatcgttgttctagctattcgcaacgcttggctttgtcgtactctataggttgttctacattgattggtacggttcttggtttaggattgcgcacttggccgcatagctaccctggccccagggcgcgttcccgtaattgtcctcagctcccctgcttacttcttaggagagccacggagtctgggggcgtccgaaggctgggcccccaagatgtcgtgggcacacgtagggccaaacgtgtggttgccttcctctatgtgccccaacggtgataggactgtgcttacactggcgcgcgatatgtggcacccagcactattaattccatccgttgggatacacgccaagcgcggcgcggggggcaaacttattgcaacggcgctatgaggcccccttagcaacaacaaataatagcgagtagccgggcgattccttctcccgctaatgcttaccccggtgacctaaggtcacccaccaagttgggccaaggggttcttgcgttggtagggtcccaccaagaccaaggaggaattgaacgcccaccattacataaagttccccgtgggggtntggcttaagcttgccctttcaggccatctgtagtgcaatccaacaaacagggcttcttgggatcacagggaagggccgcaaccagaaggccttggcacggggcttcccacaccacgacttgcacttttgacagaaccgcactttttcacaccgtcttcagggagacctgacagttttcgcgcttgtgacacaaccggagcattcacagcgggtgccgcacacaacactattaccccccaccctcgtcgcctgtacttctcccacgcgtgccacatcggtggtgtcacacatatacaccccccaataga

SEQ ID NO: 522083 - DNA, 1038 bp, Homo sapiens
ggagtgagcgcggacgtgctggtgctgctgctgggcggccgcggtgcagcggatgggcgccggcactccggtccccgccgctccccgtccccgtctgctcctagcccctgccgctgtcccggcggagctgtggcaatgcgccacacacgcggagcctgtgccgtggaccgtgtgggccgtgaggatgaggacggctgggagacgcgacggggaccgcaaaggcccgtaagccccttggtggagaaagaagtcgggcgcgcgcggattcaacggaggagccttgcaaggagcttgcgggcttgcttgcctggtcggcgcgccgacgggttgcagggccaagcttggcaggaacggcccgcagagtgcttggaagctttgaccggtgtcgggcgggggtcccaaggggttgttgcctgggcggggggccctgggcgagcgccgaggtgaagttgcgccgcgcctgtgtactctgagtccagaggatgaatccgagcacagagaaccagatgaagaagaatgaccccttgtatataagacccacgttagtcaccaaaaaccagggaaacagggaaacttattgcacgattaccaccaggagcaaggacgacaccatttattataaccatattattatcacgagcaaagtagagtagaataacgggcattatcagcaacaacgggacaatagcaatcagtagtgtatcgtagggaccaacccccacagagatgatatacttacacctttgctagggttttacatacccaaccgacgggataaaagcacaccgaacaagtgggaagccaaaagagagtaagacagtcgcattagagagacaccacacagcacaaagataaacaagaccacagagaattagaagcaacgacagcacacgagcgagaaacactcgggacgaccaatattaataaatacacgcaatataacaacaaaagagaccactatcagcaacatagacccaaacagaaaaggagagcagtacgaaaatagccatatgaaaggggacgcgaaaacaacgaaaa

SEQ ID NO: 522084 - DNA, 300 bp, Homo sapiens
  misc_feature (1)..(1): n is a, c, g, or t
nacacacgccccaccaagagggcggaagacctctctaagtataagtgtgaaacgtgtgctccccaatgcagattccacgccagtacaagatcccagattggttcttacacacacaaaagattgtaaaggttggaaaatccagccgggtccaagccaatggtttggacaacaagctccgtagggcccttggtgtccaaggccagcaccccaagaccattggcccccgtgcccgccccgtgggtgtgtccaaaaagaaataagtctgtagcccttgtctgttaataaatagtttatatacct

SEQ ID NO: 522085 - DNA, 666 bp, Homo sapiens
aaataaattactgtttggcagggctgtggggggaatggagagacgtagctaatgaacatttacatataagtggtatcatacagtatatgatctttatgtgattacttcttcatatagcatatgttttcaaacattacacattacagtgtgaatcagtacttatattcctttttattgccaaataatatttactttattactgagacggcgttttactcttatttgcccaggctggagtgcaatggcgtgatctcggactcaccacaaaccccacctcccaggttcgggcgattctcctgcctcagctcctgagtagctgggattacaggcatgcgccaccaagcctggctaatatttgtattatttaagtcgcggacaaggatttctccatagtaggccgggacaggtctcgaatctcaggtgatctgccgcctcagacctcccaaggtgctagggatatacagagtgctgagccagcagcgcccggctgcacacataatatttcatatacgtggataatactacatataatccattatataggatcgatcaacatttgggtctgtaacccatattcacggtatataaatgtttgaaccatttatatgtaaagtccattgtaccgtatgcacacacaccccacatatatctcatatatatatctaa

SEQ ID NO: 522086 - DNA, 127 bp, Homo sapiens
ggtcggcccatattcaccgctatacaccaccaacaagtcattattacctcactgtcaacccaacacaggcatgctcataaggaaaggttaataatgacttgtaggtggtggtatagcggtggtatag

SEQ ID NO: 522087 - DNA, 129 bp, Homo sapiens
  misc_feature (34)..(34): n is a, c, g, or t
gtacctatatccataatgggcctgattgcaccanctacactgctaatctgatactcagtgcgcctgcttgatgctttgcatgactgcagcagtttttctgtattcgggcagtcactcaatgttcttgga

SEQ ID NO: 522088 - DNA, 150 bp, Homo sapiens
ggaactggaggctgcagcgagccatgattgcaccactgcactccagcatgggcaaggcagcaataccctgtctcaaaaacaaaaaaaagcatttattgagtgcttactcaatggtagttaggcactggcctggacactttgcatccagag

SEQ ID NO: 522089 - DNA, 144 bp, Homo sapiens
cgaacagtgtgcttgttggttgaagctctcagagagggcgggaatagatccgcggactctcttccacgcccccgaccgcactccgaacacctcacacgattgcaccctccgcgacaccttctcggccatctcctgcttcttggg

SEQ ID NO: 522090 - DNA, 144 bp, Homo sapiens
ctgtaccccaatcttcagcagacgacgccacttggtgaagtcggctccgtgcttcttgtacgtgtacacggcgctcagatagcccatccaactccttggatggtagtctcgcgatttgtccctgtcattgccccagcgatgctt

SEQ ID NO: 522091 - DNA, 282 bp, Homo sapiens
gcaattgcccagactgcgtcttcacgcagttcatctttgagaaattgggcttgttgcggtgaccagaaatccgcgtcaatcagctttacgtcatcgggcagggtgtgttcgccgataaaggcgtcaatcgcctcgggggacgattccagtccaagttgttcaaacaggccttcgagggtgtaagtcggcgcttccatatcgttctccatgcgggctgatcatcgtatgcatgggagggttgtcgacgcggccgcgaatttagtagtagtagtaggcggccgc

SEQ ID NO: 522092 - DNA, 518 bp, Homo sapiens
  misc_feature (324)..(325): n is a, c, g, or t
  misc_feature (423)..(423): n is a, c, g, or t
  misc_feature (457)..(457): n is a, c, g, or t
  misc_feature (494)..(494): n is a, c, g, or t
cccaatcggatcctgagtgatatatcgcccctgcagcgggtcataatagcggtggcggttgtaatacaggccggactcctcatcatactgctgccccggcagcggataagctgctgcagctgatgcgggttctcttcattcagcaggttaccccattcatcgtattctgcgtaccacgctgttgtcccttccgtgctgataagggccagcggcaggccgcgatggtcgcagtggtacaggtgaatttttcgcgccggcgtgtataccgggtccatctggctttgcatctgcgccaccgtcagccgcacgatgccagccagcggnnggctttcctcactcacccggtcagccaggattcatttccagccggtcgagcattgcaacagcacggcgggaacaacacactgccaacgtcttcgccanggactgtgaaggtatccgccaagctgcggcgtgnttttcgccagtcaacggtggcggttcaacctgatgantgggtggtccccggctgttcgtct

SEQ ID NO: 522093 - DNA, 666 bp, Homo sapiens
gaagcagtggtatcaacgcagagtgtccattacggccgggcgcggtggctcacgcctgtaatcccagctctcagggaggctaagaggcgggaggatagcttgagcccaggagttcgagacctgcctggggcaatatagcgagaccccgttctcccgaaaaaaaaaaaaaaaaaaaaaaaaagaaaaagtggtgtgggggggcgtggggccccgcgaaaaagctttctagagaaccatcgcgcgtgggggcgcgcgggggcgcccgagggagggaaggggaaacgcggggcgcaaaagcggggttcccaagagagaaaccgggggccaggaacaaggggcggggatttcccaccaaaaaaaagaccgcccgggggggacaaccggaagggttccggggaacaaatcccaagagagagggagtctcgggagggcgaccataagcggggggactcttatatcacacagaggggggagcccccaaggcgaagacctcagaattctctcaaaaattatagcccccccgggccccgggggggggggggaccccgacgagggaagcagaagaggacacgtacacaagagacaacggcccggcgactaccgaacaagaggaaacacaagaatgtaaacacaaagaagcagggcagctaggagaaaaaaaagggt

SEQ ID NO: 522094 - DNA, 105 bp, Homo sapiens
gtggctgagtgaaagatcacttgaccctggtaaatgtcaaggccacagtgagccgtaattgcaccactgcactctagcctgggtgacagggcaagaccctatctc

SEQ ID NO: 522095 - DNA, 119 bp, Homo sapiens
ccttgtcccttcacagtgccacactggggcccagtatcaatggacatcacctgagatcttcttggcaatgcagcttctcaggtcaccctgccgacctactgaatcccagcctacctttt

SEQ ID NO: 522096 - DNA, 192 bp, Homo sapiens
atgttgtaaatcagagccttaatcaaattggaaaggcagttactcaaaggactgggctacatattctgtaattatgcatttatgataggaaaatgaaatttttgcaaacagacattttctttttttctgggctggagtgcagtggggtctccggctgatcgtgaaggctaccgagctcgaaatacgtaaatc

SEQ ID NO: 522097 - DNA, 656 bp, Homo sapiens
ctccgtcaggaatgttttaatactgttgtccatattttcctcctgggtactttatatagtagaaaatgtttatgtaaaaatattataattatttccccacggtgacccctgagtaacccccatggtcccccgaggactcacagggccacagcttgttgctgtggggtgagagtcatctctattccacgagaggccaccacctttgccccacacccaattctttcgcccggttctttggaacactgttgagacccatttaagggtgccccaggtcttgggtgtaaagggatacattttattgccagacccattagcaccaaacttccctgaaatgccccaagtgcccctgcttagtagccttttggaaaaggtggccctctatttgaccacttcctacgaaggggtggctgggtcttccaggagtctcctcgtttttttcacggctcttagaagtgacactccgccctttttagacttggttctgttttcgtgaccttccccctggcctcccagtgatgcccatgatacccctgcctgccctctgtctgtcttctcctaattctggccgcgtggaggttgctagtttagatttcctttttgagataactattttcatttttgtgagcctcttcgtaataaaatggtacaattctata

SEQ ID NO: 522098 - DNA, 300 bp, Homo sapiens
gtatagtgatgattcgttatctaacttgctacagcttattgttatgattgctattatttatttatagtttgttttctctcttctaggagctttgccatgatatagaacagtccaggccaggcttgagcctccgcgccctgtccatatgtaccatcttttatataagatgatatagtcacagtgatgagagtcttccccacccctatagaaacttgtaggtgactagattagcgaaacaataatttatttgatagagacagggtctctgtttactaagctgaagaaaagaggggtaccgag

SEQ ID NO: 522099 - DNA, 860 bp, Homo sapiens
  misc_feature (567)..(567): n is a, c, g, or t
atgagccgccaagtcacatgccgatcatatagatgaaactcagcccgatgagctctaacagagggcctgctcagcgcctcttaactgagactcgggtctagacttctgctgagtttcagtgtcacagatccatgagacgcgtcctgctagtagcgtagggccgtgacgtaagcctgaagcacgtatgccatgttaccacatgaatggcgcggtgtgtccacgtagaaggcgcgattccataggtaatgcagaccagcgtgtccaaaagaagggtttcgcattcgggactaagtcgctattggtctagctgcagaaacgtgggtattcattcggcggggagatttgttgctcgggcctttgagcgactccatgactaggcctgctagcgcgccgcagatgttagtgagggacgacatgggcgcagcgatgcaggcactacacgccggactgaaaggtccccgtaggaagttcaccatttcgctaggaggagcctccgttatccaactcacagtcgggggggtatcaaactcatcttgcagctctacaccatagtctgagtgcgcagcnaaggttgcggatcaacggaattaattcgaccggcggtggctgtgatgcacaaatgaacattcgggggctcctcatattgtaggcctctcgtgacatgcgctcagatgtactctccgagtgctaccctgtcaccatccgtgcggagcgggtctacaggcgcaaacggtctgggtgtaggccgcagggtccccactggccttggaaccgcccattatgggggcttcaaccttgcgcccagggatatagctggcatccgggcaagctaatgggacagcgtccagagtgcagaatgc

SEQ ID NO: 522100 - DNA, 555 bp, Homo sapiens
ccagtacggatgtggaaagccccctctttctctccatcctcaaactcaactctgaaaatctcttgcttagttccttcacttctctagtttgacatgctcacctgcttccatatcttcccaagctggctgctgcttataaacatacccgagagagaagtggctggaagtaggaagagcaggcaagaaacaagtagtgggaaggacccagagtgtatagaaagtcgaggatcacaggtccttgagaacagggcatttttttttgcagtggtcaaaaggagagacagaaggcagagatcctgggcacaatcccaaaatagtttccagacatcctcagccagtcaagggttcccatggggcagagtgtgggagccgtgtgggagccttgaaagcagggcggcccggtgttctcggcactgggcactcactcccctccaggctgccaacgaggaggtggtagcaacagtgtctgctatagcgtgttccttgagatatcacgggtagacatgtaatgcaccaaacaataaaatgtcaacttgcgtttatcaagctcaactc

SEQ ID NO: 522101 - DNA, 187 bp, Homo sapiens
tgtaatcagctcgtaccattcacacatcaagtgcggttgactttctcggaccaacacatgcaatcatggtggtttttctctctcctccgctgccatgcgtcgatcactgattgtgatcgctccgctttctccaaaacctcttaccattcaagggtgcaccgatcaaactgccggtttctaggccgtg

SEQ ID NO: 522102 - DNA, 146 bp, Homo sapiens
  misc_feature (4)..(4): n is a, c, g, or t
  misc_feature (35)..(35): n is a, c, g, or t
  misc_feature (51)..(51): n is a, c, g, or t
gtgnttttgccaaacccagggcctcagcgaccatnacttctgcttaaaagnaatcatgagtgcgtggctggggacagacctctttgaagtgtctcctgttgtgaggggcttcactttggagccactgaagagccgactgtgccacc

SEQ ID NO: 522103 - DNA, 1156 bp, Homo sapiens
  misc_feature (333)..(333): n is a, c, g, or t
  misc_feature (725)..(725): n is a, c, g, or t
acgtaatttatggctgaatcatgcgctaccttcacgccaatggcgcctcaagattcgttatctgcctcttcctacacatcgtacgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatgcgacatcccatacattgcgacagacctaggtcaatgaatctgaagaggctactcagtagacagtcccaccctcacacgattctatacctttcacnttatcttacccttcagtattgcagccctagcagcacttcaccttctattcttgctccgaacgggatgcaacgaccccctaaggatcaacgtccgattccgataaatcacctttcaaccttactacacattcaaagacgccctaggcttactctattgcctgggctcctaatggactataaccactatctaacctggacctcctaagcgaaccaagccattattaccctagccaaccccctaaacaacccttcccacatcaagcccggatgatatttcctatcggctacacaattctgcggaccggccgtaacaaacttaggaggcgtcttgccctagtactatccatcctaatgctagcaataacccccattcctcatattcccaacaacanagcctaatattcgcccactagccatcactttattgcttctaagcggagcctcccattttacctgaatggaggacaaccggaggtaccctttaccatatggacaagtgcatccgattatctaaaacaatctaacctataccaattttccctaatgaaaccaaacttaaggggcacaaaaaacaattggctccttgcaatcccctttggggggatcaataaggggcgttttaagcgggcggaaaacctgggtccaatatagcgtgggaaaacccttgcggggtggaaaaaaagagcccccgtcctttcaaaggccccttgtggcaggaaaggggttttttaccggaattgtgaagctttttaccgggggggggactctctataaccccggtggggggtccctgacaacactttgaggcccccagggggacctc

SEQ ID NO: 522104 - DNA, 207 bp, Homo sapiens
tacggggttgacgactgacgtgtgacggcgtataatacccactacgccgcctagtttaaagacgtaccggcggcaacgtacctactggaccccaggactgtgggacctgggcccaggactgttggacctgaccccaggactgtgtggactgaccccaggactggggtacccgacgctcgacattcgtacatcatgggtcatacgctg

SEQ ID NO: 522105 - DNA, 332 bp, Homo sapiens
acatggggcatggatgtgtttttaaatgtgaggacatgagatttgagagagggggctgtgacagaatgatatggtttggctctgtgtcccctcacaaatctcaccttgaattctaataatccccaggtgttaagggcggaaccaggtggaggaaattgaatgatggaggcggtttcccccatgtggttcttgtgatagtgaggttcatgagacctgatggattcataagcgactggcatttttcctgcttgcatgcattctctactgtggacctgtgaagaggtgccttctgccacgactgcaatgttcttggcgcctccccagccatgtgg

SEQ ID NO: 522106 - DNA, 255 bp, Homo sapiens
tgaccgggtcaatgtcccgctgcttcctggctatggctgagagcgtggcctgcggtgcgcacatccgacaatggctcgtggtctggcgtccatggtgctctcccggttgctcaggctgccgaaagaggagtcgccgctggacgtcccatcgtgcctgaagtggggatcaagagatagcaggggctgtggggcagccgtgtacctatactgggggatggcttgtatctcacgtatgttgcccaacccggtggtgga

SEQ ID NO: 522107 - DNA, 1531 bp, Homo sapiens
ggaacaagcgccttactataggcggctataaagggagcgcaagtagacgaaatgctaggctctgatccattttctaagaacagattagggatgagtgtgacaagcgccttgcctcatgttcaatactaataaatattgggaacagaccgcttgcgtacactaggactccaaagtgggaccacaagaatttggatcctgatcggtctccacggtgatcgtgatgctattgcaagctggaggtcatagcagtgaagtctatgccagagagatgagtgaaagctatgcgaatattgagaaacaatgtcaacgactgcagttgacatgccaagtactggtaccagtggctagaaaatactgacactaaatcctatactatccaatgtgacataatggaaatcatataactcgcgctgcacctacatagtgtctgattccccattggattcaaatataaatctgtggagggaactaaactgatttagaaaccctttcgaacgatttgcattgggtccacacgcaacataacccggtgtgagatttaacttgttggatattcgctccttagatatacctagatagtgtggggttattttaccctaatatacacaaagcggtcgaaaacaaaagtccaagggaattagctgagcacaaggaacccatccttttaattgccctaccagtgcaactcagaactaggggttcccggccacgaaagattcacgggaggaaacgaacactgaattggatggggaccaacgtcccaatgtgaattccccgcgaagaatgcgttcgctagggactataacactcggaacctttcgggagaagttgcaagaaattggagttcgatctaacccacttttggaattatacacaagcgaatgcatgccactttagggaaaatccactaacattaagaaattgagggagtttatgagcgcaaaggtcctacatttttaatcccctccatcaccaagttggactaggtactctcccggtccttagagaaaggaacagggtcctacataagttggcacttgtacctggaaaaggctctcacaaaagttcaagaaacatgtgtgggacaacaggggcctccattgtgaaggctttcactgtatgggcttgcactgggtcggcgacaagaggttacttggggagaagtacgaccaattctgtgtgggcggacactgcattgacacatgtctttggcgtgaacacatcgtcttggagaacttgaacgcctggatcgagggtcattggaaaatcccacccgaaggaaccgaacggaaaaccatagggcggagaacacggtcgacagacactaccaaccattcgtttgggccccacgctgaccaaaacagcgcgccaatgtcgtgcgaaaagacagcagtaccaccacgacacacatgagcggagatcacataacaagagaggacggcgaacaacaacgggacacagacaacgcggacaagagagacaaaggagaaacaaatgaaacaaacaccaaatggagacagcaagagagaac

SEQ ID NO: 522108 - DNA, 335 bp, Homo sapiens
ggagctcctctttgcagcaatatatcttcaattgctgggccttaaagttcccacagaggccgggtgtggtggctcacccctgtaatcccagcacactgggaggccggggcagatggatcatgaggtcaagagaaagagaccatcctggccaatacgatgaaatcccgtctctactaaaaatacaaaaaattagctgggcacggtggcggatgcctgtagtcccagctgctcgggaggctgaggcaggagaatcgcttgaacccgggaggtggagtttgcagtgagccgagaccacgccactgcactccagcctgggcgttagaagcaatccgtct

SEQ ID NO: 522109 - DNA, 431 bp, Homo sapiens
  misc_feature (6)..(6): n is a, c, g, or t
  misc_feature (13)..(13): n is a, c, g, or t
  misc_feature (91)..(91): n is a, c, g, or t
  misc_feature (178)..(178): n is a, c, g, or t
tgaaancccctangggcctgccatcccccagatagttaaggccattccctaagtccacaggatgagataggaggtccagccacaagatacnggtccgtaaagacccctgcctgatgaaacaggttgccaggaaagaagcccagcccaaaaccccactgaaacccaaaatagtcacaancaggtgacctctggtcatccctccctgcctacattccccacccagtgctgtgacagtttacccaatgcccgtgacatcaggaagttaccctatatggtctaaaagggggaagcatgaataatccatcctttgtttagcatataaacaggatataaccgtaaaaataggcaacaagcagcctcacggctactctatctatagagaagccattcttttattcctttattttccaaataaacttgctttcacttta

SEQ ID NO: 522110 - DNA, 253 bp, Homo sapiens
  misc_feature (1)..(1): n is a, c, g, or t
  misc_feature (116)..(116): n is a, c, g, or t
ntgaggatccttctatgtctcgatcgttacaaaacttcactgacagggcttgggcaaggttcaccatgaaagcagaaatgtcacaaaacaatggaggtggggcctttggggctaanctcaaatgggtcctttcctttggtagttattcttacaaccaaaatttacacgttagaattttggttgtattgtgtttggtgcttcccttgtccccttaagtggccgggaagggggggaacttttaaactttttcccc

SEQ ID NO: 522111 - DNA, 1418 bp, Homo sapiens
tgtggtgggaaccagctccctgcgaagagcagcccagctgcagagcaaagttcccgtcatctggagttcaggagtattcggggcaaacctcaacatcccgagcttacggtaaagctaggagcgagccagccaggcagtatcacgtgtccgatacatatccgtgtgtcgaagctaagccctagggcgcgtgtctagtcctgcctattgcgcgactctgagtccgtacttaactctgagcgcctgcgcgcgcccagtcagtccgctgacccacgcccgtgccagcgccacagttgtcccacttgacttacttggccctaggctgcgcgggccctatggggccgcgcccctcgctctgctgctgcgtctccgtcttgcggcaccatgtcttgcccctgtacgttccctgtatgtgtgtggctattcccgtgggcgctatctctcgttctttttggcgccacgttcctcggcgccctgcggggccttcgcttggccgcttggtgcgtccccgcgaaacttccccctgggttcacgtcgaatctcttttcggctaggaccccgtttgttccctgtgccttctttgtgtccctacgtgtttcccgcgctcgtttcgcgcatcgagccagcggcgggtcggcgctgcccgtatgtcgcgctcgctttggcgcaaggtcggttccctagtgcgcccgctttggtcgggctggccttacgcctggcgttcatgggtgggatccgtttttggagcctcatgcgagggcgctggcggtcgtgggcgcctccaccccacgcgctgctttcacagcggcgcgccgcctggggtgcgtgagggcccgcaccacggtttagcacgccggatcgtggtccgtgcttttcatgtttgtgggccatctcacgcgtcgtgtggtccaacttttttggtgccgggtcgtgcccctgcagcagtgcgccggctataggggctgtcttaatgcgccgcgctcccgtatttggtgcatactccgccagttgggtctgcccctacgtcgtgtccgggcgactatgcgcgttttcgtcgctatctgggccgcgctccatccggtgatcactttacctcgatttggacagcgggccgtaatcacccgcggagagggagacaccaatttatcacgagcaagtgcgccaacagctgtttaaaccgatgcgcctcgacaggcttataaccggcccacaactacacgggcgccacaggggacatatgccgtccctgcaacctttgttgtgccgctcatatctgagtgaccaccgccattaaacaccccgacggtaagagtattgctcgcctcataagctatctgaggtcgttaacgccacagccaccgtattgtggactgcacaccacgactacgacagagaggctctacactgtatcagccgaccat

SEQ ID NO: 522112 - DNA, 326 bp, Homo sapiens
gggcaggttcagaaagggaaaggagtgggctagaggttttatgttttattcacacagcatggaatattgaactgtccatgataaatggaggcataatgtaaccagttagtatttcaaacatttacaagcttctccatgttcccttgtactttaataagagattgagtgacaaataattttctagaactaaaagagcacaatcttcagtgatctccccttctcaatataattttcttttcttttttttttttttttttttttttttttttttttttttttttttttttttttttttttttttttcaacaagggaaaaaaaacctttt

SEQ ID NO: 522113 - DNA, 228 bp, Homo sapiens
gaccaagtaccacagtaggatgaatatagcagttcgtaccgtagcaagcctaatataatcattctgtaagtttaactatttagtattatcctgactactaccgtattcctactgactcaacattaaatctaccagcatccacgagcctactattatctcgcacctgaaagaagctaacttgactaacaccctttattccatccaccgctcccctccctaggaggcctg

SEQ ID NO: 522114 - DNA, 412 bp, Homo sapiens
  misc_feature (3)..(3): n is a, c, g, or t
  misc_feature (62)..(62): n is a, c, g, or t
ccnattaccattaagagacgcagggccttcaggcagactcggagggtgtcaacgcctgtaancgtgattttttattaaatcctgttttaaaacgggatggacttttattgatggaaaaaatcacgttagttagaagctctcaaagtacctggtatttacaactcctgtcagggagggcgaactcgatctcagagttttattttcatcagggattacgttgaggtacccagaatgagaagatttgcccaaatggcatattttaaaattggcccagaccagaacccagtttcctctgggattatttgttagtaatcgttttacaggctgagcatgtaactccaaagcttgaaggactttttctcattttcacttgttttctctaataaaaataatgctgtaatttcaacttcac

SEQ ID NO: 522115 - DNA, 932 bp, Homo sapiens
cttggtagacagtaatcatcacgagaaaaaaaaacaggagcgcgtacgagttcgttgtgcgtttgtatcccacgctttttggcccgcgtttctcctgttgggggtcctcgcttgcatatatggtgccgaaactcctggtcctttgagaactttcacgctggggacaacaaccggtcttttcaaaagcagtgttctagcaccgtgggcccccaactaaggactcgccaattcctttatggtgtcattaagacgccacgcgtcgagattgatgctaatggctcgaaaactggttccgcttccagcgccttggaccccgcatttcgtccggggacccaaaacccagtcgaaaaaatggcgccggaagttcgtcagacgttcccgcaagtattttcaggcagcaagagagcgccctttcattgcagatctctctccacggggccccccgtagtctcaataattccccccggcggcagaaatcaaggtatggttgtccccactctgccgcccctgaatgtggaagaaagacttaaccattgttcgaaagtcccttcaaattggctcttggaaaaaatttgcggggcgcaggagcacccaccgcgggtgtgaatttgtgaaaaaaggtgggagacccctactgtgaagtggttttgacagagaggaaaaccaccctgcggtgtcggggtagccctcatcaatagtcagtttttgataagcgcccaagagttttcccacccccaggaatgaagccagagaaatatttttggccacgagatccgtttggggaccaccattaagcggagagggagcttgatatattccatacgctcatgacgcctatcgcgccaacctcccacacacccaggggacaaaataacaggggtttacataaagcccccccccgcaaggaacacccgaaaccccgcaacataaca

SEQ ID NO: 522116 - DNA, 727 bp, Homo sapiens
tccccctcctcttttttttttgccccaaaaaaccaaataaacccccccccccttttaaacggggggggagggagagaaaaacgacaagaacccgaccaaaccccgcggggaagaccacccacggttccggcgcccccgcgcatatatatacgcgcgcctcgcgtgtgggagattacgggtgatacacacatgttgtgcgccacggaggcggcgggggaggagagaggagaggggggggagcgcgctctcctcggggggggcgagatcgtggcgcacactgagagagcaccccctctgtgggagagagatataccacagagagggtggagagtgtggagagagagagcgcgcaccatcgtggcgcgcgcgcgagcgggtgttctctcgtgggggagacagcgggtgggtgcttgcgctcccccacagaaaactactatcgagaggggtgcgtgtgagagagagggtggtgtgtgagggagcgaggggggttgcccactccctcaagaggtgtgtctaagggagagagggtgtgtagactcatcgagaagagtccacatcgaggagagggggggggcctctcccgtgcgggatgtggcgccctaggagagggtgtagtgcgcagcccgagaggagtgggaaagaggggggctgaacagaaagagggttgttttaacacgcaagagaggggctcccacatagacgaggggcgggggagaaaaagatgaat

SEQ ID NO: 522117 - DNA, 110 bp, Homo sapiens
gcgcctgtgacactgggtcgaaggagttctggccgacaggaggagttcatgaattgtctgctgttggacactgttgtagattggtacgacatgatgacagctggcctttt

SEQ ID NO: 522118 - DNA, 309 bp, Homo sapiens
  misc_feature (132)..(132): n is a, c, g, or t
acagggtcttgctatattgcccacactgcactcaaacacctgggctcaagctatactcttgcctcaacctcctgagtagcagggactacaggcatatgccattgtgcctgtaggtctcacatttaatgtganatttactctcttaacagatttttgagtatacaatacaatacaatatcacccccagtgttgtacagcagatctctagaattcatttatcttatataactgaaggtttatacctattgagtagcacctcacaatttcccctttctcccagcccccagaaacccttctgtcgtcttctcc

SEQ ID NO: 522119 - DNA, 513 bp, Homo sapiens
tcggatacataggtatggctgagctatgatatcaagtggattcctagggtttatagtgtgagcacaccatatatttacagtaggaatagacgtagacacacgagcatatttcacctccgactaccatagatcatcgtctatcccacaccggacgtcaaacgtatttatgctgactcgccacacatccacgtgaagcaatatgaccatgatactgctgcacgtgctctcgagccctcaggattcatctattcttgttcacctgtagagtggcctgcactggacattgtatatagcaacactcatcactagaacatcgttactacactgacacgtactacagttgtacgctcacttaccactatgtcctactcaatagtgagctgtatttgccatcataggaggcttcattcactgatttcccctattctcaggctacaccctagaccaaacctacgccaaaatccatttcactatcatattcatcggcgtaaatctaactttcttcccacaaca

SEQ ID NO: 522120 - DNA, 138 bp, Homo sapiens
caggaagcaagcgtccaaactcacagagaaagagacctcagcctctaactgatcactcaaatccgacgtcaatccctctattgaaaaaaagttcacacatagtctcccctcagcttccccagtcgtctgggcgacagg

SEQ ID NO: 522121 - DNA, 113 bp, Homo sapiens
actaaatttcatgtttccagtccttctccgtctagttcattctccacacagcatccaaagcggttcttttaaaaaattacaaatgaaatgtgctcgcggtcctagccatagga

SEQ ID NO: 522122 - DNA, 363 bp, Homo sapiens
  misc_feature (87)..(87): n is a, c, g, or t
  misc_feature (110)..(110): n is a, c, g, or t
  misc_feature (246)..(246): n is a, c, g, or t
  misc_feature (327)..(327): n is a, c, g, or t
tcgcttccggtgcgaggagaaaatgtggagataagtaagacgccctacccggtgttgacccgcatcgggttggaaaggtccttgcgntaccccatccagctcttcccaantgccagcttggtgtgccggaaacccaagggtacaaaagtgcaggtggatgacatcaagcgggttttctccctttttttgggggagtccccctccccccagtacatgaaggaggaccagggccccttcctttttaangaactcaaaggggagaccatggacccctcctgagttggatgttttccccccccccccccctgttttcccccaaagttttgnccctgtggcttgtataaaatggttgggaagctgcca

SEQ ID NO: 522123 - DNA, 133 bp, Homo sapiens
acgacgtcaaccgcaatgcgtctcacatactgcacagcaagctgtattcactttcacgccggatctttatatgttgggactgcctgtccattaacacacaccctttctgcatcagccgtgcacgtcacccaag

SEQ ID NO: 522124 - DNA, 899 bp, Homo sapiens
gcccagctcggagccagtgcaactccacctccgtgggttcaggcagttctcgtgccgagcctcccaagtagctgggactacaggcatgcgccaccacgccaggctaattttgtattttgagtagagatggggtttcaccatgtctcaaactcctgacctcaggcgatccacccacctcagcgtcccaaagtgctggcattgataggcgtgagccaccgacctgggctatgagtggtcttgaattaggaacaaatctaatggaaaggagagttgactgaagtaggcccacaggatgtgtgagctgggcagtgccttcatgaaggctagccaccttgggacgccccagtttactggggtgtcttgcggtagtgctagaagggctttctggctagctgcctgggtttggcctagaccctgcctcccctcccgccggccaacccctagtccccttacctgtggtccactgtgcattcaggggtggctgcgtgtgtctgagaacattaccaccctgggaagagcagatggagtcacactgggattcctggtgggcattattctgaagctttgcgtatccagttgagtcccccttattccagctgtggcattgccgttctacgcagttacctgatgcctgtgctgaagagctgctcacaggaggcggcggcggccctggcactgccccttgcattaggtctggggtacgctgtgtctggccaccttccctttgtccgaccagaatttaccgttgggtccaggacttctttagggccccactggctggtgattccgagacctccgtgcttgtattaccccgttgggtccttggcccagggcttgcccctaaggcccccgtgtgaccccgcttccacgttcaagcgccctgggaggggcccctccca

SEQ ID NO: 522125 - DNA, 236 bp, Homo sapiens
tcccgcgttgtctacagagaaacatctagcctaggtgagtgttgtaaggagagctggcatagctatagcacggactagtgccacgatctaccatgagtctacgccgaaggagcaattctaaccacacttataattaggggaggcatgtgatgtcgcactgcctctcctcctcttatgggtagtcatcagtgccctaatgggaccactccttgtagtacgtcaccagtgaccatgtc

SEQ ID NO: 522126 - DNA, 183 bp, Homo sapiens
gagggcttcaacggaacctttaaggggttacaggattgttctaactcctggggtcaagcaatcctcctgcctcagcctcccaagtagctgggactacagtgcacattgctatcgcactaggctaattaaaacaaaaaaaaaattatcagagcatggggtctcacatagtgtatgccccaggct

SEQ ID NO: 522127 - DNA, 547 bp, Homo sapiens
cgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattattgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgactagatttaaa

SEQ ID NO: 522128 - DNA, 364 bp, Homo sapiens
tcatgcttttgaaataatctacatgctactccatcttcgatgaacaaattttgtatttaagccagtcttctataatgaacatttagcttgttcctgtgttttgctactataaatgatgcctcaataaaacttggccattcttcatttcagtttggcataagataaaaatctggatgttaaattgttgggtctaataggtctgtgcatttataaatctgatggattctataaaattatcctccataaagactgtcctaatttacattcccacacaaaattcaagtacctatctccccattcaggctaacaatttgctaaatttttattttcatcaatgtaataggtttttaaaaaatggcatctg

SEQ ID NO: 522129 - DNA, 107 bp, Homo sapiens
gaaaacggacatagaggcggggtttcatcatgtaagccaggcgggtcccaaactccggacctcaaaccatccttcggttccagcctcttaaggggcgggggtgacag

SEQ ID NO: 522130 - DNA, 1100 bp, Homo sapiens
agcggcgtcgccaggagcagagtgtgaagacagtccccggagccagcgatcttttttacttgggcaaggagagccgggaaactccagtgttcccaccacaagcccctgtccaagacgggcaatggactggcggggcacgaagggtggacaattgcactcccgggccgggctgctggcccagaatggatccttggggtgaaggaatccatgagcctggggtgtccccgccggggaaacagcacgaaacggcgtgtgagacttgaagaaccccttctaaccgctgaaccaggagtcctatgtgaggcctacgcgggtcatgtgtctggtccgtgggtgatcttcgggaccggcatcattgggaacactgggcggtgatgtgcatcgtgtggcacaaagtactacatgcggagacatctccacaatccctcttgggcaaactgggcttctgggaactttactcaattcatcttctttctggcttccgctgggtcatcttccaacgaagctgaccaagaaagtggctgctggagggacttctccctggcaagaatcggtgccctatatagagggtcggttctctgggaaatcaacaacctttcaaccttaatgtgctctgtgcatagaaccggatttccgttgctagacacccagaagtaccagatggttcctacgcagatgatcgcagaactggtccctcataaaagtgggcaaacttgctgggatatagggtgggagcactattgttaaggaccttcacagacaggttgggtcatcccggcaggctggatgccacgggaggaaaatggggggggtaaaagtgggacgaaacacccggggaggaaaaggtggggagtacatgtaacagaaacacgtgcgtaaaatttaaccagaaacccacaatctaattattctagagcccactacaccgatagaaaagagggaggcaaactgagagggggaaactaaggggaggagcacctataaggataggcagcaacagcgtatttgccagctcaaacccgtgggcacgtatgcagagcgagggagaggcaaaaccagccgaaggaagtagaagaccgggagcccaggggggaacaacg

SEQ ID NO: 522131 - DNA, 365 bp, Homo sapiens
  misc_feature (31)..(31): n is a, c, g, or t
  misc_feature (64)..(64): n is a, c, g, or t
  misc_feature (75)..(75): n is a, c, g, or t
  misc_feature (81)..(81): n is a, c, g, or t
  misc_feature (103)..(103): n is a, c, g, or t
  misc_feature (195)..(195): n is a, c, g, or t
  misc_feature (215)..(215): n is a, c, g, or t
  misc_feature (224)..(224): n is a, c, g, or t
  misc_feature (260)..(261): n is a, c, g, or t
  misc_feature (264)..(264): n is a, c, g, or t
  misc_feature (303)..(303): n is a, c, g, or t
  misc_feature (305)..(305): n is a, c, g, or t
  misc_feature (363)..(363): n is a, c, g, or t
gcctcaacttcaccgcagaataaagaatgtnggccaaagaatgcataatcggtcactcgtatanaacagtattgnaactanaatttgaagctttctgaatggncgggttcaggcctgatgcaactgtaaaaagattacttaatgaatagactatatggaaattgtataaaatgttattaccttttatcgttagtngcttaaacagcactatatcnctaattgcnattcaaaatcaaaaacctgtttttgaatccccaagnnggnggcatgtgtatacaaccatacccccttgtacttgggggngngtctaatcttaattcaacagaaactttggctttaggaaagactcacaaatatttaaanga

SEQ ID NO: 522132 - DNA, 131 bp, Homo sapiens
tcccaaaaatttatttacaaaggcttttttttttttaaaagttatgggaaaggaaaaaaaagggtttgctcttcatttactaaaagatgggaaacttgggtttttcatcaaaaaaaaattcccttgtttta

SEQ ID NO: 522133 - DNA, 319 bp, Homo sapiens
tgaacgctagaggatcccaccaacattggctcgatgctcgttgatctctctttgacagctgagttaggcttgtggtcgccaaggtgtacaacgctgttcgtgtaggcgcctggggctagatgaattaggttcgattggtagcaaaagagatggcgttcaagcccatggctaattggattctggagaacgctgcatagagctcgtctataccactacccttgccgtggaggctactgaatgctcgatcctgctgaatgttgaaatggccgatgccctgatggaaggaggtactgatgctgtgaatgccggaaaagattgc

SEQ ID NO: 522134 - DNA, 116 bp, Homo sapiens
ctggcagccacagattcccttctttcctacacaaatcccatggattctgctttctgggtcttaggattttaaaagtgccgggatatttttcttctattagtggggtaccgagctcg

SEQ ID NO: 522135 - DNA, 240 bp, Homo sapiens
attttccttgtcccttgttaggtagttaacctgcagtacagcgaagttcaagatcgggtcatgctcactggccgccacatggttcgagatgtgagctgcaaaaactgcaatagcaaacttgggttggtctattagtttgccacttaaggcaggcaacgcatatatagggagggccgtgtatatcctggacgcgtctctctaggtcgcgagagagtaagggtctgagagggcgcatatccc

SEQ ID NO: 522136 - DNA, 139 bp, Homo sapiens
gctccatcgagtatcccctagtcttcgcattcgtcggccgtcagggcatgtctagagagttgggtcctagagagaatccgacacagcaccccgaccttgtccctggtccgagcactaggtcggcctggtgaacctcctc

SEQ ID NO: 522137 - DNA, 351 bp, Homo sapiens
tcccaagctttccacatgcccctccttacagggtacagaaattatcccctcaaccccagcctctgagggtccatgtaaggtccattttcagttccctccgccaggatgcattgtttttagcccgaggtggggacggccctccctccagggtatggagcacgctatcccgccttctcagggccctggggatttgcccctttaccttccccaaaggatggtcacacaccagcactttaacatttggtcacagaaagtgttgcagtaggggacccaagtcccaggccctgagttgttttcggcaggggccttgtttccgcatttggtcagcggggcagaaaaggccggtacaaa

SEQ ID NO: 522138 - DNA, 447 bp, Homo sapiens
  misc_feature (122)..(123): n is a, c, g, or t
  misc_feature (247)..(247): n is a, c, g, or t
  misc_feature (281)..(281): n is a, c, g, or t
ccctaatgctgaatctcttccctgtgctgaagaaaactcccagacctcccagccactggaactaaaattggcatccagaggtccggccttcagatgaaacgatcttcaagcaagcagacaannttgcgctccctcaggactgaccagaggctgtgctttggggaactcggaccactgcgaaaaatctgagaagtgatgatcgttccaggactgatctgaccacccggggcgtccagcatgattggtnggggtcctgcccgcaccctctcacccctccacgnagaggcacggtgggagagcccctgcccaccccggatgagcctgagactccagcctgaaatgaagttgctgaaatgagccctttccccagccgttcagcagcctagctgttttaccactgaaataaagtgtccaatttatcctgccattttgaggaagctgttttca

SEQ ID NO: 522139 - DNA, 244 bp, Homo sapiens
ccccattattgttcgatcaggttggcacgaccttgcgcttagtcgtcctcagtactaggggcaggcacgtgaacgatggtctctccccgctcctgcgtgtgatgagccctgagtagcctccccaggtcgtcatcttatgtgtgttttccaccatgcctggctaattttgtatatttagtagaaacagggtttcaccatgctggccatgctggtctcgaactcctgacctcaggtgttccaccta

SEQ ID NO: 522140 - DNA, 773 bp, Homo sapiens
ggtgagtgagaatatgcagtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatggcagcaggatttatagtcctttgggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgtggtttcctgactttttaatgattgccattctaactggtgtgagatggtatctcattgtggttttgatttgcatttctctgatggccagtgatgatgagcattttttcatgtgtttttggctgcataagctaaggtacctttttccaaaccagcccaagagattgtcatcttcttgctcaaccattcccttctctaccttaatttctaccaggaaaggagccttgtaaaagcgaaagctgttcctagtaaaaggaaatcgagatgatgttacatcgtcccacttgggattcatcagccaacatattcgcttcgagggaatgtatgctccctaggttctac

SEQ ID NO: 522141 - DNA, 282 bp, Homo sapiens
  misc_feature (20)..(20): n is a, c, g, or t
  misc_feature (277)..(277): n is a, c, g, or t
gcaggctagttcattcacgncctgaaacccattttaataggtggatgctttcagtgtggttctttttgttgagttggtttttgtgtccccatcctgcttcccagcctcttgcatcagtctccaccctttagccatatgctgtaccgtagtcattgttttcttcctaccgtgtacaacatctcaccacgaaacagcagcatggggccagcacttggggcccaaaagcctgaagtctgaagaggaaggaagcggcagtgcaagcgtcactgcagaggangccgc

SEQ ID NO: 522142 - DNA, 108 bp, Homo sapiens
gcccggtctctggttgaggcgtcgggtgtctggatacgggaagcggagttcgggaggaggcaggagcaggattaggagtgtgtgggggatgatcaggaaaaattgaca

SEQ ID NO: 522143 - DNA, 199 bp, Homo sapiens
taaaacgaggcagggaggtaggatatgaaaaagacggaggagaagaagaaaacacagaaacggaaggcgggacgccaatggcgccacgacttgtaatccagcactttgagagggccgaaggtagggcggatcaccctagaggtcaggagttccaagaaccagccctggccaacattggtgacaccgcccatctagtccc

SEQ ID NO: 522144 - DNA, 234 bp, Homo sapiens
  misc_feature (13)..(13): n is a, c, g, or t
  misc_feature (56)..(56): n is a, c, g, or t
  misc_feature (89)..(89): n is a, c, g, or t
  misc_feature (98)..(98): n is a, c, g, or t
  misc_feature (161)..(161): n is a, c, g, or t
  misc_feature (219)..(219): n is a, c, g, or t
ggtgaatcttgtntttattttttaaaaacaaagtaactttcgatgtgatcataccngaaagttttgcgtggtcaccatgccaagaaatnactttggtngcccagcagatccacagcgactctttctcaagggctactgtggttctagttgaggaaggggcnttaggctcagtgctggtatcctccacagtcctttcttccagctctggcctcctttggncccaggaaatccctc

SEQ ID NO: 522145 - DNA, 251 bp, Homo sapiens
taaatgggaggttgttgaccaaaggtcataaagttttacttatgcaagacaaataaggtgagactctgtctctacaaaatattgtaaaaattagccacatgtggtggcatgcacctgtggtccaaactactcaggagactgaagtgggaggattgcttgagccctggagattgagcctgcagtgagttgtgttcactccactgcactccagcctgggcaacagagcaagaccctgtctcaaaaaaaaaaaa

SEQ ID NO: 522146 - DNA, 196 bp, Homo sapiens
gtacgtcggaccgacggtgacaggcgccggtggttgtgcggttgcggtctgttagtagtctcgtgctgcccgcagctcggcctgggagagctaggcccagtaggcctgctgtaattcggacggatccgccgacgtcggggcgtttggtattgggtttggtccgcgcggggtaccagagacacgaaattcgtaatcc

SEQ ID NO: 522147 - DNA, 248 bp, Homo sapiens
ccgccagcgtctgtgtgtgctgggggtacagcgggaacgccctccccagcctgccctgtgcatgtgatgaagaggggtgccaggctgtggtgtgtggatggggaggaggcggcggcgccgaggagcctctcctgcgtccagggtcgccccctcctcagcctgcccaatgcgggctcgcggggacctgccacattccatcgcccccgctggaaaagccccccggctgagggggtagggggtgggggtcc

SEQ ID NO: 522148 - DNA, 841 bp, Homo sapiens
cagcagcaagagcctggctaggccaccgtacggaccccggagcagcacacatggcatccacgatcatggccgccgctcccgcgccgttgtggccaagaccccgttcctcagcggccaggccgcgccgccagcgccaccccccctccgcgacatcgccgccgcggcaacggcagaatcaccatgggcaacgacttgtggtacggcccggaccgcgtcaatgtacctgggccccttctccgcgcagacgccgtcgtacctgaacggcgagttccccggcgactacggctgggacaccgccgggctttctgccgacccggaggcgttcgcgaggaacagggcgctggaggtgatccacgggcggtgggcgatgcttggcgctcttgggtgcgtcttccccgaggtgctccagaagtgggtgggcgtcgagttcaagggatgcccgtctggttcaaggccgggctcgcagatcttctccgagggtggcctcgattaccttgggaaccccaacctcgtccacgcgcagagcatccttgtccgtgctcggcttccaggtccttctcatgggtctcgttgaagggttccgcatcaacggtctcgatggcgtcggcgagggcaacgacctctaccccggcggcagtacttcgacccgcttcgccttgccgaggaccctgtcaccttcgcttgagcttaaggtgaaggcacatccagaatggccgtctcgccatgtctctaatgtaggggtcttcgtccaagctatcgtcaccggtacgggtccatttggagaacctgttcgaccacctcgagaacctgtcgccaaccactgcatgggttttcgtaacca

SEQ ID NO: 522149 - DNA, 124 bp, Homo sapiens
gttgcccccaacagtaaccccctcatttatgtacttcctgcggggggtttcccttccctttttttcccactccccccccttggggtttttgggatggctcccaaataaaccttttgccccccga

SEQ ID NO: 522150 - DNA, 492 bp, Homo sapiens
gggaatggctttgagtaaaacgggaggagagtgttgctgaccactacagacggtagaggacagagacctgtaagctctacatgacaactcagtgtagaagcccagtgtcctcagcttcatgtccagtgaatggcagaagttcatggggtagtggactctacaaaggctgagcgcatcccaagacagccagcaggttgtctctggaaacgaccagagttaagctctcggctatactctgctgagggtgcaccctttcctctagatggtagtaagtcacgttatctttgacaactcttggactgctcctgaggaggccctcttttccagtaggaagttagctgggggttctcagaagtggctgattggcaggggacaagcttcgtttcaggggtctgccgttccatcctggttcagcgacggccgcgcgtggcttcctctcgccttgtcactgtctccctgcctgtccatcaccacctttcctccagaggcgga

SEQ ID NO: 522151 - DNA, 475 bp, Homo sapiens
ctccaccccgcaacccacgcagacgcagctcgaccgaccacaactgtgcgcagcagcggcggccggcggagaccgtatcgtaccatggcgatggagggctacgaccgcgagttctggcagttcggcgaccagctccgcctccagacggccaccttctccggcctctccctcggcgactccatctggtccccacgccgaggccgcgcgcaagcgcgcgcaagcgcggaaggccagagtcgagacgcggccgtcccagggggccaaaagaagagcggagacggatcgacgacgcaaggatgaacgagcaggccatcatacggggcgcggccttcattcgggctcacggacgaagctgcgtccgttacggcgcacaacagacaccaggcagaggccgaaacggtgacggacaaacgattcaggctccccgacggacggccggagaacaacgcaccgaagacaaagacaacggactgta

SEQ ID NO: 522152 - DNA, 118 bp, Homo sapiens
gcagtcgtatgcgtctgccggtaccctgaggaggcaagcgcccgaccgaccccacgtcgcagacatacataatctggatggagtgagaaccggcctcgatctggaagtcgtaggcgga

SEQ ID NO: 522153 - DNA, 120 bp, Homo sapiens
acgagaaaagacctcaatttcaagggattttcacgtgctgcacaaaaattattctcatcacgataccgtaaaatgcgcaataaagcaaacacttacgctgactttcacaacgatcatcat

SEQ ID NO: 522154 - DNA, 166 bp, Homo sapiens
cgatccagcctgcctgggaaccggtgagtctcttgtgtccccttcccccgcagcatggattacctggagacctggactccaaaggctgaccagctgtagatctgcaccgtgcattccacacccaggagccacactgaatggaaggcagccctttcttctcctcagg

SEQ ID NO: 522155 - DNA, 105 bp, Homo sapiens
tagccacgagggagacatggtgaagagaagtaatcaaaatacagtctcatccctgtcaggtaccgtgggccttgcatttcaaactccagacgtaacttcagtacg

SEQ ID NO: 522156 - DNA, 235 bp, Homo sapiens
ccccggaagacttctttttgggcccctgggttttcccctgagtttcccccccccccgggggttttttgccccccctttttggcccccctttggggccgggttgggggccccccggttttccccccccccccccccggttggttgggggtttttcccccccccccccgggggggccttcttttgggggggttttagggggcccccgggggccccatttttttttttttcccgggga

SEQ ID NO: 522157 - DNA, 105 bp, Homo sapiens
ttttcctttcttgagaagggagagaataacttccaaaatgagggggttttgaaataaccaaaaaaaggaaagggaggcttcttaaagaccaacacttgaccccag

SEQ ID NO: 522158 - DNA, 195 bp, Homo sapiens
cgtcggtatcgtgccgtctctaaatcaatctgaatgtatcattcatccttgatgaggggctcggggtagcggatggtgcgggcatcctgagtcacccgatgagggattcctttagtgcccgcaaagatcttgctcactttgcactacttgtacttagactcctcaggtgtaatacgatatacagcacagcgaccc

SEQ ID NO: 522159 - DNA, 1186 bp, Homo sapiens
tgggtgtcctgtgttagtttgaaatatacaacgaagtggtttttcacattattcattgtggctcggtgcgtgttgatagctccggtgataaggatttgtggagttgccgtgcaggtgtttaatgtggtggaaagtaagggtgagtctcatattcttctattaaattggcccacaagaaattaaaaaaaaaaacaaaaaaaaaaaaaaaaaaaaaaaaacaaaaaaaacaaaaaaaaaaaaaaaaaacaaaaaaaaaacacaaaaaaaaacaacaacacacacacaacacaaagaagagagagagacataacagcagaacacgacaccgcagacggcgagacggacggcggggaggagacgaagaaaaagcaaaaggaagacagacagcagagaggacggggggaggaggctgggacgggggggggtgggtgagagaggcgtaccggcgcggagggtgggcgacgggggaagaggagcgagcgggaggccaggacgcgagcggtgccgcgaggagaaggagggagggggagaggaggagaggaggagagagagcgagaacgagaaagaacagtgagggagagagagagagcagaggcgaaccactgggaggaacacaggagccacgcggagacagaggagaaacactaatagagcacgacaggggaggaggtaaagaagcgaagaggacacgacgagacgacgaaggccgaaccaaagagaacgagcccatatactcgcagaagagacataaagaacaaccagcacaaacaggcggacgacaaagaggagaaatgaaggacagaacgagacccaaaagcacaacacgacacaagaagacgctacagtgcgaggagcgaccacacgcgcggcgagggcagcaggaacgaaggcagggcgagcaagcacgcagcacgacgaccaaaacgaagcacaacgagaccggcgagagagcaagcagcgagcggccacggagccggagggacgcggacggcgcccggggggcagaaataggcaaagcgtgacgccggcacccggcgactagcgaagccgagcacggcctcatatcgacctgggctctcagtagcagcaagggtgcgccggctggacgagccgattatactggaccgtgccagcgcagccaggacgccggagctagcgccatacctaactgagtccaggggaggga

SEQ ID NO: 522160 - DNA, 1060 bp, Homo sapiens
gttgtctgacacgtgtatggcctcttctggggaattcacacaactgttgtgtaatagtattccacagcgttgttgtttctttttgacacgccacctgtgcttttccctccttaatcagctggtcagctccaatgattgtccggaggttcttctggaccgctgtatcctgcagagccattaagccttgctacgcaagggatctgaactgggacacctttcttgcctgtgctccgcatcccatcgcaaatattaaacctacttcatagtgcatcacacgcaagctggaaaatttgtcggccatatagccacggtttctctggagccgctattgacagaaattgagttgctttctcagtgatattcacatcgacatcatggacgtatatccagctcgcaactttgcactgatgcagatattccgtcagatctcgggccgaattttgccatgggattaccaagtgaacatgttttacacccacatggttgatttaaatgtactacttacagctacatattaaagtcaaccaatatgcacatggcctgtactccagctagaggccctttgctggttactgtggctttatggcagccaacctttatgctcgttccatatttggtgaagatgcacttgcaaaagtcagcacttgagaagcccaattcacctgggaccagatgctcgctgttaccggccatataagaattcgtgcaaagagcccagggtatggccttaagtcttggagataaaatctacttgtcacagaagaaaactagtatatcgaataatagacgataagtccataggaagctttacagataatttaggtatgggcttactggactccaacatcttttgtacgtctttcatgcatatagagaatctgagttcatgctgaatactctgttcagccgaataaacttatagcctttcgcctctaaatcaagattccgagtattagtaatgtatagtttgtcttttgtgactaacagatctgaatagcatgtcctcaatagtaatataatgtgtcatgtccccagacccttttatctcctacgatcacga

SEQ ID NO: 522161 - DNA, 860 bp, Homo sapiens
ggcccccacatcgtggggcaagaacgggaaattatgtccccgcgcccggtccctggtgacgacccccccggagacccgcctccccccaaggttgtggcccccccaacgaagcccacccggtggtaacaaccaggcggtcgcgcaacacaaagaagggcgtccaaagaagacaccgggggcgccgggactcgcacacacacccgctttgtcgcccacgtagatgtcgcgcgcgctcgcccaccaagacaaggtggtcctaccctcgcctatggcgcgcgtgttacacacgcagtgcctcacacacacaccgcgcacagaccaagcaggggcccccccagttggtaaccccccccccggggcccaccggtggcacacaggaggtctcacaccctgcgaccgcccaggaattactacgagatagcgccacgtcgcgcccgcccccacaagccctcgctcggacacacaaagggggaaccacacgagtttgggcagcagcgacccctccgccgcccagccgcttcaccaaggtgtccacaaacaatgtcgcgacagcgcccgccgcaagaagagatccccacccgacctacacaaagaaaggggcggcgcacacccacacagctgcaataccgctgagaggacactgtgaaagaacaacacgcatggtcgaaaatacccgctatacatcccccacgacagggacaggggcgacaagaaacgccgaccacccgtcgggtacgccgccttggggcacaaacgaggaggcgcccaccaacccaaggacaggggctgcccacacagcagtggcgacccccccggataatcccgcccaacaaacgttttcccccccccccaacatgaca

SEQ ID NO: 522162 - DNA, 318 bp, Homo sapiens
taatatgctgtctcatcacccttttttgtaacatttgtgtttcctgctgcaggacctacataagctgaaggtgcagtagtatttgatggtgcaggaacgtgatttgaagccagaattatttgtaggtgctgttgttgcagtaacagttcttgagcttccacttcttgatgagcttgatgaacctcctctgctgcttgatgctgtagagtttgaacgagtagccatagaaggtgttgcattagatactgttgatcttactacaactgtagaagtacccggtataataatctctgaaggtgccttctctccctctattcc

SEQ ID NO: 522163 - DNA, 1310 bp, Homo sapiens
tgtgggtggtaatctggaatcgctatcactttaatcagcttctggtttgaaggcagcagacagcgtttcccctccagaagccagcccctatttcttcagcgcggcgagggaacacagaggacccacgaggccccgtctttccgtccgagccacagctatgcccagagagggaaccaggcgggggctcctcagccagaaactctttagaattatagaagagggtgcctccgagtctcgaggacacccctcacgagggcgtgggtgtgcacaaagaggcgtgctcagtggccgggagagagagagctgcgggcccgcgacaccacgccaggcaagtgggaagagaagagaactctgggaccacccacgcgagaacagctggtctccttagaacaaacagagagtgtatagatttacacctgtggtctttctctaaaaatctgagacacagggtgctggctctggggtccctcctgcacaaggcccagacgtgttgtggaacgcaggtggggcaagactgggtgtcctccccgctgggtcccttggagcaatgttgggcgcctctactctcgtgtttccacaacaaaagcggcggacgctatacctctttctatatacgcgggtccatacatgtgggggcacaaggtgttaggaatcaacaaaagaagttttctcttcctccccaaatcttagatctgctccctattctgtgtgacacatgggtgacattttccaaaaaatgctgggctatccacccctgggaatacccctctgggggcccaattccggctaacctaaccaaattttttccaccaaaatttcgggttgggggcaaaattttattctctttggcacccactgggagaattgggccttttttctcccacccaaaggtggttcctccacaacaggtgaagcaaaactctttgctgtgtgacacaaaagaaccctgcttttatgctttgggagcacaccccctagggagcattgaaaaaatccaggggaacacccggtggtgaaggggaccactgcctacccaatacgcacaggagagaccttcccccaaaacaaagacacgggggactgaagccactacggggtgtgcccgccccggccccgtgggagaatgggcgcccctatataaagaaacatccccggggtagtagcaaaacaggggggccctcacaccacccggagatataataatgcatataccacgcacctattggggaacagggtacaaagagcccccggacaaaaggggatacgcatatgtaacgacgcagcaacaacaaggaggcatctgaccatgg

SEQ ID NO: 522164 - DNA, 254 bp, Homo sapiens
tgaagtgggtgagatgacccatttgaagcacagtggacccttgaacatgcaaaggttgcggcagtcaattcacataaaagtttcgatctgacgttgggcagatcacctgagattaggagtttgagaccagcgtgacccacatggagaaaccctgtctctactaaaattactaaaactagtcgggcatggtggcagtgtgcctgtaatcccagctattcgggaggctgaggaaggagaatcagttcaacccggga

SEQ ID NO: 522165 - DNA, 105 bp, Homo sapiens
catagttgtgcctgtctcaaacctcagccttcctagtggctgggattacaggtgcgcaccagcacccccaggtaatatttgcatttttaataaggatcccctagg

SEQ ID NO: 522166 - DNA, 576 bp, Homo sapiens
ggacacataggcgcgagaccatgggaccttttgtacgacccaggggctggaatgcgaggttccttcagtggatgctaggggaggtgctgggcgtttcgctgccagcgaatccattcacaccgggcgtgcatacctaggcaagccctttggtctcggccaaacacttggaccgcatgtgcctgcaactaatttttcccagaacgtgttgtctagacgacatggaggccttactctgtgcctgggggtggacctagagattgctcaagatgattggtcaagttagaagtatactcagttcacagggaagcaactgaggcttggggagtcaggcactagcttactgataagctacaaaccatctgggagcgaggattgtaaaagtagcttttagacacatgtagggctcacatttttttgtcttaaacgagcctctttcgagagtcttttggttaaaccaaacaaaggaactgtttgtatgtaccctctcgcttatggaaaaaatatatgtccgtcataaaaagctgttttactagacttaccctagggtgttaattctttgccaggatcccccttttt

SEQ ID NO: 522167 - DNA, 373 bp, Homo sapiens
  misc_feature (64)..(64): n is a, c, g, or t
  misc_feature (81)..(81): n is a, c, g, or t
  misc_feature (204)..(204): n is a, c, g, or t
  misc_feature (236)..(236): n is a, c, g, or t
  misc_feature (242)..(242): n is a, c, g, or t
  misc_feature (249)..(249): n is a, c, g, or t
  misc_feature (259)..(259): n is a, c, g, or t
  misc_feature (287)..(287): n is a, c, g, or t
gcagctcttcccctgccacctcctctgctcgattgttgcactgaaagtagagcagcttccccanctcgaaggtaacaaacnaccaacttcccaatccccgcacgttggacaagtttattggaggaaccaggatccacgttacattttgagcatgcagctaaccgcgatcccagttttcgagaaatgttattctttgtctcatanctaaatttatgcacacatgcactacatgtctnacgggntgttggntactttgctngatgctgggtattgcactgagtctgacncagtgtcgaccagtggggctggtagaaggttttaaaatgatggtcacaattcgtagtaatggtagtgacagtggaaaattatgaag

SEQ ID NO: 522168 - DNA, 308 bp, Homo sapiens
agttccttgcattgtccgggaccatggattttaaacaaaaaaaggccctcaacacagatatggaagaattagggttagaaacagacacagctggctgtagcaggtgtggagtgtttctctcacagatgtggcccacaatgacatactccagtgttagaaatcactcttcccacagcaagcctacttcaggcaggctggagacatcacaccataggttcagcacaaaaaggcaaccacagattctgtacattcctatgactgagagaaagggaagtactgtccggacatgcaagcccggtacatgcaag

SEQ ID NO: 522169 - DNA, 1307 bp, Homo sapiens
  misc_feature (302)..(302): n is a, c, g, or t
ccacggatgatcgcagactggggtagagttgcatcgtccatgggctactgccttgaccgccactataacgcaggcggaaacggggctgtccagactgagagcacatgtcaggaactgcatactccgattgacgtgcgtgatgtcaatgacaccatggaaggtagagctctcatgtagaggacgctcattcacgcatcttccgacctgtgcgaacacgctggtacagtaaaccattgatgcgttagtgtagcatgatggttgagacgtgtagctatacgcggagcgacacgagacgtggtgantagagatgtcatactcaataggaaacgtaccaagtagtccgttcgttggcactagtctagatattctcattgattgctggagtaaatgtaattgctgatctgatagagtggacacaaagaaggaacattggatcatacatgtgtggcggttgtgcaggaaatgctaaatgttagggtggcagatatacgggtaattcattcacatagctaagaagactgagtggatacacatgggcaagcacagagattttgcgcgaaaggataagcgattttgctgtgggaaactcaatagagagttagacttgttgtggcatatgtacatgggaccttcgaaaggccaagcaagtatccacgatctcaattgataattactttggtactccattattgccccccaaatttttgaaaggaaacatggggcgaaaggaaagacaattataagtatagaaggctgtgaacagttacatacttgtggcaaaaaacttcaggctgcgtgaatatttgggacttggaagggtcttctttggtgcttgaatcagggggtggaatgctgagcatgcatggttctccataaaggttctttgaacccgctgtgcccttgatgagacactgggagaaaaggtgtagggttaagccattgatacaggtgtaagacaggacaggggaaatgttcgtgcgtacttctgggctgagctccatgaattgtgtaggctcaataaccctattcataggagttcctgggttttaatggaacgttgtggcacccggtgtattccacgttccatgatcataaagggtcgaggttttggcgctgctgattctataacaaggttttgcattgtggtggaaagtaaggaacgtagttaacgaacgggtatatacaggttcaaaagaggtctggtaaggctacagaaatggaccacaactgtttgggggcaatgtgaggaaggtgtggacaccacatttgagagaattggcaaccagcagagcaaatgaaacacaagg

SEQ ID NO: 522170 - DNA, 209 bp, Homo sapiens
cacgaggggaaatcatgctcccccacgcctgaaagttggctgagctgggtcactcccatgtcagcaaccccatcccccacattccaacagcagggacactgtgcacctgcggatgccttcaggggacctgttcacgggtttggcagacaccatcctgtaaactgattgcaggtcggctgcgcctatcaccaccaccggcacccacttca

SEQ ID NO: 522171 - DNA, 160 bp, Homo sapiens
gaaagcactggctgttgttggccctgggagcatgggcctcatttggccccttctgtcaccccccaccccagctgagttctcaacatacctcaacttctgccgttcactgcggttcgatgacaagcctgactactcctacctgcgccagctcttccgcaac

SEQ ID NO: 522172 - DNA, 612 bp, Homo sapiens
ggaaggccccctctcaggaaaagtatctctcgtaagccagcgttctggatctcctcgtctgcctggatccagttgccgtccatgtgtataactcgatagtccacctgccaatctggactcagcggaaaggcgagctcctggcctcggaagacccaggactccagaaatggagctgactattgtgggttccataaaggattacactggggatggcgttcttcctcagcttgtccatgtcgctggaatcattcctgtgttaagttattatccccgctaaaggtctgagtgagttcttcagggaagcgatactctgagtaccacagggaccagccgtccttatcaaagtgctcccagaaatatggcagtgccacagagagtgtgtcctcattggagtacttgcgcttaaattcatccaacacaaaggtactcttgggcaggtgagcgaaggggtccttggccttgggctcagcagccagcgcctgctcacattcatccatctcctcctcaggagcagtggcagccgctttttctcctccttccgctcagctagggttctgttctcttccgtgacccttctcttccgggtgggcctttaaagttgggctctggaac

SEQ ID NO: 522173 - DNA, 544 bp, Homo sapiens
  misc_feature (113)..(113): n is a, c, g, or t
  misc_feature (136)..(137): n is a, c, g, or t
gagggttgtaaaaaaagttgttggtcggagagcttcccccccccaaaactccccaggggagaaaagtttgtgtcccggtgtggaccaatgttttatggcaagtgaccccctanaaagaatgccggggcccccattnngcccaaaaaattcccgggttggcgggcaaaggttggcaagtttaacaaaattccctttacaaaaagcccggggggccccttggtgggcatcccaccctttccctgaaaggtccattaggacatccctcaggggatttttaaaaaccctctttccaggaagggaaaggagggattcctcccccccccccccccccaaaaaaaacggttttggcgccctaggggaaaatcggggagcgggttttaaagaaagaaagttaactttttttttccccctggggccccggtccggatttttttggggtttcaaaagtttttttgtttgggttttttttttaaaaaaaggggagaaaatttgataatttgaatccccccccttccaccaaaaatttgggcaaaaaagtttccca

SEQ ID NO: 522174 - DNA, 956 bp, Homo sapiens
  misc_feature (10)..(10): n is a, c, g, or t
  misc_feature (30)..(30): n is a, c, g, or t
  misc_feature (59)..(59): n is a, c, g, or t
  misc_feature (85)..(85): n is a, c, g, or t
  misc_feature (574)..(574): n is a, c, g, or t
  misc_feature (768)..(768): n is a, c, g, or t
  misc_feature (799)..(799): n is a, c, g, or t
  misc_feature (829)..(829): n is a, c, g, or t
ttggttgttntttttcaaaattgtttgggntattcaggattccctggagagtcccatgngagtttcaggggggttttctatttcngcagaaatttctattgggattttgagaagaattgcattggatctgtagattgctttgggtagtaataatcatgttaacaacatcaagtcttccagtctatgaatgcaggatgtctttaaaaatttctttcagcaatgttttgtagttttcaggtataagtcttttgtctccttaaatgtattcctaagtactttattctttttgatgctactataaatggaattatgttaatttcgtttttggaaatacctaacaatgaatacattgttagtgtatagaaatgcagctaatttttgtgtgttgattttgtatcctgtcttttcattcccttgacagtatcttttacagagcaaaaatttttaattttaatgaagtccaacttataaatccttctttcatggattgtgcctttggtgttgcatctaaaaagccattgccaaatgcaaggtcatctggattttttcctatgttatcttctaaaagttttanaccttcagtccactttatttgtttttgtggagggtataaaagtctgtgtctagaatttttttttttttttttggcatgtgaatgtctttcaattttgttcttcttcaatgttgtatttgctattcttggtcttttgccattccataataaactttagagtaattttgtcaccatccacaaaataatttactggnttgagattgcactgaatctatagatgaagtngacatcaatatagaataaaactgacatcantagtgagtcttcctatccatgaatacaggatgtctttatgtcttttaaaatttctttcagcaacattttatagctttcaggtagttaactttttaactgtagggttttacatgagataatgtgatag

SEQ ID NO: 522175 - DNA, 255 bp, Homo sapiens
aggcaagaagggttgccggtagggtatgtgggctttttttgccttcctatttcctttcaaagaaattttttgtaaattacaaaactgtgaattgggtggccaaaaactgttgcccttggttagatgtttcaaacagggtaaatcctatatggcccccggtcccccttggttccctcctccctcccctgagagtggggccctcatccgcccatgtaattcccattggcttgttattaaagagcctttcaaatttta

SEQ ID NO: 522176 - DNA, 129 bp, Homo sapiens
aatactcagctcggtaccctctctccacactggtgagaagcatatgagtgtgaattccgcctaaaggctttgccacacatattgcactggtatggcttctccccagtatgaattttgtgatgttcaggt

SEQ ID NO: 522177 - DNA, 428 bp, Homo sapiens
  misc_feature (17)..(17): n is a, c, g, or t
  misc_feature (61)..(61): n is a, c, g, or t
  misc_feature (64)..(64): n is a, c, g, or t
  misc_feature (108)..(108): n is a, c, g, or t
  misc_feature (111)..(111): n is a, c, g, or t
  misc_feature (118)..(118): n is a, c, g, or t
  misc_feature (129)..(129): n is a, c, g, or t
  misc_feature (131)..(131): n is a, c, g, or t
  misc_feature (133)..(137): n is a, c, g, or t
  misc_feature (144)..(144): n is a, c, g, or t
  misc_feature (148)..(148): n is a, c, g, or t
  misc_feature (154)..(154): n is a, c, g, or t
  misc_feature (158)..(158): n is a, c, g, or t
  misc_feature (160)..(162): n is a, c, g, or t
  misc_feature (168)..(171): n is a, c, g, or t
  misc_feature (209)..(209): n is a, c, g, or t
  misc_feature (218)..(218): n is a, c, g, or t
  misc_feature (224)..(224): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (276)..(282): n is a, c, g, or t
  misc_feature (292)..(293): n is a, c, g, or t
  misc_feature (337)..(337): n is a, c, g, or t
  misc_feature (395)..(395): n is a, c, g, or t
ggggaaaccccaaaganagagggtttttcagtggagaacatggggggcggattaggcttcnatnagattacattcatttcacatctgtgtgcaattctcccataaatnggnctttganatatatatatntntnnnnnggtatgngggngggatntttnannntatttnnnncccccctctgggggggggggggggggggggggggggtngcccgggcngggccngggggcgtggggggggggggggggggggggggggggggggngngnggggggnnnnnnncgggcgggcnngggggggggggggggggggggggggggggggggggggggggggngggggggggggggggggggggggggggggggggggggggggggggggggggggggggnggcgggggggggaaatgacacattgaagtgagt

SEQ ID NO: 522178 - DNA, 81 bp, Homo sapiens
ggaagtatcactatggttcggggacttacattcactgcttttgatttgtggggccaagggacaatgattaccgtctcttca

SEQ ID NO: 522179 - DNA, 241 bp, Homo sapiens
  misc_feature (65)..(65): n is a, c, g, or t
tgggagcttgagaacagccctgaccaacaatggagaaaccctgtctctaaaaataccaaaattangttgggcatggtggcgcgcacctgtggtcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagc

SEQ ID NO: 522180 - DNA, 715 bp, Homo sapiens
ttgttgctggtgtaaacctagcacttttgcaggtcattaacagccaatatgctgcggattctagcaagaccatcctggttaacacggtgaaaccccgtctctactaaaaatacagaaaaattagccgggcaaggcggcgaccgcctgcattcccagctactcagagaggctgacgcttgagaataaggttaacctgggtcgcgcacgttgcaatgagaccataatgtgccactgcactccagcactacagcctgggcgacagcgagactctgtctcaaaataaaaacaagaagtataaaaaactaccatgttggccgtattggcccagttcactttaaatccgaccaagtataaccatgcggccgcaatatgacctcacctgtgcaatggggcctataactgatccgcttgtaacaacttggcccaagatagaaccctttaccaatgggaataaaccggcttacgcaattaaaattgtcggccgcataggcccattctactagatactccagcaagctatgcacgcggccgaatttccagttacattggcgaatttgccctaagggtgaagggattagaatgcgtggacattcttttaaattcgggaaatatttaagcatagcggttcccttttaaccaccggccggaaactgcaaaatcccttataagtcaaatgattttcccgcgtgagctgactggttctcctgggcctccc

SEQ ID NO: 522181 - DNA, 419 bp, Homo sapiens
  misc_feature (319)..(319): n is a, c, g, or t
  misc_feature (350)..(350): n is a, c, g, or t
  misc_feature (374)..(374): n is a, c, g, or t
  misc_feature (408)..(408): n is a, c, g, or t
ctgcggggcaagtcctccagaggcagcagcccaggtggtgcagtgggtgagctttgctgcttccgctctagtgcccccagccagcgcctgggtgttccccaccttgggcgtcatgcgccacatcaaacaggccactgcgcatgcaaaggaggaagtgaggcgaatcctggggctgctggctgctcacttgcagacgaggacttttgtggtgggcgaacgagtggcattggctggcatcacagctgcgtgcgccctgctgtggctgtctgagcaggccctagagccttgtttccgggaggccctgcccaatgccaaccgntgggtgctgacctgccttaaccagccccagncccgggctgcgtcgggcgaagcgnaactgtcggagaagatggcccaccgtgctgcccnaaagccggcag

SEQ ID NO: 522182 - DNA, 346 bp, Homo sapiens
tgaccatgcagttctattcaattaagtctgagttatatgaaattcccgtcatcggaagtgaccctgcccatcatggtgggttctacctcctaatgaacatcatcactcaggtacgtgtgcatccggggtgttgtttatcctaaccacaagattgcgcttccttcaaccgtcaacggttcgtcgtgcaccttccggaaaattttgtgagcctcatctttttcccatctcgtaccttccagaacccctttcaccctgtcgcactggctgggcaccttgttttgtcttcattgggacctcaatgtacacagaggtgtgggacaacctagggaccacacagagtgagcct

SEQ ID NO: 522183 - DNA, 215 bp, Homo sapiens
  misc_feature (57)..(57): n is a, c, g, or t
  misc_feature (60)..(60): n is a, c, g, or t
  misc_feature (62)..(62): n is a, c, g, or t
  misc_feature (68)..(69): n is a, c, g, or t
  misc_feature (73)..(73): n is a, c, g, or t
  misc_feature (86)..(86): n is a, c, g, or t
  misc_feature (88)..(88): n is a, c, g, or t
  misc_feature (101)..(101): n is a, c, g, or t
  misc_feature (108)..(108): n is a, c, g, or t
  misc_feature (114)..(114): n is a, c, g, or t
  misc_feature (123)..(123): n is a, c, g, or t
  misc_feature (129)..(129): n is a, c, g, or t
  misc_feature (173)..(173): n is a, c, g, or t
  misc_feature (210)..(211): n is a, c, g, or t
  misc_feature (215)..(215): n is a, c, g, or t
gagcagacgggggcggcagtgtagtgggctgcgggctggggactgagacggctcacnagngnatcccnnggtnggtgctgagagcngnctccgggtctctncaccacngtagtnctctcattnccaaancatcagcggcttttaaaataagatctcttggtagccatccggtnaaattggtaaacaatctaattaaatggcatcagcacnnaccn

SEQ ID NO: 522184 - DNA, 285 bp, Homo sapiens
ggctatcacattatcatctgtggcagaaaaatttttggggaccagttttgaggattaatgtcagaaatggagacgagatccagcaattgagtcaactagtgaattcaacaacttgaagctccatttctggaaatctcccttctcctttaatcggcctgtggattgtctggtcccatctgtcaatctgcaggcatttaaattcttcctgagaatcctgggcttagaagtacggcgggacaattgaggacctgcaggcccttttagacaatgaagataatgtgatag

SEQ ID NO: 522185 - DNA, 480 bp, Homo sapiens
  misc_feature (182)..(182): n is a, c, g, or t
  misc_feature (312)..(312): n is a, c, g, or t
tgcggtttaaaagatccctttgaattaaagcggcttggagcgagagacccaccccttaaggttctggcccggggttttgaaaaaaactattacatgtactctttcctgggccttggcagttttggcccactgggccagcacccccatttgggggtaccttttccaccccaaggtgggtcccntgggtgctccccttatccccatggagcattgccccccccgcttttttaagacctttggcctgggcaattacaagtacatccccctggattagtgggccggctgctttggcatccaaccgaaggatattgncaagggttttgtgatttaaatcccctccttccccaggaccggatttttttttttaccctcccctttgtgtttcccccaatgtttaaaaagtttggatggtttgtttttttgcctggaaacaaggtgctaacaaattttagttaatccctttacggggcttaaaattta

SEQ ID NO: 522186 - DNA, 173 bp, Homo sapiens
  misc_feature (45)..(45): n is a, c, g, or t
  misc_feature (61)..(61): n is a, c, g, or t
  misc_feature (70)..(70): n is a, c, g, or t
  misc_feature (96)..(96): n is a, c, g, or t
  misc_feature (107)..(107): n is a, c, g, or t
  misc_feature (116)..(118): n is a, c, g, or t
  misc_feature (126)..(126): n is a, c, g, or t
  misc_feature (136)..(136): n is a, c, g, or t
  misc_feature (141)..(141): n is a, c, g, or t
  misc_feature (143)..(143): n is a, c, g, or t
  misc_feature (146)..(147): n is a, c, g, or t
  misc_feature (150)..(150): n is a, c, g, or t
  misc_feature (159)..(159): n is a, c, g, or t
ccccgtggctctctccagcgcgcaatatctccatatactcgagcncaggctgtgccacgancatctacantctccactatgtgccagcctgtcaangcaatttctcngggagcccnnnaccggttncggcctgttnggagntnttnnttnttcctaaantgccggttagtttc

SEQ ID NO: 522187 - DNA, 242 bp, Homo sapiens
tctagggccaggtttattccctcacatgggtggttcacatacacaggacaaaggcacgggcaccatgggagagggcaatactcctgccttctgaggggatcttggcctcacggggtaagaagggacaggatggtttcttttctgcccttactagggcctagggaacccatgagcaaatcccaccacgccttccatctttcatccaaggagaatccaccttggtgacgtttagttccaaccat

SEQ ID NO: 522188 - DNA, 403 bp, Homo sapiens
agcagagtagtggagcaagcatgtaagttatctcacgtgtgtgaaaatgtgccatatccactttcatcatctgggctacaaccagatcacttgtttcacttttcctcacaaatattaccagtgcaggacttgggtcccagtgaatcttcgacatgaagttgacgcttcctgaagtgacgcatactctagctccacagcttcaaccttctcctctaccccttccttttcttctgctctgtctttctgtcatgtcttggtagggctgtcttaaagaagcatgagcgttgaggcctcctttgtatgccttgtgacaacatgtaggtgctgtcactggctcctgcagacagttcagcaacagcccctttggatttctggatattctggaaacaaaatgaaccacgtg

SEQ ID NO: 522189 - DNA, 1669 bp, Homo sapiens
ggacagcggggatggccggggtggccacagctgccgcggggcgcgtggacacagccgacagcatccggccggatggagacatccaccacagacgacacgcgccaaggtccgggacagagacgccgcgatcatgcggaacagaggggtcacgaaatgcaggacgcacatattcacccatcagcgtgaccttatcccgacccccacttggacggcgcgaacatcgaccccatgggctcccatgagtcaccaagactgccagagacacaccacacaaaacgggctgagtatagggaaaggaatcatcaaccgctcgagtgcgcacggatcactggatcgtacccgcgttggaaacacgcctagagaggacacatgatacggacgtagccaatctcgaacaatattcccagtaccactcaacacctattacatatgcaaccccaaggacttatacacccctgggactgacgatgccgagcaccccaatggccacgcgcggcaatatcaggaggaaccacacacacagaaaataatcaccctgaccatacaagacccaatgaggccactagggcgccacaaaacgctgacgcagacagaagggatgacaacaaaatttatttgacagactacatcccatctggcttcaggtgagcccacggctgccagatacacaaaatgaccattataacccccgtaagcagcagccaggggcaaaccttacccaccaaccaacacatccggacctaacccttatttccccatgagccacacccgacgcaccattaccacctagattacccacacattcattgggactcaccatcccaacacactagatccatggcttactaccttaaccaacacaacaaacaaatctcacaaacacccatagcccgaccataccaccttaaaccacacaacacaacaaacaacaccgcaacaaaacagatcaccacagacaccgccccacatccaccaagacagaataccagccgagatcgcccgagcgacgccacacaaccgaacgggcacacccacctacgaccacacatacggaggacaacaacaatatgtggcaaccaaacagcgcccagcaggcccagccccgccacgaccaccccgccacccaacaaccataccacacagtgggaaacacaccaccaacagacggtggcacaaacaacactcttagctaccacagaaacaacacacaccaaaaaacacacacagcacaaagattcagacaacctaacaaacatactctcacacgcgaatataacaacacccaaagtagaaaatataaacaccacccatcacacacataactacaaagtacacccacacccgcgcgcgacaaccatagactacagcaccagccgagcagcagcacgcgacagacacagaccaccgtcaacaagcaacggacagcacacccgccaccacacagaacgcacggatcgcccgcgctccaccagcacacgcacaccacgccacggaccggcactcaaggaacaagacaagaagcaaacgccaacacgacagaaccacgaagacccgaaagccgaagcaccgtcctgcccgcaactccgcacacgacagtccatcatcacagcgcacgactggaccagcacccacgacctacgagaacgcggctcgacatcagccaggcgca

SEQ ID NO: 522190 - DNA, 511 bp, Homo sapiens
  misc_feature (55)..(55): n is a, c, g, or t
  misc_feature (236)..(236): n is a, c, g, or t
  misc_feature (307)..(307): n is a, c, g, or t
  misc_feature (334)..(334): n is a, c, g, or t
  misc_feature (344)..(344): n is a, c, g, or t
  misc_feature (370)..(370): n is a, c, g, or t
  misc_feature (411)..(411): n is a, c, g, or t
  misc_feature (424)..(424): n is a, c, g, or t
  misc_feature (474)..(474): n is a, c, g, or t
  misc_feature (483)..(483): n is a, c, g, or t
gaaaagtaaaaactatcctgaaccttttaagcagaaaataattacaaatatctcnccctgtccccagtataacaaataagtacaaacacatacttaactgcacaactgaagtttgtactgttagcatttgggttaaggggaacctacattccccagaatccttttctatacatgattctaggctacagctagaggaattcaagaggtattcacttgagattgggaaggaggagctncagcagcagcactctctctcaagtcattatcctcttcgtggttagaggtgacagacacaaatgctgcaggnccagcgtgcctaacacacctctctctnttgtccaggntccctcacaaatattagcctattggnaacaagctccggcccaccaccagatcgtggaggagacaagnagtgcattcaagnaatagtccttattaccaaggtatgtttagaagctataataatgcagtacnatgagtagnacctcctcacacggtagcttcagtgtgt

SEQ ID NO: 522191 - DNA, 415 bp, Homo sapiens
  misc_feature (197)..(197): n is a, c, g, or t
  misc_feature (199)..(199): n is a, c, g, or t
agcttccccttccccttgtttgggtctgtcattggccctgatccgtatacctccagattccggcttctacatgggacagacgtggatgtactgtccaccttttatctggtagggatctttattattccctattgctctagggctttctgtttcccttttttccgttaggctgcgtagtaggcatgctctgggtattntntgcgttgtccctgcgtcggccttagggtctctccctgtcccatcccggctgttgggcttggcctctttgcctctcgtcgtcttgtgttttgttctccagctttgtagcagctgccttgtcaaaccctggcgcactgtaccataggtcaatgtaacttttgtttttcggtcaatttaagttcttttgtcaccaattattaataaacagttttgactt

SEQ ID NO: 522192 - DNA, 519 bp, Homo sapiens
  misc_feature (31)..(31): n is a, c, g, or t
  misc_feature (94)..(94): n is a, c, g, or t
  misc_feature (97)..(97): n is a, c, g, or t
  misc_feature (109)..(109): n is a, c, g, or t
  misc_feature (119)..(119): n is a, c, g, or t
  misc_feature (126)..(126): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (139)..(139): n is a, c, g, or t
  misc_feature (151)..(151): n is a, c, g, or t
  misc_feature (154)..(154): n is a, c, g, or t
  misc_feature (158)..(158): n is a, c, g, or t
  misc_feature (192)..(192): n is a, c, g, or t
  misc_feature (196)..(197): n is a, c, g, or t
  misc_feature (241)..(241): n is a, c, g, or t
  misc_feature (252)..(252): n is a, c, g, or t
  misc_feature (334)..(334): n is a, c, g, or t
  misc_feature (447)..(447): n is a, c, g, or t
  misc_feature (464)..(464): n is a, c, g, or t
gaggctctgacagttgtatataccgattggnagagcggggcaagggtgtggccagagccatgacatttcattaaacaaattgtatgtcactganggntcctttctgggnctcgctcctngcctttncnanaggnaaacnaccacacccaanacncccnacccgaataacagaatgcgagtccagtgttccanatcnncttgttacacatcaatatgaaccccgcacgtgtcctggccaacnacatgctttcnttttctgtctcatcctagagctcgaatcctgattcatttcagcagggactccacaggccacaggaaagattgtggcattaanatattcatttatacttttgtggtagttcaaaacagtggtcttttttctgggcctgcttaccgaccatacaaggtccgaagcataacttaaatgggggctaagactcccatgangaccataagaagaaganagaaaaacaaaaagaaattcaaaaccaaaaacacaaactaaaaaacccctctggg

SEQ ID NO: 522193 - DNA, 173 bp, Homo sapiens
ggggctggccaatggggacaatcaaggactggaaaggcagggcagggtggcctgtaatcccagccctttggaaaggcaaggggcgaggatgctttaggcccggagttttacccaacctgggcaacacaaggagaccccccttttttctcaataattaaaccaatagcctggga

SEQ ID NO: 522194 - DNA, 121 bp, Homo sapiens
ggaaaatgaaggcatacaacaaacattccgattaatcaacaagtataacatagtctttcagtacttccaaacttacatttcctttgaatgtacaatgaaactttttgtctaaaatgttttc

SEQ ID NO: 522195 - DNA, 986 bp, Homo sapiens
ggcgttttcccgagctcagtgttcttgtgctctccgcgtcagcctttgtcgcccgcgcctgtgtcctacctgcgtgactcccggctgtacgctctgcttggcctcgccatgcctggtgcgacctcgagcaagtggtccggtccctcttgtagacttgcatacgaagtgcgatcgatgtcgagcgcgcgagcaacccgtcgtgcactgtcacctacgtcctgggtgctggcagcgttggaacgagctggggcaaaagtgcgttgacgctcacacgccaggcgttaacgcaatagactccaaccagcactttacgctgggattggtcttgacttcatgtgcaatgcttctttacaacgtatgcgtccgttgaacaggaacacccggtgaagttgcatcccaacggatgtgaaatggaatcccgagggagttcaccaggacgaactgtgcagttcacttttccctttggttgtatcaaagacattcgaagagtgcggcaaccttgatcaatcaagcatagttggctacaagatcctacttcgcgcactttcattggttgagagctccagcgagggagctccccccaaattggcaccaaagtggccctttcaccagcctggcggtaattggtccattgaggcattgaggtttatagcctgaaatggcaagtggaaccatgcggactctggcgttacagcaaggcttggtttgaacccagaaagcccccaaattcctcggtcacaattgggcagagagccacaggaattcctttgtgcacagtaacaccgaagctcctgattgtgacacaaaaaaatttaatcccacaaggtgctttgtgacaagttccctttattcccggtcacacaaacaatggttacttcgacaggtcgtccaaagcggggtcaccccctcgaggatgcggcccattaggtcgaaccgggctgggtataaaccccattaggcctcgtgacggtttgtggggaattgac

SEQ ID NO: 522196 - DNA, 451 bp, Homo sapiens
ctcgaggcagtaagtctatccaagatcttagaaccgacatctctacactaccacaggcggagagacggaatttaccaacgatgacctccctccgacggcgtactacataacaagcgtgctctccgaagataattctatccagaccatgatcacttttgaacaaggaggaaggtggaccgcacctgaggaagcctgaaaacagtgaatgtgatgctacagcaaaaaacaagaatgagtgcagccttcatattcatgcttcctagagcatctcccagaaactgaatgttccaatggccccactctcagagccgaatgccgtcagcattgtcattgctcatggtagcgtgagggatgccatctcagtgatggttccagatgtgtccatctcagatgatgggggttactcctggacacagatgctggcaggaccccactattacaccatcctgga

SEQ ID NO: 522197 - DNA, 330 bp, Homo sapiens
  misc_feature (43)..(43): n is a, c, g, or t
  misc_feature (158)..(158): n is a, c, g, or t
  misc_feature (170)..(170): n is a, c, g, or t
  misc_feature (212)..(212): n is a, c, g, or t
  misc_feature (274)..(274): n is a, c, g, or t
  misc_feature (327)..(327): n is a, c, g, or t
aattcgcggccgcgtcgacagaagacgacagaagggtgggcangggggacagagtctcgctctgtcacccaggctggagagcagtagcgcgatctcggctgactgcaacctccgactccccggttcaagcaattcttctgccccaccctcctgagtanctgggactacangcgcccgctgccacgcccggctatttttttgtacttttttancagagacgggtttcaccgtgttgcccaagctgggcaacccgcccaccttggcctcccagtanggttacaggcagagccaccgcgcctggccttttgtattttagtagagaggggnttc

SEQ ID NO: 522198 - DNA, 239 bp, Homo sapiens
  misc_feature (40)..(40): n is a, c, g, or t
  misc_feature (98)..(98): n is a, c, g, or t
  misc_feature (182)..(182): n is a, c, g, or t
  misc_feature (214)..(214): n is a, c, g, or t
  misc_feature (222)..(222): n is a, c, g, or t
agaagacgacagaaggggttccacaggaggcctacacgcngccgcttgtgctgcagccatgtctctattgatccctgtaaaagttccagcatatttgncgagtactcaacaccaacatcgatgggcggcggtagcctttgccatcactgccattaagggtgtgggccgaagatatgctcatntggtgttgagggcagacattgacctcaccaanagggcggnagctcactgaggatggg

SEQ ID NO: 522199 - DNA, 214 bp, Homo sapiens
caccgtgtgaccctgtgctccctgtcatcagtagtttgggacgatatgttatcgatgtcgtgagttctcagagattgccgagattatggcatttacgctgccccctctccggtgagaggtgacgcggccgccatcggtgaaagctttgagaccattccggaccgcaagattgtgcgtggcagtgatggcatcacctcaacgatctatcaacgtg

SEQ ID NO: 522200 - DNA, 154 bp, Homo sapiens
  misc_feature (58)..(58): n is a, c, g, or t
  misc_feature (79)..(79): n is a, c, g, or t
  misc_feature (94)..(94): n is a, c, g, or t
ttctccgtgccgctcctggctcccacttacgcgttacgtggcctcgtgacgacgcgtnacgtggcctcgtggtcacccnttccctgtactaccncgcgctgctcattccccaactgctcttgcctgcgctactaccgggcctgggtgtcgctgg

SEQ ID NO: 522201 - DNA, 524 bp, Homo sapiens
aagcacactgaagcctggggaaggatgctcaggaaagagttccgaggggatttgggtggaatacgccagtgtctgccacagaggagggggcccatctccttcaggtgggtcagaaaactaagaagggaatataccccactccccttataggtgagaaatgtagaataaatgcaaagagacacagacctggaaggtgaagattagtgtttgattcttggctctcttattcatgatgcaaatatcttgggcaaagcaattaatctgagcctcagttcctcatctgtaaaatggagtcgatcacacatttacttcccagggtggctgtgagtgttaaatcagactaagtgctgtgtaacccattgtttaaacattaggtatcaatgttttgttttttattgatatataataattgcatatattttggaggtgcatctgatattttgataactgtatacaatgtataatggtcaaatgagggaaactgggatatctatcaccttaaacatttatcttttctttgtaaa

SEQ ID NO: 522202 - DNA, 789 bp, Homo sapiens
gctcgccccgtgtggcagagaggcgactatgtgaacgtcaggtgctgctgagctgagcccgaggaggcggctggtctgtatcggggcttagcctgcagcccgcgctgagctgcctgctgcctggtgcccggagtgtcaccactgcaagtactgtgcgtgccacatacctggcactgtgcacacgttggagtgtgacccagcagggcacctgtgaactgcatggcagaacattcgattcttgcctgacaataccttggtgttccatgcactggggcactccagatgtgttggtttgcagtgaactgcgaggagcaaaaaggtgtggatgaccctgggggtgaaacatgacttgacgccagcgagtctaccttcaggacaccagtgaacaaggctgtgctgcgcaacggctggaggcacggtgacctggggaacgagacacgcaagattacctgaggagggtctggagacgacagacccgggacagctcaccgagcttcaacccgatgtcaggcggctggaaggaacacaatgggccatgatatcatgcacgatgacatgctattggctgccatgtcctgggtcaggtacatcggaggacacaagtatgttgaatggttgggcgagaaacaagaacagcgccccaaggaccggagatcctatcttttcaagaaccaaaggcttggaacgtcagaagcccgggactgactgagactaggccaggctggaagaagacacgaaccaagccaatcaagggggaatcagaagggtacaatgaagaatggggaaaga

SEQ ID NO: 522203 - DNA, 200 bp, Homo sapiens
gtaaaggcaaacaataagcagagaagggcgggggggcatctaatgtaggtaccttttgggccaacggcagccaaagaagtctccatagagatgacatacaagaaaagccctgaagatgagggggaaagcaatgtagatactgggaacaactgaagcaacagatgggacccccaagatccaggaaaaaacaaaattctttc

SEQ ID NO: 522204 - DNA, 249 bp, Homo sapiens
agcgattctccagcctcagcctcctgagtagctaggactgcaggtgctcccccacgcccggctaatttttgtatttttagtaaagatggggtttccccatgttggccaggctggtttcgaactcctggcctcaggtgtgatccgcccgcctccgcctccccaagcgttgagattacaggtgtgagcccccgtgcccaggccctcagtaggttttaaggagtccccagccctcctcccttttgggcccga

SEQ ID NO: 522205 - DNA, 294 bp, Homo sapiens
agactatgtccaatgggtcgtggttgtaaaggtcgtgacaggataaaccttggctgtacaatattgagaatctaatctttatgtttaataggaatggagacatttcgctccactgggctacagatgaatggacatgcaaacagccattttgagctccaagccatcatcgtcggtaaaagactactcatttactgtgctattttctctcatcaagtcttgttcttttggcagtagtgatatttgatctttatatgcatctgagtcattgctcgattgcatactctgaggagaggt

SEQ ID NO: 522206 - DNA, 260 bp, Homo sapiens
gagcctagagctacgaggaactattcctacagctacaaggctctgcggagagcgcttgttaagattgaaagataagaagatacatgagagcaagcgaatggaaaagagttgagagtgaagacactgtcaagccacctggatacagccatgcgtgaggctcatgtacctcaatttttaactacatgagccaacatatgtccatttttgcttaagctatttcgtgattagttttccatcatttacagtcaagggccctgact

SEQ ID NO: 522207 - DNA, 724 bp, Homo sapiens
gtggttccccaagggaagagggctgccccctgccccctgaaggagagaagcatcggtgtgcacagccagcagagcttgggatgcaccgccactgcttgcttctgctccaacacaccatctccccagcaataaggctggcaagaagagcttgggccttcgcagaggcgttggaatcctgctcactgagctcaccctcctgcctgcactgaggtctctttgaacagaatcatggcagaggaacatccttagagcctaacagtaatctcagtagttcacttgataaatttgccaccacaggttcagaaactttggggggaaactgggaccagtctggactgtggcttaagctattcagttgctgtagctgaatacccaggcgccttcaaacaggaaaacatttcccaagggtatttaggctggtgggccattctgttcacttttgaagctgggggtgagggtgggggtggggcttctactttggccggaacatggaaaacggggctcttaacaccaccttccccttttgtctagggtttcttccttaggccttcctggcctttggcccttgaaaagaataattacatgatagggcagccctctccagccatactgatgcatgttgccatgtgtacacaagcatctccccctttccagcaactccgatttgagggtactcccaatctttctgggacttccaccatacgaaaaatacaccgccagtttg

SEQ ID NO: 522208 - DNA, 907 bp, Homo sapiens
caaatgatctgtgtcccctggaccaaacaatttttgggggacaagtcccttctcgggggccccccgggtcttaggaggaggccccccgagtgtgtgtaacccctggcgggatacactctccccgcggaatgttgttaaaatttggcgggggcacacactctttggtcaagacaccattagttgttttcttataaagcaaccaaggagtgccaagtccgcgcggccgcagttttggtaatgtaccgacgccgccccccagcacgtacattcgcgccgggtttagtacgctccccatctcgctcgaatcctccggtaattgatgctcaacaacctaggagcgttggtacaaaattctttcaacaggccccatatagtagagcgcgcccaacacccgcccctttcttgggggtctctgcctgtgagatgcattcacacgcccaacgtttggtataaacactcacgcgctgacaacacctatgaaaagttgctgcgcgctctaacacaagctgtggggagcataaaaacaacaaggttgcgatggtcaaacacttcgtgtggttcgcccccgcccgaggatgctatcgtaacaacatcgctcgaaggaaatcttgttgggggtgaaaaaatatgcgcggtgtaaaatattattaggggccccaaaatcatttgtccacaaaatacctgtgagccctgacgatgccactctaaagaaaggatctttttatgaagaaatagattgtcgcaatagatctcactccgtgggaacaaatttgtaaaggaagtcactttctgctccttgacggccagcgggagacggtttttcttcttgagaaagtcatgaccgcacgcttattgtgctaagaaatgccccacacaaaatgaaaaaagccaaacggccaacaaaaca

SEQ ID NO: 522209 - DNA, 593 bp, Homo sapiens
caatgtacaccagcgagtacggaagaatgactcctccgagtgaaaagatgttggagattgggatgtgctcaagggaacagtatagacagaggtactaacatctccaattcagacttccaaatacactaacaataagttaaaaatgtggcctctgatcctcatgtttcctcaccagtagaggcaaaaaaggagatttccataactacatgtaaaaaagaacatgttcacgtaaatccacacactacgtgtgagtgttgcatgctgttcttccacaatataaaagtataaaaataagattaccgacctttgtatctagacagatctgtgagaaaacacggttgctactagataactagctctgtgtaatcctgagcaggcgcgcttatcccagtgcctcaccttcctgtgctgtctcaagagggcagaggcatggagatggcaatgccttttcattccaggaaaccacactcagatggcagaaccagccctagccatgtcgcatagcctctccatgggttacactccttggacctccaatggatgggagaaaggtctctcagcccagataacgtgaggcggtgtggtcatgtgtg

SEQ ID NO: 522210 - DNA, 111 bp, Homo sapiens
cccatacagtgtgcagtaacacacagcacagacacatgtgacatgattgggcacactgaatgggacctctgtgtgtaacatgcatttgcatctcagtgtgtgctataggta

SEQ ID NO: 522211 - DNA, 674 bp, Homo sapiens
aaaggctcccctgcgtatgggcaatgaggcccctttgaccggctcctcccctgctgggcgccacgcagcttgacactgatggagccctgtggcttgggggcctgccggagctgcccgtgggtcccatgtcactgcccaacggcctacggctacaggctttgtgggctgcttgcgggatgtggtggtgggccggctacccgcttgcaccttgctggaggacgcctgtcaccaatgccagagtctgcggctcctgccccaccccatgagctggcacctagagtccccgctcccgctgtaattattttctattttttgtttaacttgttgctttttgatatgattttcttgcctgagtgttggccggatggcactgctggccctggcctcccttccgtcctaggcagccgtgctgcagacagacctagtgctgagggatggacaggcgaggtggctagcgtggagggctcggcgtggatggcagcctcaggacacacacccctgctctcaaggtgctgagcccccgcctttgcactgcgtcctgacccactggtgttcccggcgggcatagcagccccggtctcctgtaatcaccctcgctccgtcaggcgggactcgtgtccacgagaggacggggctgctgagcgtctgatggggccttcctccgggtgacccca

SEQ ID NO: 522212 - DNA, 109 bp, Homo sapiens
ttacatcgagctcgcaccgatatccccatacagagtacaggtaggattggtgcgtgggtgaaagagtatgatggggtggtggttgtggtaaactttaatagtgtaggaa

SEQ ID NO: 522213 - DNA, 191 bp, Homo sapiens
  misc_feature (125)..(125): n is a, c, g, or t
ttccaatccattccattccattccattcacctccattccactacaattcgttccattcccttgtattccgtaccattccattccattccataccactccattggttgttaattccactcgattcnatgcgatgattccattacattccattgggaggggattccattcgcgaccattcgatgattgccttc

SEQ ID NO: 522214 - DNA, 126 bp, Homo sapiens
cacgagggcgacgatcattggtcgccggtggtcacccacatgcggatccggtctggattgaccgggcatgaggcaagaaacatcctgcttttcctgcaggggagcacctgaaatgaccggccttgg

SEQ ID NO: 522215 - DNA, 187 bp, Homo sapiens
tgagtattcggtgtgcaggtcatcgcagcattagcgagaaggtctccatctgaagatgccttcgatactagagtttagtcaatgtctcggtttgcccttgtaattctggctggacatcaggttagcctggcggtggtggtcatcatgactgtcgtacataggtccaattcaccacgatagcgagatc

SEQ ID NO: 522216 - DNA, 127 bp, Homo sapiens
tggcgactaaagccgctcgcagtagtgcgccctctatctgtgaggggtgacagaaacctcatcgttacatggcctgggtacttgtggtcgctccgtgaaaacttagacggattatcagcaagtccac

SEQ ID NO: 522217 - DNA, 721 bp, Homo sapiens
tgtgattggtggaattctggggaaatccttttggaattttgttggaacaccctctttttggtgaacacacaccttggaaccccaagtgagggttaccaactggcaaacatctcttcacattccaccacagtctaaactcagtcctgaagcttctgatcttattattaaactttgccgaggacccgaagatcgcttaggcaagaatggtgctgatgaaataaaagctcatccatttttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgatatgcgaggtgttttgaggttctgagagtaaaagtatgcaaatatgacagacaccgtcgaagaggatcctctaga

SEQ ID NO: 522218 - DNA, 380 bp, Homo sapiens
cccccccccgggggggggccgggggttttttttttggggtgtttttgggttttccccccccccctcccccccccccctcttcctggtttaagggggggggggggggcccccctttttttgtggggccctccggggaccgggggtttttttgccccccccgaggggttgtggggcgtgtttttctcccccttggggccccccccgggggggggcccgggttccccccccctttctttgggggggttttccccccccttttttttccccgggggggggggccgcctaaaaactacactcgataaaaagtaaatacgtcaatgatagatgagtaaatagtaaaaacgatggtaggtgcctatacatgcaccataaaatatccc

SEQ ID NO: 522219 - DNA, 221 bp, Homo sapiens
gtcagtcggtactccagagtgatagacagaagacattgatcagaaagattcaggccgggagtggtggctcacgcctgtaatcccagcactttggaaggccaaggtgggtggatcacctgaggtcaggagttcgagaccaccctggccaacaaggcaaaaccccgtctctattaaaatacacaaaattagccaggcatggtggtgcacgcctgtaatcccag

SEQ ID NO: 522220 - DNA, 224 bp, Homo sapiens
gcggccgctactactactaaataggcggccgtcagacggactacgccaaggccatcgccgacgagctgggcgtcaagctgcaactgcaaccgaccaacccggccaaccgcgtgccgctgctggtcgccaacaaggtcgacctggtcctggccaacttcaccatcaccccggagcgcgccgagcaggtcaacttcagcattccctacttcagttccgggtcgacg

SEQ ID NO: 522221 - DNA, 390 bp, Homo sapiens
  misc_feature (205)..(205): n is a, c, g, or t
  misc_feature (273)..(273): n is a, c, g, or t
  misc_feature (288)..(288): n is a, c, g, or t
  misc_feature (324)..(324): n is a, c, g, or t
tcttctagtgcttttcagtgatactcacgtttgcttaaaccctgtagtgctttgtgatagttcagtcccagggaaagagaaaactcgccctaggccctaggtgggaagatggtttgaaatttttgtaatcgagtaaggcacacccgaatgtaaaaatccttttgaatgatgcctttgatcaatctttctctacacctagtctgantttttttaaaatggtagcctatattttttaatcaactaagtggtcacgcacttgaaagttttctaaantcaataaggtaatgnccagttgttatttacagctctgtaacctcccgttgngtcaagtctaaaccaagattatgtgacttgcaataaagttattcagaacagaaaaaaaaaaacccc

SEQ ID NO: 522222 - DNA, 1774 bp, Homo sapiens
  misc_feature (951)..(951): n is a, c, g, or t
gttctttttcacccatgggggcatcattttgtggctacgccactgtgtgggtagttctctttcttataatatcacctccccttttgttggttgggggcgcctcttattcttgctgatggttgcgcctcatctcttgtgtgattgatttgtgtccttcccttccctgcttggggtgggcacaccacctcttgtgcgccgccgtcgcatattgaatgagctccccccctcttttggtgggtcctcgttgatgtggactcaccctctcttctctgtgtgtgactgctgcgggtggtcgccaccccacccaacattattggggggggcccccacacctggctcgcatattttttgcggcatatagttgtggggcgcccaccatgacatttttgttcgttgcggccgcgtgtatattttctttttgtcagcaggcaccacccctcgtgggggcgccttctctttttattttacagagctcttgttctcctccttcggtgggggttaatttttgttctccgccccaagtcaccgactccgggggggtgggtgatgttttctctcctttttgggtctgcctacaatcacagagtcgtacgtcgtcgtccatacacgaactcatttctgcgggggggtgtttttctctctcctctagccgactcttctcttgttttctttacgaacagtagttgttgtgtccctgcgccgccaggcacttttctcctctccctgctgtagtatatggttctctcttgtgaagaagttagttgctctacccccgcctcctcttctctctgctcataaataggagataaatataatttgtggggtgtccgccccccctcctcataggagaaatatataagatacaataaataaattatcaaactatgacatatataaataataatactcccgccaggtaaacttcaaggtgtttctgtctgctctgtctgncttctctcgcgcgacatagccccgcactagatagagggcataagagcttctctcgcccccccttctctcctcattatagaccctcgtgtatagctcctcactactagcgtcgcacaagggaccctctttttaaaaaagagccctcccaacgagatagagcgcacgactcgtgttttgtgacaataaggggttggtgcctcaccaccagccgccctctctcagaaagagagagagaaaaagattttcccgcccaccgcgtgtcaatcactccacacccttttcacgcgccgcgcgccgcaaagagagcacactctctgcggagatctctctcgcgagtagtacacacgctctcctctcatcacttatttctctctctcgcgagatagagagccggctgctcttccccacgcggaggagaaacactcacaggcgttgagcccacacatatagtgtcgtatattctatctcacacaggtgttctccgtcttgagcccacacttgagaggtcgtcgccaacatgagaagagaagaaatagagatagagcacaccacaccaccacacctgtgtgtgttttcactatttgtgtggagagtggttataacgcccaccacatcgcacccacgatttaacccggcctgtgaagaagtctgtatgaccacttgagatgtggccccacggtcaaccacccctgatttcggcctgagtggagagaagaaagaaaggcacataatgttcgacctgggctcctgagttatcgactgctttggatgttgccccaccaaattgggatcatctaaactgagtccccctgcctaattctga

SEQ ID NO: 522223 - DNA, 206 bp, Homo sapiens
  misc_feature (28)..(28): n is a, c, g, or t
  misc_feature (38)..(38): n is a, c, g, or t
  misc_feature (42)..(42): n is a, c, g, or t
  misc_feature (60)..(60): n is a, c, g, or t
  misc_feature (67)..(67): n is a, c, g, or t
  misc_feature (89)..(89): n is a, c, g, or t
  misc_feature (104)..(104): n is a, c, g, or t
  misc_feature (140)..(140): n is a, c, g, or t
atgtttttgaataatgcctttataaatntttttttcantgtntatttaagtggaattaanatatgtnaggaactccccctcccctaaantcaataaggtaatgnccagttgttatttacagctctgtaacctcccgttgngtcaagtctaaaccaagattatgtgacttgcaataaagttattcagaacagaaaaaaaaaaacccc

SEQ ID NO: 522224 - DNA, 479 bp, Homo sapiens
gtcagaagatcctggcaactggtgccaatgttattcgtaaccactggtggaacttcgactgacctactgtggtctgaacggtacttttgtgggacgggctggtgctactggcacgttagaacgacgttttaaacaaggggacccttaaacggcatttggccaaaaaagggccttatcctgtgtggaaaggacaaaacccataacttttcccttgttattaccaaaaccccccgtgtgggggccccaaaattttttgtgggggcaacaccggggttgcgaacaaggaaaaaagacctctatattgacagaggcctgggcacacatggatatggggggaaccacgggcaagaaaggaaacgtgggggtaacaacggggacggaaagggaaaaaattttatgggttgggaacttgggaacttgggaaacggggccccttgggaaactttccctttttaaaaattttccaaaataacaaaaag

SEQ ID NO: 522225 - DNA, 92 bp, Homo sapiens
ggatttgctggtgcagtacaactaggcttaatagggagctcgaattcgctcgaattcgagctcgaattcgagctagaattcgagattcaagc

SEQ ID NO: 522226 - DNA, 229 bp, Homo sapiens
  misc_feature (5)..(5): n is a, c, g, or t
aagtntagaagatatctaatagcatcattgtggcagatggtaaatcagcagccagctttctaaagtcagtctcttcctcagcattctccacttagtatctgtatcttctacatcttcctatccccctcaggtacttgacctggtgagtaagtcaataaaagtttctggaacagaaggtccagagctggactcataccaagaattgtcaaggatgaggaaattacacttc

SEQ ID NO: 522227 - DNA, 134 bp, Homo sapiens
  misc_feature (111)..(111): n is a, c, g, or t
tgcggtgtctacgatctatctgcaccacagctcatcctctatattaaggtcagttaggactgtaacaatgcgggcagaaagaagaggttaagcacttcaatccttctctgngttcactatcattttgacttgag

SEQ ID NO: 522228 - DNA, 146 bp, Homo sapiens
tcttgaagaaaatcagctgcactaacgctaaatagacttgcctaacatctcctcctagtaatggacacagactactggtttcccagtaccggtgcggaaatgttctgctgttaacataacataaacgtgtgcgtgtctctcctata

SEQ ID NO: 522229 - DNA, 446 bp, Homo sapiens
ccagaactgcctttcagactttacatttgcatgcggatggatcccaatacgtattcattgatgacttgcgtgcgctcatgtgcggatccatagttcctgaactacaatggatgtccaaagacctagaaatggtgattatgtagccatagcgccttcaactccttgtatgtatggtcttgcagatcagagctgcatgctttgctgctgtgggagatgatcagtgtatcggcagacttgactcagcacgatatgaagtgacactgttatggtcactggaagcatatggaattgctgatctgcaccaactgggtatttgttgatgggacgatttctgatcatgttaggcataccgatcacatggatgacgtcccaatgtggaacgtactctttgaagctaactgatgtcgagattacagtttgcctacacatggactgtgtattacctc

SEQ ID NO: 522230 - DNA, 294 bp, Homo sapiens
aactttttccccaaccccccttttactttttttttttgggggaagggaaccccaacggtttaatcccccttctaccaacccctgaaataagcttttggaaatcaaaggaaattgcccgttaccccctccggattttaaacttggctatcccgtttgttaattccccaagattttgttttcctttcatccctaattgttttgatccttggcagaaaaaaaggatttgaaattcaaaccagtttggccccctattttaatttctttgaattaaaaaaaaaactttttcaaaaggga

SEQ ID NO: 522231 - DNA, 176 bp, Homo sapiens
ggggccttggaatgccaggaaaaaactttttcaactgagatcaaggcttcctggagggaacccctgcaaaaaggccctcaggcagttttccagttatgtgacaaagggcaaaaacggccatagggtgcttttagttttgggatggtcccatgaccccatccagcccttggacctta

SEQ ID NO: 522232 - DNA, 529 bp, Homo sapiens
aaaaatacaaaaatcagccgagtgtggtggtgcacacctgtcatcccaggtacttgggaggctggagcacgagaatcacttgaacctgggaggcagaggctgcagtgagccaagatcacaccagagtgagactctgtctcaaaaataaataaaattttaaaaacgctcgacttggctgggcacggtggctcatgcctgtaatcccagcacttgggaggccgaggcaggcagatcacctgaggttgggagttcgagaccagcctgatcaacatggagaaaccccatctctactaaaaatacaaaattagccaggtgtggtggcacatgcccagttccccatcattaaactcaggcctgtacctggctgtccgttaaaacaaaaaaaacaaacgaaaaaaaaaaagaaagagaagagagagagagaaaagaagagaaaaacaaaaagagagaaaaacgagaagaaaaaagagaaacggacgggagaagaggggggaaagaaggggaagggtggacggaaaaagggaaagag

SEQ ID NO: 522233 - DNA, 175 bp, Homo sapiens
ttttcccacagattcacccccccacccccctccatttccctcattccttttaggagcccccccccctaccccccatttgaagaacccggatacataaaatttagacaaaaaaggaaggaatcgaaccccccaaaggtggtttcaagccaaccccatggcccccatgactttttca

SEQ ID NO: 522234 - DNA, 101 bp, Homo sapiens
ccaagtccttctgtactgacctcgaggtggcacccacatgtgctgtggttcctcctcaccgctccgagcgatgggctgagtttcacgcacagtaatgagaa

SEQ ID NO: 522235 - DNA, 152 bp, Homo sapiens
ctatggcttcttgctgttgttgtattagggcatacaacacagatcagagactttcatttctctttttatggttttctccttgagaaattggcactttgatctgtatctttgtgtaacagcttacacatacagatcctaccagcactattacc

SEQ ID NO: 522236 - DNA, 150 bp, Homo sapiens
  misc_feature (56)..(56): n is a, c, g, or t
  misc_feature (78)..(78): n is a, c, g, or t
acccactccaccttaggtaccagacaaccttaggccaaaccactttacccaaatanagtataggcgatagagattganacctggcgcaatagatatagtaccgcaaggagagatgaaaaattatagccaagcataatatagcatggagta

SEQ ID NO: 522237 - DNA, 405 bp, Homo sapiens
taaacaggcatcaagttcagtgtgttcttattatgttcgacagagttctgcatctgtcatcgactagtctataaccatgtgtttattcattttattttttgagacagagtctcgctcagttgcccaggctgaagtgcagtgtcaggatctcggttcactgcaacctccgtctctggggttcaggcaattctcacgcctcagcctccggaggagccgggtctacaggcacgcaccaccacacctggctaatttttgtatttttattagagattgggatagccatgtctctattaaaaggccttttagatagatcgtggagctaatccgacctgaacatcccagtcctggagtattttagcatgaggatagctctctattggtctggaaggttcgcctgatggttgg

SEQ ID NO: 522238 - DNA, 118 bp, Homo sapiens
gaaaaacacaggatcaggtctccttggcatggctaacattgaccttggaaaagggcgaggacttgtgattacaattattcttccaagaggcctctgagtacacaggttgaagaattca

SEQ ID NO: 522239 - DNA, 245 bp, Homo sapiens
cgcgggtctctgcctgtttctcaacatcttcctatatacttaggaaagacggcactagccctaggggcagcgctacagcgtgtatctaggataataaaccagagcaacagcctcagacacattgatttgagaagagtctatagacttaaacctaggaataggaatattacatcttggattatatacaactggctgccattggttaagacatcaacaggacattaacccaggtctagagtttatct

SEQ ID NO: 522240 - DNA, 195 bp, Homo sapiens
gttgagacatgagataaaggtacgaaagtgggtttaacactatgtgaacacacaatagcgtagacccaaagtgggattagatagcccaatatgcttagacctaaagctcaccagttctagtccacaaaagtgttcgccagaaggatacgagccagagcttaatactcagaggagccccgcggggggtctgcattg

SEQ ID NO: 522241 - DNA, 445 bp, Homo sapiens
tctcttaactggactctgttttcttttggtttatctttggtctctgtgggatctttactgctaagatgtagagccttaatgctggcaataccttcaggcccctgtaggcttctggctgcattctgtttgctattgtctctatgacagtttcatgcccagaatgggtcaccagtagacagtgattttcatttgtccaggacccatatcagagtccttcccgttatgaagttgcataggggaacacaatggtcataatatgattaggtatagttaatgtgactacttgctcaatgcaaattaattacaaagttaaactgaaaactatgcaaaagatatagaattctataaaattaattaaaaatgaaagtggagaacttctcccatcacatggtaaactattgtaaaaggattagacaggaccatatcaattaaaactaaagacact

SEQ ID NO: 522242 - DNA, 277 bp, Homo sapiens
aacccgcagttgggcttggcctcaaggatgcaggaacaagctggctagctggaggaggccctgcagaaggacaagcaggacattgcccggctgctgcgtgagtaccaggagctcatgaacaccaagctggccctggacgtggagatctgccactataccgcaagctgctgtgagggcgagagaatgcagactcacgtggaagctactactccatgcagcagtagggggtgtctggcctagcgtggttgggctccagtgttggggggctctaggcttc

SEQ ID NO: 522243 - DNA, 1381 bp, Homo sapiens
  misc_feature (316)..(316): n is a, c, g, or t
  misc_feature (530)..(530): n is a, c, g, or t
tctggctaccgggatctaaaatggaagcgttttgggggtcggggtccggatttgggggggggggttccggccccgaggaacagttttataccgcatttccgctccacctcccgaatttccttctcagtgaatctccgggcgtctctgtgcactttatacaggaggtctccaatctcagcggcggaacccagaaaccccgagggtgtgacccggagaccctctcagtctcctctgcgggcgttaagttctcagaaggggcgagagtgtggagtagattgtgccgacaaaacatgtgcgcgtgggatctccatagcgngctctcctgtgtggccctgcgtttctcccgacacaacattcttctgtgcgcgcatattatagtgcgcgagagtctcacacacacacacagagtgctcaccccacagtgcgcgctggtgtgtgccctctctgtggcgcagacactattcaccgcgccgtgaaattttctcacagcagtattatgtgtgaacagccccagtagttttctctgctgnggccccagagaagtgggtgtgacagtgtgaagatgacagagaagactctctctgtggggaaagacatgtgtgcacacacagagcctatatattagtctctctatagagagcctatattctccattctcgatgtgcggcttgtgcacccgaggggccccctgagtgtttacagagccgcggagcgctctcgaaagagaagtgaaacaccctctgtgttgtgtgtgtgacaccacccaacccagagtgcgtctcccactccgggaagagaggctatagtggccgtgaaagtgcgagagaaaagaaaggactttctccctgctgcggggtatctgtgtgtgggccaccctgttgtccgtgtggggtgtgttttaacgcacctataatttaaagatgccccccccccttctccgcgcggtggggacccacgtggtggggttctcaggtgggggtggccaatatacctctgtggggctctcaaaggccccttcgtggggcgtggtcaaaaaaaaaggttttctgtggggaaaaaaaactccaccccccaaggtgtggctcattagaaggccccaggaaacgccggtattgggtcccccggggcgaaaactttttacgtttagaacacaaggggcttgagctttgtgccgaaatggtggccgtggatgtaactttacaacccgcgaagaataattggccccccggttctcttttaaaccacaccccgcgggttgtcttccaaaaaccggcgcccccatgtgtgtgtccaccgctgaaaacacaggggtgctgttgcgacaaacattcacagggggggggaccccctttgggtgccccccaggagagacccccacctg

SEQ ID NO: 522244 - DNA, 229 bp, Homo sapiens
cgcttagtctagatgggagggacgctttactctgcagggatgagtggtcttctcgaaaaccaatgtggcggcagccctgggctctgagaccacaaatgccttgaacttgggggccggagcttgccgcagagtacctcagagccacaacagcaaggtcactacctcaggcatccctcattccccactccctggatggggctgtcgggctagtcggggctgtttggctagt

SEQ ID NO: 522245 - DNA, 227 bp, Homo sapiens
tagtcgtctagacggatcccacagaggctgatggttatcttaagtaatgagtcacctggtagtctggctggtggcaacaagggtgtcaatcaattgttcagcattccttcccgaggtgggacactccgcaagcttcatttgatatttggatctcctaaggccagtctctggaattctttttttttttttttttttttagaaaacatttcgttactttaatttttttg

SEQ ID NO: 522246 - DNA, 140 bp, Homo sapiens
agaggatcccgtgttgaaggcgagcatagcacttgcggcagatcatctggtcgcagttgtatttctggggcaagctggcggagagaaggctcaataatgccacctcgcagggcgcaacaccaggtgcagggtggactctt

SEQ ID NO: 522247 - DNA, 305 bp, Homo sapiens
  misc_feature (18)..(18): n is a, c, g, or t
  misc_feature (293)..(294): n is a, c, g, or t
aaataagccagagtggcngaaaatgaaatccaaaattgtaaaaatattccaattaagtccagcactttataggcccaaagcaattatttttaatatgttttatttttaattattatggtatataatatttgtatatatttattggatacatgtgatgttttgatactgtcatataatgtgtaatgatcaaatcagggtaactgaactatgcaacccctccagcatttatcatttctttgtgttcagaatattccaattctacactttaattatttaaaaataaacaataaaannctgtttactat

SEQ ID NO: 522248 - DNA, 812 bp, Homo sapiens
  misc_feature (553)..(553): n is a, c, g, or t
  misc_feature (590)..(590): n is a, c, g, or t
  misc_feature (711)..(711): n is a, c, g, or t
  misc_feature (736)..(737): n is a, c, g, or t
  misc_feature (747)..(747): n is a, c, g, or t
  misc_feature (757)..(757): n is a, c, g, or t
  misc_feature (776)..(776): n is a, c, g, or t
  misc_feature (788)..(788): n is a, c, g, or t
tcaccgggccggttctcttcgggaatttacgcaagggccaccccccatatccgcctttatgtcctatatacttccaggtcatcccttcctgggagaggtcatccctggaactggaagtccttatcgtaccttggtagagagtatccgcaaggtttcctcctcaggaagattcaaggacctgatagcaagatccggctttcaacacaggtgacttacgaaagtctaacatcaggccttgtgccacatcaatctggcttccaacgttaattcccttcctatcactggagcactgaacccgtcatatcctgttgaaaagcctggaactgaagggataatctggccaatgagacaacgccgcacgagcatctcctcttaaggagtacgtgcctctggactcatgtttgaatcgacaccgtctcacaagtggaagaaccaattcttgtcacttttttacagctttctttggagctgcttcagtccactctcccacgaggcactttggtctgtatctttgctcacactgctaaatttcttcttggctgtaggggtgtgntggttaaaggtaccaccaccccctaaagactccgttnttgaaatgagtggtatttatagacttctctgcgtggtgctgcctttctagagggatgatagatcatttgaaccccatagaccaattttaacccgaaaatttaattgtacctgaatcaaccnttcagcctaggacgaagtctaggcnngtcagagtanttatgatcangagaattgtgtctgaaccngtaacgagttanccttttacacgaggaaaaaactcg

SEQ ID NO: 522249 - DNA, 124 bp, Homo sapiens
  misc_feature (33)..(33): n is a, c, g, or t
  misc_feature (78)..(78): n is a, c, g, or t
  misc_feature (117)..(117): n is a, c, g, or t
tcccctccttgccatcacctgaagacccccacnccaaacactgaatgtcacctgtgcctgccgcctcggtccaccgtncggcccgtgtttgactcaactcagctccttaacgctaantttccgg

SEQ ID NO: 522250 - DNA, 706 bp, Homo sapiens
  misc_feature (377)..(377): n is a, c, g, or t
ggaactggctgtcggtgggggtgcagcactgagccgccgacagggcgggtgggctttgctgccgagcaagcggcgctgtcttgtgggcctagcggcgaggcgacccgcacagtactgtaagattgatgttaaaggcatggtgttcaccccacttcatcagcgtacataagttatctcttcttttggacccttattttatgccataatgtatgtcattgaaagtgcccgactagagacctcctaaaaggaaatacctatcaagtggaagaaaatctgtatttcaaaaactttatgacttgtactactggaacgaatgtgatcaaaacgaagcctgaacgttaaggcagacaattaacgaacgacaatgtgacacttgnttacgcagacagcttgttactgcaaggagcactttgctccagctcgtttagctggtcacatctataacccagagaaatgacgggatattctctgactgctcaggcggaaaaaaccggatcgagcttccgatgaccgattcgtactgccctatgaacgaacggagagtatgcttgaactatctggatgcagacagaattacctcactatagtgggttgatctccatagcaaaaatctcaggttaaatatttgtccactctgcggactgtgtcatagcagaaatacgtgactacaggcagtccagtaacatgcaaatctccatggttacca

SEQ ID NO: 522251 - DNA, 171 bp, Homo sapiens
gactcatagatcccctcatcgaaaccctaacctgttgcagggacactagatcagagggaaaggctgctgtatttcgatgacggccatcgaaaccctcttgaactctctcttcaaagttcttttcaactttcccttacggtacttgttgactatcggtcagggtttcgatga

SEQ ID NO: 522252 - DNA, 341 bp, Homo sapiens
atcagctatcaacatctttctctctttaatcattattgtaatcaaattactgttaattgtgccttttatcatgggaattttattactttaataaatttagatttttttccaagtttaagaaagaatccagttcacacttttttattctcttctccttctgtttctttgaatttagctgttgacagtgtcttgaagaggatgacaataattggtgtaattttatccttccgatcattggcacaagaagcacttagagatgtaagaaaccattacaagtatatactcggtatccaaacaatcccttttaatttctcagaaatttaaagttaagtttcagattc

SEQ ID NO: 522253 - DNA, 2182 bp, Homo sapiens
tttttcccctcttttttttttcgcccccctgtaacgacgccagtccagctgcatcctccagttcactctagagatcccctcgcgaacgtgttatcccaacaatgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522254 - DNA, 259 bp, Homo sapiens
acctcgagagcgtcatcagcttcaattaactggtcgtcgattcgatttgtgtccgatctgtgtcgttccattcgtgccaccgtctcggggcaacaactgcagacgcctcgtcgcccacggctgtgatccactctcagtcagtaccatggcccatcctctgaagcgcatgcccccatatcagtgcacccagctagcaatacattcagcaatcatagtcaccccctcagctctatcttcacaggcacggttgcaagccgat

SEQ ID NO: 522255 - DNA, 322 bp, Homo sapiens
  misc_feature (250)..(250): n is a, c, g, or t
gcgggctggggggcaggagctcgggaccacatcgaaaagtgctaagttgcactcagtcaggtaactcttgcttctctctctctttttgttgtcttgaaatgtctgtccaagtcgagatctatgtggagtcttggtattgcaatgaaggagagggcacaacttagttaatataaaagtcccaagtttgtctttaaaaacataattcgaggtttctctttaatgcatattgggtgtttgctgactagagcanttttgattagttcgtgcatggagatttgttggagatgagaaaccttaagtttgcacacctgttctgtagaag

SEQ ID NO: 522256 - DNA, 2138 bp, Homo sapiens
agcataaactattcaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522257 - DNA, 1658 bp, Homo sapiens
  misc_feature (8)..(8): n is a, c, g, or t
  misc_feature (54)..(54): n is a, c, g, or t
aaaataanaaataatattaatatatataataatattaattaagacaagaactcnaggagacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522258 - DNA, 439 bp, Homo sapiens
tgctgagaacaagaagacaagtacctaggcattgaattctgacctctcaaggcctcaatgatgaccactattaataaagtatagtatggatgtgtctacataaaactctgactatattaagccctcagctttctatatggctggtttcattaccttcaagagattatggaagcatcagacgtgttatctgccataataatgctgtgtgtttctcatgagagcttcagatcctctacacactttacattcacctctcctcactgtcaccggtgacgtaggcaagggatcaacagacggtgcgtcatcaaaaacagtggaagaccggaccgtcggatgtacttagagcagcacatccacttaaataatgattgtacccatttcaccaatgaggaaatggggttataattgagacaaggctgcggtcaacttgtctggagta

SEQ ID NO: 522259 - DNA, 1589 bp, Homo sapiens
cctgatacaatcagtctcgtgtgcccaggaaacagctatgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522260 - DNA, 106 bp, Homo sapiens
ggatctgagtgaggcggaaaatagattcgagcgatgttttatctttggtgcagtttgggcacttaaaatgagatcttgtttcctggtttgcagcggtactggtttg

SEQ ID NO: 522261 - DNA, 2210 bp, Homo sapiens
tttttcccctcttttttttttcgcccccctgtaacgacgccagtccagctgcatcctccagttcactctagagatcccctcgcgaacgtgttatcccaacaatgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtaagaaaccattacaagtatatactcggtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522262 - DNA, 1533 bp, Homo sapiens
agcggaagcgatcagaggatcccctctggtatgcaagtgtctggaagaggtgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522263 - DNA, 208 bp, Homo sapiens
aacgatctgcatgtgtgaagcaacagatgagaaatgagcatgagcctgattctgtgcttaaatattgtgaagtcaaatatatataaatattgttatctatttgttatgttttagaggtgaagtctcactctattgcccaggctggagtgcagtagcacgatctctgctcactacagcctccacctcccaggttcatgcgattctcctg

SEQ ID NO: 522264 - DNA, 1523 bp, Homo sapiens
tttttccagtgcctgcatgagatagtcaaccgttcaaacttaacgtgtggacggttgactatctcatgcaggcagtggaaaaagaccccacgcaccacatcaagaagtaccgtgctgtattcgcacaaggcaaaggtgtggcctggcctaaggcggccacgttcaacgagcaacaatcgattcctgtcaccactgctgagcagtgggctcggaaaaccttgcagtccattgaaaaccggatgacattcactctgtacgtacagagtgaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522265 - DNA, 1634 bp, Homo sapiens
caaggaaattaagagaggacacaaacaaatggaaaaaatattccatgctcatggaaaggaagaatcaatatcatgaaaatggccatactgtccaaagtaattcatagattcaatgctatgcccatcaagctaccactgcctttcttcacagaattagaaaaaaagtactttaaatttcatatggatccaaaaaagaccccacgcaccacatcaagaagtaccgtgctgtattcgcacaaggcaaaggtgtggcctggcctaaggcggccacgttcaacgagcaacaatcgattcctgtcaccactgctgagcagtgggctcggaaaaccttgcagtccattgaaaaccggatgacattcactctgtacgtacagagtgaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcaca

SEQ ID NO: 522266 - DNA, 2501 bp, Homo sapiens
tttttcccctcttttttttttcgcccccctgtaacgacgccagtccagctgcatcctccagttcactctagagatcccctcgcgaacgtgttatcccaacaatgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacaaaaaaacacacacccccacacaccacacacacaaccacacaccaccacacacacacaccaaccaccacccacagctagaagccacaaccaacagaggcagccactgtgacaccacgagagaaataaaaagaaaacaaaacagcagccaagggatatcactcactcgacacctatccacccaccatccactctacacactccccaatatccttccacatcttatcaccaccacaaatcactctcaccactctacatcacagcacacacctcccaaccacataatataaataatatatattcactatactttctctcccct

SEQ ID NO: 522267 - DNA, 335 bp, Homo sapiens
tggagatacagacgcgtgagatagaacgagacaaagatgggaggcaatttcagacgtgctcacagaagagaatatgctgaaaggacaacatgagaaagaagcagcagatcgaaaacgcaagcacgaggaacaactggaaactgagcacattaatccagttactgaacagagactacacgtggagcaaacaagagatgaagatcttgatacagactcattgaactgaatttcccccttccccccaattgatggaagaatgttccagattctaaattgaggacttcattattaatggcattactgtgttatgattaacaaatttcctgtaaggtaca

SEQ ID NO: 522268 - DNA, 268 bp, Homo sapiens
cccccacccccgggagtgttggtagactttcaaattccatttttgagattttatggtctattcctagaattttagattgttttctcagaattccaaattccccttttgaggctttaagcccagcctaggatttgacactgagtttcaggcccttgactttggcccccttgttcccaggccccctgtggctgactaggggctggggtgtttcctccccagggcctggtcagcacccaaatggttcaagtaaagcaagttgtgtccccca

SEQ ID NO: 522269 - DNA, 914 bp, Homo sapiens
  misc_feature (705)..(705): n is a, c, g, or t
  misc_feature (720)..(720): n is a, c, g, or t
gtcacgcaccgagaggcgggggtgtctcccatgccccgcttttctcagcccaggccagcagtggtccagtgctttggatcagggttccccgcccaggcttggccactcctgccctgatcccttaatgcttttggcccagagcaccccgctaagtccaaccccagaggggcctcatccgcaaagcctcgggaagaggacagtgacggaggcggctgccctgtgagctgcacggggcagaatgtcctttttggcgtcatgttggatgttcacacattccattatgggggttcagttctatttgggattccctttcgggaaagagggtagagggggtagggagggggttaagcccacgaagaacggagggcattgccagaagggggtgggccttgaatgggttctggcacttgcttgttccattgcaccaccgggggagccgtttgccaaatttgttgcttctcccaaggcccattagtggccccccccacaaggagagatgccctgggacgtccccctgtgttgggccgtctggtggttctctgcaagggagcccagttggatgatggcccccgtgaaactcctcatccccccttggccttggctgggggtctcctggcaggtttatgggagccgtaccatctttggggagccgcctgggacccacgacatcatcgaccctggaacagacatggcacgcacctccangctggcccttgaacnttcacccgcccacatggcctaccgcaaggggcatcatcttggtttataaagccgcaacccggcagttctcgtacctgattgagaacatggcccgtgactggggcaagtacgcccacactcgctacttcaggggcggcatgctgagcaacgcgcgcctcctctttgggcccacggtcccgctggcggacctcatc

SEQ ID NO: 522270 - DNA, 925 bp, Homo sapiens
gctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcgcgcagtatgggcagcacgaggacggctcgcaagagcggagtatggtgtcaagccgaaggcctgtggtcgatggtgctatggcttggatcaatctaagatgaaatgtgagcgagtgtcaatgtctttgattatatgggaatgtggaagaaggtgaaaatgatgaaaagtaagcacgggggcggccatggtggagatggctgatggatacgactgtagaccgggaacattagcgcacgtcatcaacaaaattccatgtttggggcagaagtgaatgtctgtgttctccaagtcaggccagaacataatgacagtggtcagaaagtacagggttggaagaagggtcttgcaaggtacaaaagaattcagtgaactccggcaacaactcggaatataccacaccacagagaagggacagccacacagaacccgaatccaagacaacccaaggcaagtgatgactatcttcaagccgccagtggacggtgaacgacggagacaatcccggagatctgggcatgcacatggcagctgaaggcggcatcttcatgtgaaagtatactcacgcaacaacgacacggaatacgtctgaaggcgaggagaaaccagaggagacaggacaactgggtcacgaacaatacagagagaacgagagggcagcagccaagcgacaaagagacacaagacaagagccacaatacagagcagagaca

SEQ ID NO: 522271 - DNA, 660 bp, Homo sapiens
tctgccttctttatcatcttcataacaccccaggcagagggtgcgctctcactcaaattcctgtttgcatctccacgagccatacataagctacaatcatctcaggaaaaggggttccccttgcatcatatctgtccaggctaaggatttggtccttctaggttctactggtccaccaagtatagagagatccctggggcctgcagttttccctccctcttcagaagggatctcttggcaacagaggtagcatgaggcatgctctgcttacttttatccttaaaggcctttcagatgcccagagtctgtctgttggtcctgagcaagccatcttccagatgggtccacgtggccttctgactgccatggcctggccctcacagtgtctctttcgggtggtgtttagagtggaatttgcctcgtcttcttaaccagttcctgttagatccctgtgttttctcccttcacctcagagacaattctttgggctgggatctcgccgtgtccctgggtttccctgggtcttggtttcatctttctcttcacagagatgatttcagtttatttgtggcctttctggaatgttccttggagagccaatatgttccaggtactttgtcagaattaaaagactctgaaagataaaaaaacaaaaaaagg

SEQ ID NO: 522272 - DNA, 236 bp, Homo sapiens
cgtcgggcccggggacgccgaatggtcacccgatcagcagatcttcggggccatgtgatcagctcacaaccgactaggcaaccggtcgatctgtcactgccggctaccctacgagcagctgcccctcaccaaagagcgcggcgtgcatcaggagagggacgagatgggttgtccgtagtcgtcaaacgctctgactggagacgcaaggtgcgcgagagtcggacgtcgactctcgt

SEQ ID NO: 522273 - DNA, 125 bp, Homo sapiens
atttttccttttagccccgagggtaatcctgacaaacagttcagccaggaggaggcagagaggactgggctgggcaaaggtccaccaggacctggctcctcctctctctctctctctctctctct

SEQ ID NO: 522274 - DNA, 233 bp, Homo sapiens
cagctaaatatactttagctttcgtgctcaatatcctttcccatataatgtaagggttttacctcagtacctacaactaactcatttagttgaaggcacatgttagagttaaggaagggctgtgaatcctgttatgctatggtcatgacatcatatcaaaggtaaactaaacagagactctgtatcctcatattctatagtggatctcctagctctgaaaagaaatcttgttc

SEQ ID NO: 522275 - DNA, 427 bp, Homo sapiens
ctaatactttgggaggttgaggcgggtggatcacctgaggtcaggagttcgaggccagcctggccaacatggtgaaaccccatctctactaaaaatacaaaatattagctgggcgtggtggcaggttcctgtaatcccagctacttgggaggctgaggcaggagaatcacttgaacctggaaagcggaggttgcagtgagctgagatcctgccattgcactccagcctgggcaacaagagcgaaactctgtctcaaaaaaaaaaaaatgttttagccaggtctggtggtgcatgcctgctggggtctcagctattcaggaggcgggggtgagaagatggctggcacccagggggttgaggtggtagtgagctggtgatggtgccacggcactctagccggggcaacagcataaccaagacactggtc

SEQ ID NO: 522276 - DNA, 269 bp, Homo sapiens
acccagtacatatgacttccaaatgctgaaaatcagtgattaaaagaaaaatcttaaaagcagccacagaaaacaagtaaattacatactagaacaaagaatagaatttcctcagactggccaggcgcggtggctcacgcctgtaatcccagcactttgggaggccgaagcgggtggatcacgaggtcaagagatcgagaccatcctggccaacatggtgaaaccccgtctctactaaaaatacaaaaaattagctgggtgtgcggctg

SEQ ID NO: 522277 - DNA, 109 bp, Homo sapiens
gggggtacagctcagcgtaaattgtctccacactcctcctcccggaagagcttcaagagctaagaactgcatgcagtcactgacttccaagtgcagcaacccagcccat

SEQ ID NO: 522278 - DNA, 1408 bp, Homo sapiens
  misc_feature (77)..(77): n is a, c, g, or t
gtgaggcaattggccggcaagcagttgtaagtcgaggcatcggtgatagcacactatggtctctgtgagcatcatanggtgtctctgaacactatggatttgtacataggtaagcttccagcattgcacaattcgacatgtacgtactctgggcattatcgtgacggtatcatgaactaaataccatagattcgtaagctctcgcggatagaattgagcaagacatatggtgggtgagacggacgaagcgactaggctatttcctatccgctgaacaatgggaacatcagatcgtgatttaatagtagagctcattatcagcatctagctctgtccttataactaggcacagagagctggcactgcagtggtattcttattccactctattgctggggatagaaagactgggtttggaagattgacagactagtgtcttggctatgaacgcagggggaacaacttgcttggtgaggtctaggtggtttgggagaactcaggtagagacctatgagagtatacaaaggacatcttcctgtaccaggaagctagaatcggtttctgtactccagaacacgcaacccaagagtcacgctggaaacactttgccatgggcaatcattagagattatttcagagggagttgtccttcctgggggagaacacaatttgcgaattagagtaacctggtaagaccagatcatctattcctcgcaattcactttccccgcgaggggacagagagattcaatctgggccatagattttattggaacacttggaatttgtcgagacgcattcgagcaagagcaagcccactttgcagtcttgtgccctcaatttgaatagtccctaggggttggaaattcgcggctttaaaatgtgctttcactggcacagcaattaacttaaatggggtgaatcggccgcccctttcccgttgggggtagaaacacgaaaaacgttgtataccgaggttgaattacgtaacccttggagttgtctaggtttagctttctttccttccagttggaagtcccccaacaagcttttaaggagcagttccccagaaggcttgcccaacccaaatatatttcattcgtttgtaccccactctaattgggcttgaggagaaactctcggtgcacaacgagggtctgggcccatggcggagtgaaacacaatttaatgggagccgagaaatttaacggggttgggctcctctgtaacccacaagcggtgcttggactagagactctgtgatgggcaaaagaaaaagaggggagcgtttacataaacgctctggaggggagagaagattggagacagaagcttttcttttggaggacaaaaagttattattgttttaacttgaacagaaagagaggtatatatcggagcaacatga

SEQ ID NO: 522279 - DNA, 936 bp, Homo sapiens
ggaggttgcttgagcccaggagatgaagctgcagtgagctgcgatgtgccagtacattccacgcctggatgacagagaccttgtctctttttaatgaaacaagtgggcaaacagaagttcaagaaaggaaacttagaaaccaagtctcaatggagatataacaaaaaaaaaaaaaggaagaaaacagttaaaattcttcggcaaattttgggggcgggttccgaaaaactattttgatactgaggcctggctttgaccgggtgttgtaacccaatatgtgcctggccccatggagttaacacattttttctccacttctcggactctggggttcgcccccaaggagtgaagaaagtttccacaccaccggacaacaaacagtgctcacgtgcagggccagctaactctgggccgcctctcaggccgaagtcggcgttcaaggggggggcacttcaaatggggacggtttcacacacgcagtcgtccataatatgggcctccgggagatccacagtaatctgctcgcgcgcgtttggacggaggtcgaacgaccccggaggaaagacatcaaagacaccaacacagacaatgatgaggtgggcgaaaggggcaactatcaagcacagctatccacatgcgacacgcgcgtaagggtcccggcgcccgaccaacaaggagatggggagcacgagaagcagacaggggaccctcgcccgcgaggcacagtctggcaaaataccaaatgtcaaaacggggcacctacaaccgtctggaataacaggtgctcccggaaaacgatgggtacccaaatcaaaatgccaatgtcttccataaaccgcggtctcggggggcaggcagccgcccagacaccaagataaacggtacggcagataaaagcaccccgccggcacccacagggggagcaacagcggggac

SEQ ID NO: 522280 - DNA, 331 bp, Homo sapiens
  misc_feature (56)..(56): n is a, c, g, or t
taacactaggaatgctaaattcatgacagtaaactgaaagattttgcacacttcangcaagcaagtggcaggtcatcttcaatacagacaacggcaagataaaatgtttggggaaaatttatttaaatataaaacaatggtgacaggctgggtgcagtggctcgcacctgtaatcccagcactttgggaggccgagacaggtggatcacctgaagtcaggagtttgaaaccagcctggccaacatggtgaaaccctgtctctactaaagatacaaaagttagccaggcgtggtggcatgtgcccgtgatctcagctgcctgggaggttgag

SEQ ID NO: 522281 - DNA, 242 bp, Homo sapiens
agtgacatcaggcgatgacagaataggacttgtcagtgcccatcctctcacagaaacttcaatttgaacaaccattcacacgcacaaataccttcactagagctaaggaatccagacgagagattacagcacctgaatgtagcacagaaataagagaagatgtattgaagagggtaggaaggacagtttcacactgtgctttgttcgtcatgtatttccgaattagttctgattttgtaaaa

SEQ ID NO: 522282 - DNA, 408 bp, Homo sapiens
caaatgacctcttacttatcaggctcacctgtaactcgtttattctatcagtacagacttgtggtttgctgccttattcttaaagtcccgaccatcactttgtatgtggctgacagaggccccttgctgctggcgctgtgtccctgaacatccctgtcattctttggacacccttgacgaattctcagcacaaggcgctctggctcttttgaacagtggttcggctgctgctgcctggacatacgctgccactctagaccagctgcccagcaccccgtgggtcccgtcgcttgcgactgatgcccaagcaggtgcgctgaaggcctgtgtctgggcccatgtctcgctggctctcagcagagaactatagtgtctcttccgtttggctcatttgtgtacctgttgatc

SEQ ID NO: 522283 - DNA, 118 bp, Homo sapiens
tcggtccacatgattgtccacgtccttaagcttcaattctgggccctttaaggcttagcagcctctgagctttcagagaccctttagcttcagaagcctgctaattccttggacatgt

SEQ ID NO: 522284 - DNA, 463 bp, Homo sapiens
cactaatctttctgtcactctagattggcctgttccagacatttcccatgaacggaaccatgcaatatatgtggtcttggtgtctggcttctcacttagcatcatgtttccaaggttcatcagcacttcgttgttttttattaccaaattgtattccactgtattgatatacaattggttctccttatttttgggagttctgttctgtaaagtcaccgcaaacattgaattagcaaacattgaaccactacccctacaggaaatagagttaggttcctgcaagcctctggtcacatttttgcctactgatcgatatgtaatcttgttttatgtgtatttctgtttaaagacaactaatttgatatataatgtgtctatatatttatatacatatgtgcatatgtatatatgtataatatgtgcatatatatatagttggttcattaacattgaagttatggcc

SEQ ID NO: 522285 - DNA, 346 bp, Homo sapiens
catcaccccatgcccccccgggccccccccgggcccccccccgggccagcccacaaaagtccagcttcctcggaggggtttattaatgccccccccccatgctccgcccccttacccaccccaaaaaggggtaaacaagcccgggggtcccccaggaggggggcaggggcccccccttcaacccccgcccccccccaggggacagttttttaaaagaggggccgggggcatttcccccccgctgggggggcaaaacccccccaaggcccccccctttaaaagggcacctggccaggggtaggttttttcaataaagtttttgtattaaaggaggggctctgggtta

SEQ ID NO: 522286 - DNA, 660 bp, Homo sapiens
  misc_feature (28)..(29): n is a, c, g, or t
  misc_feature (257)..(257): n is a, c, g, or t
  misc_feature (261)..(261): n is a, c, g, or t
  misc_feature (493)..(493): n is a, c, g, or t
tttaaaaaaccccccccctcgcgggggnnattttttttttgtgggggggccgccccccaccccaaggaaaagaaaaaaaatttttttgtttttttaaaaaaagacacccccccccccccccccccccaagggggtggtctcctctcccccgccgcgggggggggggggggtttttcttcttcctccccaaaaaaaaaaaattttccgccgggggggggagggacccccccccccttttttttggtgtagggggaganaagnataaaaaaaaagagtgtgggggggggaaaaagaaacacacaccccctctcttttcccaaaatttttggcgcccgccccccccaaaaaggggggggggggtagaaaaaaaaaaattgttttttttttaaaaaaaaaaaaaaaaaaaggggggcccccccccctccccctcctttaaaaggggccatttttttttgggaaaaaaaataccccccccaaaagggaaagaggggcncaaaaaaccccccccttttttctttaaaacacaaaaaggttttcccccccaaaaaaattattttttcacaaacccccccggtttttgtgaaaagaagttttcccccctgtttttgggtggaaaatttccgaaaaaccacaggcgtgccaatctttgggaatttttcc

SEQ ID NO: 522287 - DNA, 630 bp, Homo sapiens
  misc_feature (146)..(146): n is a, c, g, or t
  misc_feature (261)..(261): n is a, c, g, or t
  misc_feature (319)..(319): n is a, c, g, or t
  misc_feature (358)..(358): n is a, c, g, or t
  misc_feature (398)..(398): n is a, c, g, or t
cacctatgtactgggctcaacaatatgtcacactaccctttatggggagggcccatgcaagagagtcacatcatctaaattatgggcccaaaaatatgtcaaaatgctatgagtatggctcaggaaaatgaaagaatcacatgacntagggtttaggcccaactatatgtaacaaacaccccagttcgcagagcacatgcatgagcaaagagtcacatcacctaggtgctgggcccagtgatatgtaataatacttttttngcagttcccaggcagaagaggagtgtcacatcacctaggtgattaatagaaagatatntcataatacttctgtgggcggggcccttgcaggagagtngcattacctaggtgttagacccagtgatatgtctcaacanacaatgtgtgcaggtcccagactggagaggagagtcacctcatctaggttcttgacccagtgatatgccacaatcccttttggggcagagaccaaagagtagagtcacatcacctagatttggggcccagcaatatgtcacaatatcccaagaagagggtccaaacaaaagagacacatcggccgggcatggtggctcacgcctgtaatcccagcactttgggaggcatgca

SEQ ID NO: 522288 - DNA, 832 bp, Homo sapiens
ggatcagccgcttcctgcctggtggaggagcttcgtgccgtgtactgtcgcccatcctgcgcgccagcctgccaagcagcgtgccccggttgcaggcgtcatgcagcgtggcgcgaccacgctctgggccgtgcgctgactctgctggtgctgctccgcggggggcgtggccgggctggcgcgagctcggggggcttgtgtcccgtggtgcgctgcgagccgtgcgagcgcgtgcactggtccagtgcgcgcctccgccgcagtgtgcgcggactggtgcgcgagccgggctgcggtgcttcctgacgttcgcactgagcgagggccagccgtgcgggcatctacaccgagcgctgtggctccgtgccttcgtctgccagccgtcgcccgaactaggggcgacgctgcgggggctgcgtggacggccgcggggctctgcgtcacgctagtggcgtcagcggctgcgcgcctaccctgttgccggcgccgccagtccagggacatgctagtgagtcggaggaagaccggcaggccggcaggtgtggacagcccgtacgtctgcagcaacggcacgggtggttgatccaagttcacccctccattcagaggataatcatcaatccaagaaagggctgcttaagaaaagcagggtacaaagtgataagagtctcaaagcacagattccagaattttctccgagtccaggcggagacagatattgggcctgcgtagagaattggagacacctgaataactgaagttcctcaatgtggtgagctccaggtggacaattcccaatggacagaaggattaataggaaacgcggcgtctt

SEQ ID NO: 522289 - DNA, 697 bp, Homo sapiens
cccatttctttcgtgtgatcatgagtattactatgaaaaaggtgaataagcctacctgtatcaccactaatccatagacagtaaattctcatccgattaacagcatcttcactaaacatcatggtgcaatagccacagtcgggtgaccaggacgtatcatccaagcaaggcattactaataactatccgaagctaacccaacttcaatcatacggacagtcaactggttgcaggtaactcatttatcaattcatctgatcattctcagtttagcatagatccgaaacgtagccagctgatgatacatacatgtgatttcactacaagcaggctatttcccatttttccccttctcgcccctctccagcatcctaaaagtaacttgtgatgagcttacaagaaactcttgcatgaatgcacagaaagtagaggttggggtgatggaaaggatcacatatgttcagtgactggttaccatggcaaccctccacacaaatatgatatagatatatataatatatattgtagatatatattatacatatatgtacacatgtataccacgcacccactcacacatacacacacgcactttggatcaacatcatttccaggttcaggaaatagaggatcataatttctgtgacatctcatttatgcaggtactcactggaggtctgagatccttaaaatgctg

SEQ ID NO: 522290 - DNA, 377 bp, Homo sapiens
actcccttcccatcccagacccgagacgcagaaggctttagacagagcagcttcatcaggaatctggactgggctgaggtacctgctcccagctcctcaaagtgccatccggtaaatctgcatctattagagctgacagccaggctgctcaggcttaaacaattaatatgcatgaggagtccgcaaactcagagcaggggcatgttactgtgctgggatgtaggacggcttctcggataaggtcattcatttttatgattctgcttaatttggatttgccagtcttcctttcattatcccatgggccagtcttaataatcaagactatgttatgtgctttgtggcataattaaagccactgcctaattagacaagca

SEQ ID NO: 522291 - DNA, 193 bp, Homo sapiens
  misc_feature (180)..(180): n is a, c, g, or t
agggtgggaaaaatactgtagggtttggggttttaaaaagtcaagcagtgtccctatcccaagaaagtttggaatgggaattgtccactcccattgcagagagcaactcatgtcatctgtgtgacgtgagagagggcccccattttgggactctctgacaagttgttgggaagggcgtangtattttttgggg

SEQ ID NO: 522292 - DNA, 575 bp, Homo sapiens
  misc_feature (9)..(9): n is a, c, g, or t
  misc_feature (79)..(79): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (145)..(145): n is a, c, g, or t
  misc_feature (151)..(151): n is a, c, g, or t
  misc_feature (186)..(186): n is a, c, g, or t
  misc_feature (212)..(212): n is a, c, g, or t
  misc_feature (288)..(288): n is a, c, g, or t
  misc_feature (558)..(558): n is a, c, g, or t
ggcggaacngtgtctccttcactttcgccctccagctgctggagctgcagccgaccgcgagcgtgccaagcggcttcancagctagcggngntnggcggcggccccctcaggacaccaccagattcccctcttcccgcggcctcncatggnacccacggacagacttgcgcgcgtcaatgtgtatnctcatcatatgctgaccttggcaaanctgccagagatattttcaacaaaggatttggttttgggttggtgaaactggatgtgaaaacaaagtcttgcagtgncgtggaattttcaaccgtccggttcatctaatacaagacacttggtaaagttacttgggaccttggaagaccaaatacaagtggtgtgaagtatggtctgactttcacagaaaagtggaacactgataacactctgggaacagaaatcgcaattgaagaccagatttgtcaaggtttgaactgacatttgatactaccttctaccaacacaggaaagaaagtggtaaatcagtcttctacagagggagtgtataacctggttgtatgttnacttgatttgctgaccg

SEQ ID NO: 522293 - DNA, 1253 bp, Homo sapiens
  misc_feature (1221)..(1221): n is a, c, g, or t
ggacgcgtgggcattctagatgatggtgggcgcggaacaccatgcgcctaccgtctggcttcctggatccaacctccaccgatatgcagctctcagggagacagtcgacaccacctgaccgtgatgggattccatgcctcaccaatgtcttcgcgcgtcgttactgcgcgtgggtgggcccttccggtgtccggcatcgtactgttggagtcgtcgtcgtccagagaccacaggctggccaaggtacatggtaggaacaatcaacaccgtgggaagggcgcccgtggagcagcacgcaggggctggtgatagcaccaaggacactaattgcctgtgaaggggggggctcgctgcgcgtgtgactagtcgagcaagaaccccccttcgtagcggctcgtcccgtgaggcctctcaagagcacctaggtcccaatatcggggtggaacgacagggaatacgggttcaccgcatcctgcttgaagcagcaacgcatcacctagtcccacaaaaagggctgctattaccttcctagaccccatgggggacgcaggcctttggaagcgacacgtgagacagctaggcgcacggacggggaccgagcaccgtagtgtgatggtggtcaagtacaccgtgaaggtggggcatggataggtgggcgttcccatgaaggtcctcgcaaggccacaaggcacgttgcagagaggtccactccctgtggactatggtgctcacgaatggccaggatcatatgcggcgcggggggtacagcgacgtagaagggcgccatcaaaggcaaggggggcacggcgacggctccgtacccaggagcaagggcgtcttacacacccgatgggcaaaccccagggcgagggctagcgtcgctgggcgcgggaggaaaaacccccttgcggaaccaaaggcccgaccgcggggctttaggaaacgtggctctaggaaaagacaaacacttggggctcagatggctttggttgcaccattcgtatatacggttgcgtatgaatggggggcattggcgtggatggagaaatattggttccttctggccgcaggatattgcgtcaggtggggatttaattccattggcaggcgaaagaggacaaccccgttacccaaatctgccgggtgtgttccatggggcgattatggttttgtggggcccgagacgagaaggacgccctatttaggggcgccccaccacgntaccccctctatgcaggcgggggaacctagcg

SEQ ID NO: 522294 - DNA, 778 bp, Homo sapiens
cgacccacgcgtcgcgactgacgggcacgctgactggaggctggcggacaggcgacagcgacctgcggtaggaccagaggagcgagagcagcaagaaccacaccacccagtcggatgcaatgtcagtcggaagtggaaacctcagagggggtagacgagtcggaaaacataagaactctggggccctaggaaaaggagaaccaaaatgagaatggctgaccgtctcggagctcctgaaggaagggacccagaggaagtcatcacgagccggtgcagagaaacagcccagtttgatcaaggacttcttgaaaggcaagcattaacgaaggatgctgtttaaggctgggccagcacggcatcgttgtacttcacatactcaggcctcgaggaggaaatggagccgcaacaaggaccatccagcctttgcccctttgtacttccccatggagctggaccggaaggaggcgctgaccaagggacatggagtatttctgtggtgaaaactgggaggagcaggtgcagtggcccaaggctggccagatagtacgtggagcggatccactacatagggcacgaacgagcctggagtctgactggtggcccatgtcatacacccgcctacgtgggggatctctcgtgggggccaggtgctgaagaagtggccaggagcactgaaactccccagcacagggaagggacccagttctacctgtttgagaatgtggacaatgccagagttgaagcaagtctacgggcaggatgaacgcctggactgaaa

SEQ ID NO: 522295 - DNA, 108 bp, Homo sapiens
ctgctccgccccttctgccaggcctaggcaccaggaaaaagaaacaggcactgtgaagctcagtatgcctggcagagagggacggagcagcagagaggggcggagcag

SEQ ID NO: 522296 - DNA, 811 bp, Homo sapiens
  misc_feature (27)..(27): n is a, c, g, or t
  misc_feature (41)..(41): n is a, c, g, or t
  misc_feature (280)..(280): n is a, c, g, or t
  misc_feature (569)..(569): n is a, c, g, or t
  misc_feature (577)..(577): n is a, c, g, or t
  misc_feature (630)..(630): n is a, c, g, or t
  misc_feature (725)..(725): n is a, c, g, or t
ttcgtttgggactcagcgcgccgtggngggggtctacgggnattcggccattatgggccggggggttcacatttacattaaagatgtaaggggcgggaaaaaaaaaaaaaaaataaaaaaaaaaaaaaaaaaaataaactcctttaccggaagggagacgcaaataaaactatattcgtatcttccgctgggcgctgatacccaaatagcagatgggaagcgtctcttacagcctcacgcagggtttacgtggtttcagaggggggaggggggagccacngcgatataaaggagagctgggaggggcgacacaccgcctccccctggtccggaagccaaatctatccccccggacttgggttaggagaccgctcacagctgaaaaaggtagtatatctggcgctcaggacggtggtcttaacactccgcgtctctcagcgctgcaacggaggcgaggacggtggtgaactgggatatattatgcgcgagacactgatgatgtatttgtcagtttcttactactatctcatcgggcgatctccttagtgcaagaaacaaagcggggcccngacgcttntcaagcccgtagtccttatccaggataaattcccagagggggtgccgcataangtatgggaaggagggaatgagcggacaaatccgcctcgcgtgtgccagcggcgcacgatagagactcactatataatacataaggcgggctagcncgtctctccaatccgcggtacgtccgcgcagcgacactaggctttgtaggtaaccaccaacaacctcgagcccccctcgcgagccg

SEQ ID NO: 522297 - DNA, 668 bp, Homo sapiens
  misc_feature (2)..(2): n is a, c, g, or t
  misc_feature (81)..(81): n is a, c, g, or t
  misc_feature (87)..(87): n is a, c, g, or t
  misc_feature (101)..(101): n is a, c, g, or t
  misc_feature (117)..(117): n is a, c, g, or t
  misc_feature (122)..(122): n is a, c, g, or t
  misc_feature (162)..(162): n is a, c, g, or t
  misc_feature (166)..(166): n is a, c, g, or t
  misc_feature (168)..(168): n is a, c, g, or t
  misc_feature (187)..(187): n is a, c, g, or t
  misc_feature (230)..(230): n is a, c, g, or t
  misc_feature (232)..(232): n is a, c, g, or t
  misc_feature (241)..(241): n is a, c, g, or t
  misc_feature (243)..(243): n is a, c, g, or t
  misc_feature (319)..(319): n is a, c, g, or t
  misc_feature (324)..(324): n is a, c, g, or t
  misc_feature (330)..(330): n is a, c, g, or t
  misc_feature (339)..(339): n is a, c, g, or t
  misc_feature (352)..(352): n is a, c, g, or t
  misc_feature (361)..(361): n is a, c, g, or t
  misc_feature (370)..(370): n is a, c, g, or t
  misc_feature (374)..(374): n is a, c, g, or t
  misc_feature (396)..(396): n is a, c, g, or t
  misc_feature (421)..(421): n is a, c, g, or t
  misc_feature (453)..(453): n is a, c, g, or t
  misc_feature (474)..(475): n is a, c, g, or t
  misc_feature (477)..(477): n is a, c, g, or t
  misc_feature (483)..(483): n is a, c, g, or t
  misc_feature (485)..(485): n is a, c, g, or t
  misc_feature (517)..(517): n is a, c, g, or t
  misc_feature (521)..(521): n is a, c, g, or t
  misc_feature (533)..(533): n is a, c, g, or t
  misc_feature (540)..(540): n is a, c, g, or t
  misc_feature (567)..(568): n is a, c, g, or t
  misc_feature (580)..(580): n is a, c, g, or t
  misc_feature (584)..(584): n is a, c, g, or t
  misc_feature (590)..(590): n is a, c, g, or t
  misc_feature (597)..(597): n is a, c, g, or t
  misc_feature (664)..(664): n is a, c, g, or t
gnccataaacacgtttagggaaaaatcaatttaaagacagaggcattaacatgtcagaacttactagcaatttcacgcacngctcantctacagcagattntgaagaaaataaagtnaaatngctcatacgatagttaccgtctggggctacggttctcctngtgncngcccagacgaccgcggcgngtgtgcggcggcggggcggggaccccggagcgggttttacctncnaggacaggntnctgatatccgtgttgagggtggtcagcggggtcctggccgcctggttctgcccgggtctctggtgatgcaggctgncaatngtgggntgcgagtanggggcgttctgcnggtccaagntgttgtcgntgangtgctgcgggttttccatcttnctccccttctctcgttctggggggngctgggcacgcagctccttggagcttggcgtngcgagttgttcatgttgtatnncnggctcntngggtcgtccacaggggttttgctccgggggangccngggctgtggtcngacaggntgtttttcctgaacggccctcacgggnntaaaggctttcntggngagcgngaggganggcgagagcgggcacgggagctgtgctgccctgaagctcgggccgccgctgccgcctgctgatctanctgc

SEQ ID NO: 522298 - DNA, 695 bp, Homo sapiens
  misc_feature (38)..(38): n is a, c, g, or t
  misc_feature (138)..(138): n is a, c, g, or t
  misc_feature (168)..(168): n is a, c, g, or t
cccaaaaatctccatgtcaacagaaaagtacatttctnaagccacattcttcaaatgttgttatctctatcccagataagggagttataaaattcagtatcaatagattccaaatccttaatagtaagttttttactnaacatacgcttgtagaatggtaaagagaanccagtatcgataactttccatgaaatagtgccatggcaataaacgaccaatgaaacagaagtatgaaagatggtctggattaatggttgatgctggatttatctgcagacaatagttgttcttgcccgcatactcaaataagcaatacattgggttcaaaacttcatgtgaaagcaagaaaaaccattctccatgactgatgttcctgaagaaaaatggaacaaatggaacagaaaaaatattcaaagacataatagaagaaaacttccctgacattaaggaagatcttaatatattcctcgctaggccaccataatcaagtccttcttctcctctaaatattacatataagcgcctcctcaagtcatagggttttaatgccataatctgttggaaggaatcttcaaacaatgtctgccgggacacattgatctttacatgactaggtagtgcattgactggcacaaataacggaagtgagcaagcttccacctaaaccgcgttcataagcaatttgtggaccacct

SEQ ID NO: 522299 - DNA, 182 bp, Homo sapiens
atgtgggaggacgagatgaccttagagcatggtgacgttggcaccagagatgaccatcatgagattacagacgttgaagacttggtacacacctacccacaccgtccatgcaactgctgtgtgccaatgatgtgcggagagcagtgaggtgaggcagattacccagctggatccgctgtgta

SEQ ID NO: 522300 - DNA, 1237 bp, Homo sapiens
ggtcgttctgtacagctcagctctcaagacaagttctattcatgaatagttggtagcattggggctctctactgtgacttactagagcttgatgccataataggattgcaatcttccattttaaataggggtgctgcgctctttagcgactgacttgtagcatatccaacctgacacgtggttctggacagtctgtgttacctggcatgcataacactaatttatgagtaagctactcggctgacccaagtgtacagactattcaatattgttcaggctactgtggaccgtgaacgtctacacccgggttactacctataccactttcttgactgtgttggtgcttgatttacctagcgatgttctcccgtggtacacttttcccgtgtgtagcaactttggcggaatgagagagcgataactttctacggcacagaaggttccaacgaggaagtccagggaaaaagccgagtgaccgggagtcaagttctctgttctcgacacgggtcgtgaaagacgcgcgacgaccgacagcagaactcaaaagccagacagcacacgttcaagcgacacacaagtctggcgaaactagtgtgatcaagagttgaatttgagtagtacagtaggccgctattccgatgtagtgcgcgccgaaagaaattgtgtagcaccaccttgttcgccccagaacgtttttgtgccttccggtgaaaccaagacactccgttcaaatgggttacacgacgggtgccgcaccgacattctaacggggtttacttgatacctaaggcgtgcgcaggtgggttgtttatactatcaagcaccttgatagtataaccgcatttgttggggcccgccgtgggagatggatttatcacattgggggcgattcacccatgtgcgggtcggtgggggaaccgaaattgggtttcccttgacacaggcacaccatgtggggcaattggtttgggtttaacttaaaattttgagtagcatattgtacgcagttgcgggggcttgggatttccttttaaaaacgaagagacgactttgccccagattggggcaaagaaggatgtgtgccaaattgcccgaagcgcgtttattatatgatagccaaaggagcgaaagaggttagaatttcgacagggaaatttccacagagatggcgatttcgcgaaaagaggtatagacggggagtaacagcgtttgaaacgcagatttgcgcaaagagaaa

SEQ ID NO: 522301 - DNA, 176 bp, Homo sapiens
aacgggtgagccggtgggacaggattccaggccaccacaggctcttgggcaggctatgtcctgaggaggcctgggctgcgctagagaagccggccgtattgaggtggctgcttctgtgcataactaccgagctcttgaactgctggtgggaaccaccatgcaaaccaaccgaatca

SEQ ID NO: 522302 - DNA, 255 bp, Homo sapiens
agccggtacctgagacacgtggtgaaacccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcacgcagaacgcgcctaat

SEQ ID NO: 522303 - DNA, 416 bp, Homo sapiens
  misc_feature (31)..(31): n is a, c, g, or t
  misc_feature (62)..(63): n is a, c, g, or t
  misc_feature (67)..(67): n is a, c, g, or t
  misc_feature (207)..(207): n is a, c, g, or t
  misc_feature (360)..(360): n is a, c, g, or t
  misc_feature (391)..(391): n is a, c, g, or t
attgaactcctgaccccaaatgatccacctncctcccaaagtgctgggattataggcgtacnnctantgcccagcctcctggctaattttttttgttgttttatttttgttagagataaggtcttactttattgcccaggctggtcttgaacgcttgggttcaagtgatcctcgtgccttgtcctcccaaagagctgggattacagncgtgagccactgtgccgggcctccttctggttttttcaatcttattttgtttttttcctctagaagcatttggggatcttctggttatccttgttggttttctgaaatggtacgatatgccttaatgtggggtcattttaaattgcattatgnattaatctttgtcagtctaggaaatgtgtanaatttgggttttggaaaacttgtaa

SEQ ID NO: 522304 - DNA, 1091 bp, Homo sapiens
  misc_feature (1)..(1): n is a, c, g, or t
nggtgtccattgtgtccagtcagggtggggggtcgatgcctgttgagggcgtctgggttcaaggttgtccacgtcagaggggtgccgcgttgctctcagccacgacgggtgtgttgtggtggtcccttgcctggtggttgtactgaccgactgttgtgctcgtgtgaggccccccgacgcacctattgggtggttgatggtcatttccctctcttgtccgcgttctctcggctctttgtgtctcttgtggcgggtgcaccctctttcgcaatcatgccgcgtgtgggtgtcctcgctcacgagccactttgtcctgcactactttctctcttttgggcggcccccgcgtcctgttgttttgtttgtgttgtcccccctcgggagctttttttttcacttggtgttgggcgggtgaagcccccggtgttgtcacaaagctctttggtgtgtcataagtggggggcccactccacggagcaccaccacgctgttgtggtgtgtactctctctcgcgtgaagaatggtcttgtgtttccagcggcatcgctacacagactcttggtgtccccctcctcgagactccctcgcgtctctcacctctttcgggcgccacgtgtgtctccccgcagtgttctctggtcaccccatcggtgttctctccgcgcgcgagatccccgcagcgtgagtgtgtctctcgctcgagagatgttctctttatactgcgggctgcgtttaactcgttggtgaccactggctctccacgaggcccggtcgcaccgcggggtgcgccccgcaccctcatctccgggcgccgcctcgattgtgcgcccttctctctccccccctatcctcccggctctccgccgcccttgtgtgggagtccggtctttggtcccgacagctgtctgcccccggcaactttctcccatagtccccgggccttctctcctcctgcggtgcgacagccacactttgtgggagaacctcggccccccttgggtatcttttcttctctgtggggtccgttttattttttatccatggacttattgcgtggtccgtgtccacccccaaaaaagggttttttctta

SEQ ID NO: 522305 - DNA, 1715 bp, Homo sapiens
tttgttggtcctttgtcgctgctggtttagctggtgtttcgtttgtgctgttttgtcgtgggctgtggttggtctggtttgttgcgttggtggtgtgttgtgttgtggttgtcgtgtggttttgttttttgtgtgctgtgttcgtgtgtcttgtggttgtttctgttgtggcttgtggtgttggtcttatctttgtcgggttggtgtctgtgttgtttgtttgtcgttctctctggtggctggtcttgcctatgttctgcgttgtttggtgtgtcggtttgttgtttctgtccggtgtgccctgaggtggcgctgcgtgttcctggtcgggtgtcccttctctggtgtgtgtgcgctactcttcgttttggttgtgccatctgtctttgtcttgttttcttcgtttggcccgagtgggtcctccctgcgggtcttggttgccttcagtgtctgtttgctgtttgtttctctctgtcttggttgcgtgacgttttatcttgttgtctcttgtgttctcccctcggagttgtgtgggtggtgcgtctctctgttgtctttgttgtgcgcctcgtggtgtttgtgtggttgttcacacaggggtgggtgtgtgccaccgtggtggggggtttgtctgtttgttgttttgttgcttttgcgtttttttgtggttttcgctggtgtgggtgtgctttggggtgtgtgttctctcatgtgttggtcatgtggttgtgttcctctctctctatggttcgcgtctttctctttgggggcttgtgttgttgctcccctcagtgtgggtggttgtgcttggtggtgctcaccatccttgtgttgctcttttctatctccgtttgtgggggtgccctctgttgggttctcgttgctcttgctcctgggtttgacccgctgttcgtgccgctgcgggtgaatcatccacacatctctccggcttgctctcttgtcgctctctctttcgtctctgctcgcctcactcgctggtggttgtgacgctcttttggctatgtgtcgctggttgttttagacccgcgtgtgtgtagagtgttttacgcagtttggcttgctcctgtggcttgtgtgggtgttcctcttgtctctctcccggtgtgtgatgtgtgcggtggcgttgtgtgttgtctctttgtggtggcgtccccatagtgagtgtctctctgcgggataatcccctgtgtgagtgtgtgtatatcttcgggggcgtccccccactcgagacccctctttttctgttgtccccggaatcacacctggcgtgttgtcgccgcccactctcccacgcggtgtccaccacccccgacacccgccacgcagaggtgggccccgtctgtgtaccacactggagagggactccggcgccctcggtgtgtcttctcgtgtgttcctcgtataatagtaggactcggtgcgagcccccgcgccgcgtgaataggaatgtgttataggtggtgtttggagaaacatatgtcgctggtggtgtggagacaataaactatatctacccacaaaccctgctatgtgtgtggtgagcactgactcgttacgtttgtgaactgcttgataccatgtatttttagtggctattccatgctctccagaacttgttctgttcccgagacacatgaatacatatgcccctgtcataagccccttgtccctgggatttaatattactactggta

SEQ ID NO: 522306 - DNA, 312 bp, Homo sapiens
  misc_feature (40)..(40): n is a, c, g, or t
  misc_feature (80)..(80): n is a, c, g, or t
  misc_feature (121)..(123): n is a, c, g, or t
  misc_feature (127)..(128): n is a, c, g, or t
  misc_feature (140)..(142): n is a, c, g, or t
  misc_feature (150)..(150): n is a, c, g, or t
  misc_feature (153)..(153): n is a, c, g, or t
  misc_feature (197)..(197): n is a, c, g, or t
  misc_feature (211)..(211): n is a, c, g, or t
  misc_feature (213)..(214): n is a, c, g, or t
  misc_feature (216)..(216): n is a, c, g, or t
  misc_feature (276)..(276): n is a, c, g, or t
  misc_feature (279)..(280): n is a, c, g, or t
tgccactgtccaaagtctgtcacagtcctccatatggcanagttgaagaaaattggcaatcttttttggggtaccaaggntctcagtttgtacggtctttataaatgctgaacaagttgtnnntttnntgcccccttttnnncacttggnaanaaaaaaaaacaacaaaaaaaattaacatcaaatgaaaatgttanaactttttatatantnntntcaactttaaaaaaaaaatatcatataattagtttaataatatatatagaataaaaaaantanngagagaaaataatctaaaaatagaaaaacacc

SEQ ID NO: 522307 - DNA, 853 bp, Homo sapiens
  misc_feature (718)..(718): n is a, c, g, or t
  misc_feature (760)..(760): n is a, c, g, or t
  misc_feature (808)..(809): n is a, c, g, or t
  misc_feature (814)..(815): n is a, c, g, or t
  misc_feature (817)..(819): n is a, c, g, or t
tcttgaggggggggcttgggattttcatctagcctggcctaggtttcctttatggtatgggttttggcccttcatccgtgcaccgccaggtttgggggtgacataaaggggccccccccccccatctgcgccgtctggacacatttttgtggtttgttggttttgttacaatctgacattatgccgaactattgttgtaccgattgtttacaaagttatttatgccaggtttggaagccataccccggtttttattgttttgagattgccccttgttccggatttccctaaggtaggagagaattttaacggggacttcatcgaccaccaccccatctaccaatggccccgatctaaccaagtaggctatagaccttcccacttaaagcgctgtttaactggaagttgagagtctgctttgtacctccagagttaccatgagcatgttgtggataaatgtaaattatagtccaagtaagatactctgcccagtttcctctgtagaggattcacttttctccaattttaaaatttcgacttcagcccttgcaactcacggaggttctgctcccgcactgagcttcttgtacttacatagatctaatttataccgtgagtccagacgtaggaataaatgctcccaaccttagcctcttcttttgcttttgcttctctccttctgagagtgtgagttgagttctcatttaggtttgtaacntggctatttcctagttgtaaagttctgcatttataagtgccnttgttgtaaggtggtgtttcctagaccttccctgatgcgattttaccnntgttnnannngtataaaccattgtacaaaagcgacccctcttga

SEQ ID NO: 522308 - DNA, 1217 bp, Homo sapiens
gtacatgaaacactagaggactgcatgtacattctgtggggggtgcaacaccttggttctggttcaaaccagctgtcacttttgcatcagctgtgccaggacagggttcaggacccaactacaacattcacatgttggttgtccaacatgtcagctgtgtttccctcaactttcatgtattttccctgaagcacaacacacacaaatcaacatcttttcatttccacacatcacacaacacacacacaacaaacaaacaacacaaacacaaacaaaaaaacaaacaacaacacacacaacaaaaaaaaaaacaaaacaaacaacacaaaaaaaaaaaaagcaaaaaccaccgccgcagaaagcaacaaacaaaagaacgaacagcaagaaacacagaacacaaaaaagaaacacaaagaagaggaagcacaaaaaaaaaagagaagaacacaagagagaacagaagagaagacagacgccacaaccaacagcagacaaaaaacacaaagaagaaagaacagaaggagaacacacaaacgcgacccacagacaaagaggaaaaggagagagacgagaaagacaagcgaagggaacgcagacaaccgcgaagcaagaaaacgaagcggggaaagagagaacgagacgcagaaacaaaaccaacaaacaaacagaaagaagagaagacaacaagaagagaaaaacaacaggcaaaaacaagcgcagacgacaagaacgagatcgagcgagagaacagcgaagcaacaaagaaggagcgacggcacgagagagaccaggagcagaacacaagaacagacgacgacgaagagcgggcgagagggcaagggagagcgagagagagagaaggaggacaagaggagcaagcagtgacgcagccggcgacacacgaaggaaccagacccaagaccgaacaggccgaaagacaaagcacgacggacgacacgccagaacgagagaaagcaggggacgaacagcgacaaagcgcccaacacgggagagagccgggacgaagcgaagacggacgggggaaggacgggcaaggagaggcaggaagaggaggggggacgaagcggcgcgaggacaacgagagacccaggccccgggggagtcggcagggagaggaggggcagggcggagcaaggaacgggagcgagggagaccgggcgggagagcgacccacgaagcgggggcacaggagg

SEQ ID NO: 522309 - DNA, 238 bp, Homo sapiens
ttttttttaaaggataattgggccgggggtggctcccccccattatccccgcccttttggaggcttaggccggggggtccccttagctcggggggtttagggtgccgtgatttattattgcccccccgccctccccccgcccgatggcagaggggggccccctctcttttcatatgtatatttttctctctttatggggccaggtgggagaaaaaaaaatttttttttttgttgttga

SEQ ID NO: 522310 - DNA, 522 bp, Homo sapiens
  misc_feature (437)..(437): n is a, c, g, or t
aagtctcccacccatcatggtgaaccatgtttaggcagatgaggaccatgatggtgatgtcaaaagcttgtctggtcacgatgtcaaagacaaaccctggaacttgttctgagaaaaacaagagatagtggcatcagggcctttgggccaggacaaaaccaggcatctgtgttatctgtagatgagttttgtctccatcacactccacatcttaacagaagcgaaatactatccttacctcttccaaaatttcacttttagttgactctacctcattgccccagttcaagtccttaatacctctcctggccctttgatgccaccaggcccttcttttgtcctggtctgtgcccttgcctctattcacaatgccctcctatctcctctcttggctgtctaaattccaacaggcttgactaataggtcagattccagcncccctactggccccttcagagaaccaaggctttgggtgtctgggctctggggagtgggctctgccactgtgagtgcctgcaggca

SEQ ID NO: 522311 - DNA, 228 bp, Homo sapiens
tggggagcacacagtggcaacttcattgttgtcttattttcagaatattcacagcttccccaacctttcgcaacaactatcctgataaggtcaacagccatcaacactgaggcaagactcttcagcaaaaatattgcaacttgctgaagactcagatgatgatgatgatattttagcaatacagttttttttttcttttttctttttgtagagatgggtcatcctatg

SEQ ID NO: 522312 - DNA, 445 bp, Homo sapiens
  misc_feature (77)..(77): n is a, c, g, or t
  misc_feature (380)..(380): n is a, c, g, or t
  misc_feature (388)..(388): n is a, c, g, or t
aatggcccttcaaaacaacccccaaactttccttgcaagagcatgacttttctggccaagaagcaaagcccatgaanccctgcccgggaccctggcactattcctgagtgttgggggcataatggggaaaaagtggcagcccacattaagattcatgaccaaggccgggtgtggtggctcacacctgcaatcctagcactttgagagactgaggcaggcagatcacttgaggccaggacaacatggcaaacttggtctctacaaaaaatgcaaaaattagccgggcgagatggcatgtgcctgtaatctcagctactcaggaggctgaagcaaggagattgcttgagcccagggaagtcaaggctacagtgagccataantctgccantgcactgcagcctgggtgagagagtgacagtgacagaccctgtctggggaaaaaaaa

SEQ ID NO: 522313 - DNA, 149 bp, Homo sapiens
tacagacctgtgtggaagagacagagctgcagcagcggaacagcagcatcaggcctggctccaatagcatcgcggagaaagacaacaagcctggttcctattggcaagccagcctcagagcactatgatgacgaggcagaagcaggaag

SEQ ID NO: 522314 - DNA, 139 bp, Homo sapiens
  misc_feature (21)..(21): n is a, c, g, or t
  misc_feature (24)..(24): n is a, c, g, or t
  misc_feature (31)..(31): n is a, c, g, or t
  misc_feature (46)..(46): n is a, c, g, or t
tccccgccgacagccatgctntgnaaatgcnctaccctgtctaggnaggctgtcatttctgcacctgtgtaaaagtctaagtcctcctataaagtgactacagactgcttatctggctgccctgtcgggctagtcgggg

SEQ ID NO: 522315 - DNA, 882 bp, Homo sapiens
ggtcctatcacaatctctactagtgaagaccccaaccaggccaaactagaaattctaatggacaagccaaagcatgaatgtggtatttgatagaatgtcatatccagaccaactgggtgaatgttaaacttagaggaatcatgtgtgggttattatcggtacccagtacagcatcgtgccatgctggaaattttattgagcatggcattcttgtgattcgtttctctgcgccccctggtggatcgagttggattacagaatgacctcttctccttggctcgagctggaagtcattagcactgtatgaggttctaacatagtctatggtaggcattggtgtgaatgagcccaagttatactgtagtggagcgagctgagctgtagcctggggattctctcaactctcttgtccctcacagacttctatgaggaaatccaggagtttggtgagagatgtcttttcacctataggggagagactggggctgggacccctaatatcctggtacgaaggtcatctcgatcgcactcctgaggggcttgagttctgggaatacactaggaagaagcgagtgacatacaggcttaggaacgttgagaagaaggcccgtcgtcggttggaaggaccacagtgtaagggaaaacagattctctccggttgatctgaggagtcctgtctactctgacttgtttcgaagcatggtgatggcagtactttagactcttatgttgaaatacgtttcatagactcaatgcagatttgcgggaagaggaaaaaccgacttcgaaaagagtccttggcgctactcttttgtctgacctgattcaatgagtcctcacgtttgcactttcagaagacgtgcgtccaccggacactgtatg

SEQ ID NO: 522316 - DNA, 1770 bp, Homo sapiens
gcatcgacgcgggctgtgccaagtcactggaaagggaaagggtgggggttatgtgggaaggttggggtgtgacccaggcaaaggatctcagacgagtcagacagatgccacttgggcacttggggtacagccaggtgtcagcgataacagtttatcatgctcattaatctggggatttcaaaagacagcaaagtgagacaagtcacaccctatcctcacgccccaagttgcagtgtctccatcatgttacaagagataagttaccgatctgaaatatattccttttacttttcttgttgttcttgcgctagttgttgggattggttttactagcgaacagtactcgtgatttcggggagagataatacatgtagacgaatggagacgggtgtattgtacgtggagattgtccaataggagccacattgcgtgaccaagtgcacatcacaaatgcgtgatcaaagacaaggaacgtagagatagcgacaaccgcacacagctgatgagccaaggaaacgcaatccgcagcattagggagagcacagatctaacacaccgggagacaggcgcatcccgagagcgccagaagacgattgaggacaccatcacagcagaaaccagacttacacaagaccacagcccaccacacacaagaagagcagcgaagaaacaaggtgcatatacccaacacaaagacggaagaccacaaaggacaacggtgcaaccgaaggacgagcggcagcacaactggcacaatactacatacccacgcgcagcgagaccagatacattcaacagaagagacagcaataggtgggatcacaaacgacacagaaccaaatgaacacgaaaggcaaacacagtacaagggcgcacaaacaaaaacaccaaagggagaaagacaacacatctggcataacaatggcactcatgaccgaatgaaggtcaggtagcactcagacacacagcacatgacacttacaacacaccatagagaatgaagcacgctaacaagccaacggtgagcaacagacaagtacaacggagagaatcacaacatgaccaatgtccaatgactatagacaatgacaactaaaggaggaaagaagagaacgcacaggcaaacatgtgaaagcaacaggacacagcacacatagaacataatatcaacaccacagcacatacacaatcaatcaaagtgacaaaccgacgacaaatacgaaagacgaaagagatcgacaacacgcaggaaaggagaagacaatgaagcacatagacaaagaaaagaccacgtaacacatggaacacatgacaggaacagaccaaagagacatgaacatagagaaagacaacaaagcaaggacacgccaagcacaccgagagaagacaaggacaaagacaaacagccaccagacgcaggagcaccagacacgacaaccgctcagtccgcgacgtctaacagtatcagcagacaacacacagacaacccacaaggcgacaacgcaggtggaacccaaagcagacaagaagacgatgacaccaaatcacggacatcaacgacaagaacaagaacgacggtgccgaacagataatgagaagacacacgcagcgaacgacagacataggatgaacaccagccatgcagcaacagtagccacaggatcgaatgatgacgcacacacaggcatcggcgcaatacagaagcagagcgaatgacataccgataacacactacatatcgacgtcatgcacgaacacgaccctgagaaa

SEQ ID NO: 522317 - DNA, 166 bp, Homo sapiens
gttttaaaaaagggaattccaaaaatgttgggactgaaagccctgttgaaaatggggaacggccttttttttccctttggcttttaacaatatcaggccacttcccccttaaagaaagttggcccaaggtttttcccaataaaaaaaaaccccctttttcccggga

SEQ ID NO: 522318 - DNA, 287 bp, Homo sapiens
  misc_feature (250)..(250): n is a, c, g, or t
  misc_feature (270)..(270): n is a, c, g, or t
  misc_feature (284)..(284): n is a, c, g, or t
gagctcggtaccggtcttcgggcggccttcgtgtggctctttggggggcgcgtgtgatagggtgggctaaaaaccatgcactctggaatttgttgtattttctcccaaagagcctgcacaaatgagccacaccaatgagccacccaaggagcccctgtgtgtggctgcgtgggtggcgacctcgtgagcagaacccatagctccgatgcagtacattgctaatgacttcaccatgtcaatagcgaactanctatactcaatttgatccancataacttgaccanacg

SEQ ID NO: 522319 - DNA, 700 bp, Homo sapiens
agtagtctcgctccatctctaatagactaaacctagatgcctctatgacggactgttgctatccaagcgtttggtgttaccttctcctgggaggtcctgctgcaactcaagttccacaggatggtcatactttcaaacaacaagtttacatcattgtaattattactggtatttacaatttgcaagagttttgggttagttttttttggcttgttgtttgtacaaaaagagtctaagcattttgggccaaacagatatttttttagtgaaaagaagagatacataggatgtgtgaattcccagttttttttaattattttaatcccaaacatcttcctgaaaataacattcccttaaacatgctgtggaataaacgggttggtgatgaaaaaaaaaaaaaaaaaaaaaaaaaaaaaaaaaaaacacaacaaccaacaaacacaaaacaaaacaaaaagggggggccgggcgccgctataaaagataccccccggagggggcgcgcaccacgaataaagcccgccaccccccatgttttattaggaacacaagagggcgccccctatggggagggacgcataatatacacacgcgagcgcgggcccgcgtgtaacaaccaggctcgggatgggaaaacacccccgcgggacgacttggaagaagaccgcacttggggggggcacaaattgggacaccagca

SEQ ID NO: 522320 - DNA, 411 bp, Homo sapiens
ccggacccaagagcagagggacgagacaacatacaggattttagacaatatccaaaagatccaagattttgggtaacatccaaaatacacaggaactcaaacatctcaatagtatgcaatcaaataatccaattaaaacggacgcatgggcaaggggcctgaagagacacttctaaaaagaagacatagaagtggccgacaggtatatgaaaaaaatgctcaacatcactaatcagggaaatgcaaatcaaaaccacaatgaaataccacttcacacctgtaaaaatggctattaccaaaaagacaaaagataacaagtgttgatgatgatggggagaaaaaggaacactggtacactgttggtgggaatggagattagtacatccattatgggctcattgggttccgatg

SEQ ID NO: 522321 - DNA, 602 bp, Homo sapiens
acccacactttttaacatttaatcttttactttttttatttttttactataaattttttaaattattttaatcgataacaaataaccttcccacctttctaaaaaagaaacccccaaaaaaaaaacaaaaaactaaaaacaaccccccccccttaaaaacagaatttttttctcccacaaaaaaaaaaaaaaaaaataataccccccacaaaaacacacaaatcccacaacaacaaaaaaaaagcccccttccaaaaaaaaaaaaaaaaaccccctcaaaacaatccaatagtcaaaaaaaaaaaaacaaatttatcccacaaaaaaaaccttacccccaaaaaaaacacaaaaaactattattttttcccccctctattaaacaaaaacaccctcaaatttcaaacaaaaaaaaaaacgtaaaacaccccccccgagaatctcaacaaaaaaaacacccccaatatcttcgttttacacccccacaccccaacaaaaaaacaacaccacccccaaatacttttatacacaaaccacaaaaattactgcacaaaaacaaacaaataatttcctctacaaaaaccccacccaacccacacaac

SEQ ID NO: 522322 - DNA, 427 bp, Homo sapiens
tccttgcaaagtaaatctgctggtaccatgtggcattaatccttttccctagagtgactcttatcttctgccaaaggttagttttaggatttagacaaaatttgcattctccacactgtggaatgtaaagtggaatgacagtgtcacccgctttcagcttagtaactccctcaccaacactttccacaattccagcaccttcatgtcccaagatcactggaaaacaaccctcaggatcagctccactcagggtataggcatcgtgtgtgcgcaaaccgcagtgacaatgctcttgattcgatcttcatgacgcttttgggggtgccacctctatctcctatagagagagaggctttacagcctcaaaagcatctacaagctgtgcacttgataacctcgttcgccatgttcgcgtattcgggtcgcc

SEQ ID NO: 522323 - DNA, 255 bp, Homo sapiens
cgtcgacatggtaggaaaatgtctctgatctgctgttgaatctactacacatggtagtaaaatgtgtctctggtctgctattgaatctatctctgctactgctctctgtctctgctcctgctctgcctctctgctcctgctctccgtctctactgctctctgtctcgactgctctctgtctctgctcctgctctctgtctctactgctctctgtctctactgctctctgtctctactgctctctgtctgtcgacc

SEQ ID NO: 522324 - DNA, 521 bp, Homo sapiens
gcagcggtggtctggggtgattggtggtctgggctcaggcgccgacagggaaccacaccaggcgaggatgcctgtaccaaataagccgtgaaagcccatgagcaaaccccgcgctttgctgcctttgggcagataacccttgatttcaacacaggcatataccccgacgaacagggccagcatcagccagtgcagggttattgaaagttttccaaatcgggttacgacggtgtcgctggtcataagaagcgtctcttgattgttgtgagggacggttgatccggttgccttgaaccggctgcgtaaccctgctcgtactgtcttaagagagtctgaagatcgactctcgggttaaccttctttcaccttcagacttcgttaagaaatggcttggatacttcgctcaaacccattgagggaggcgttcggcccatgcccgattttgactggaacatacccctgccgttgcatttcggccaagctgaaacgccgccgttgaccctgacaggcgtccgtagcgg

SEQ ID NO: 522325 - DNA, 897 bp, Homo sapiens
aatataataccgtgatctctcacgtctatacggggatctagtcgaagtcctttcatacactatgatctcccgccgtgggaagcccttttcccacccggtgaaaaaatttgcgcccctttgtgacaagaccggcctctctttcgcaccccggggactattcacattctaccagaagcggcgcccaccttctctaaacgccaacaggcctcccttggtgtcgcaaaacacaaaacgccccctttaatcttcgggaatattggcgtcaactcgaagagcctgcctaaacaaagttcgacttgcgaaggatgcccgccaccaattgggggccacccatacacacaagcctctggagcgcacccctggtcgaacacaagccatttattggtggatggcatcccgaagataaatagccaatcattctcccaacataacgaacggtgataaccaatcaactccgccgcctgctcatccttctttttgcgcgcctctgcggcgcctcccttttgtccctgtctcccacactggacgccggcttatgcccaatccttggagaaacagttccagcgggggattgatcctgcacaccgcataccgttccccgcgacgggttcacgaatggccccggccccctcgcccctggcaagcaggcaacaagcggcgcgttgaaccccccaatatagaacagacagaaagcgaacgatgtgcccaacagcgggaccaccaggggtgctacactccccgcccaccaaggcggcatcggtggagaaaacgacccgacgcagacaggcgaggctatgtcacaggagccacgcggagacgccaccttttttcggaagctccccgccggaacccgggataaaggccccccccacccggaaaaagaactttcgacataca

SEQ ID NO: 522326 - DNA, 245 bp, Homo sapiens
cccatggcactagtcaacagacatgctgcgatcctgaggcagtatagtcctgtaagaatgttagcctcatgtatgcagcttacaaaaaaaagtatatggcctctgctcatttgtgaaaggacgctagagccataattcgtgtaattcctttgggaacctcattctggctgttttttgttttcctggggcccctacatcactcggtcagacgaagtgctccaaacaaactgtacggctcccttggc

SEQ ID NO: 522327 - DNA, 826 bp, Homo sapiens
cagagatggatttggttgtggacgtggtccagccacctcagtaaaattggagaggattattatgcaatgaataaacttacagtcaaaaaaaaaaaaaaaaagaaagctgcaaaaaagtgcagtgaggtgcctcagcatgagaaaaagacagggtctcgctctggccatccaggagagagtgcagcggttgtgatcatagctcactggtaactggtaacttctgggactcaagcaatcctcccacctcagccttccgagtagctgggaactacagtggcctggttctggatgcccagtctgggagtgcagtgggtgtgatctgggctcactggaacctccacccatggggatccagcgattcttccacctcagcctcctgagtagctgggattacaggctggagtgaagtggcacgatctcggctcaactgaaacctctgtctcccgggttcaagcaattctcctgcctcagcctcccagacagggtctcacttggttgcccaggctgagtgcaatggccaatcatggctcatggcctcacctccaggtcaagccatcctcttatctcaagctcctgatgtagttgagacaacggctgtgccaccagtgtctgcgtatatttcacctaccacttttgtgacgacgggtctccatttgttgcccaggttgatctcaaggcgggataagactcatggagggtttaacttgagttcactgggagatagtctggggggaaaactatctggtagggctaaaattggtgaggctcgaatctgggaacagtcttttacgacggcaaaaggtctgtaacatggatccggagaaat

SEQ ID NO: 522328 - DNA, 309 bp, Homo sapiens
  misc_feature (29)..(29): n is a, c, g, or t
  misc_feature (37)..(37): n is a, c, g, or t
  misc_feature (216)..(216): n is a, c, g, or t
  misc_feature (241)..(241): n is a, c, g, or t
  misc_feature (289)..(289): n is a, c, g, or t
tttaaattttttttttgagacagagtctnactctgtnacccaggctaaagtgcagtggcccaatctgggctcactacaacctctgcctactgggttcaagccattctcatgtctcagccttctgagtagctggaattataggcacacatcaccatgcctagctaatttttgtgtttttttttttgtagagaccaagttctgccacattgccctggntggtctcgaactcctggcttcaggnaatccacccgccacccaaagcgctgggattacagcatgagccaccatnccaggacgcaaagttattat

SEQ ID NO: 522329 - DNA, 331 bp, Homo sapiens
tatgacctccgcctcccaggtccaagcgactcttccgcctcagcctcccaagtagccggaaccacaggcacacgccaccacacccagctaatttttgtatttttagtagacatggagtctcaccatattggccaggctggtcttgaactcctgacctcaagtgatccactgcctgggtctccacacagtgctgggagtacaggcgtgagcccgtcatgcccggccccagctcctcacattctacggaagttgtgacatggcagttaagaggactgcactcgagggcaggattagggacttctaatgtgatgcagtgttattcctctacctg

SEQ ID NO: 522330 - DNA, 535 bp, Homo sapiens
atttacttattttttttagagatggggtcttgctatgtgaggccaggctggttgtgaacttgtgggctcaggcattcctcctgccttggcctcccagagtgttgggatgacaggtgtaagccacggcacctgactcccaaagctcctttacctgcattactcccgagctcaaagagagtcggcctgctgtgactctccctcctagagtaggcctgaactggccaccaactcaccagaccactcagagctctgcaggaaccctctgttctaggcagccacaacttaacttctgttagcctgccattccttcgacctccaacaagccccttcctcatcccagctttcatcaagtctggcatcctttcacccaccttgggcaggtagtgctccctcattttaatctcatccttttaaaaattattcatacccttccttgttagccaggagttcacagtgtatatctgtttgaaaatatgccttcatcttttctacaagggtttagcacatccctataccctcagctagactgtcaaag

SEQ ID NO: 522331 - DNA, 132 bp, Homo sapiens
gcagccttgggttgcctgaaccccagcatagccttatggaacccctgccaaggtcctaggcactggtttgaactggggcacaagtaatcaatcaatgaattaattaattaattgaatcaattaatagtgaaa

SEQ ID NO: 522332 - DNA, 538 bp, Homo sapiens
  misc_feature (39)..(39): n is a, c, g, or t
  misc_feature (43)..(43): n is a, c, g, or t
  misc_feature (78)..(78): n is a, c, g, or t
  misc_feature (381)..(381): n is a, c, g, or t
  misc_feature (494)..(496): n is a, c, g, or t
gcggccgcctactactactaaattcgcggccgcgtcganatgnaagcgtggaggtggaaagcatggaacgggcggganattaaaggaaataatcccagatggaagcgtggaggtggaaagcatggaacgggcgggaaattaaaggaaataatcccagatggaagcgtggaggtggaaagcatggaacgggcgggaaattaaaggaaataatcccagatggaagcgtggaggtggaaagcatggaacgggcgggaaattaaaggaaataatcccagatggaagcgtggaggtggaaagcatggaacgggcgggaaattaaaggaaataatcccagatggaagcgtggaggtggaaagcatggaacgggcgggaaattaaagnaaataatcccagatggaagcgtggaggtggaaagcatggaacgggcgggaaattaaaggaaataatcccagatggaagcgtggaggtggaaagcatggaacgggcgggaaatnnnaggaaataatcccagatggaagcgtggaggtggaaagcatgg

SEQ ID NO: 522333 - DNA, 442 bp, Homo sapiens
  misc_feature (132)..(132): n is a, c, g, or t
  misc_feature (135)..(135): n is a, c, g, or t
  misc_feature (142)..(142): n is a, c, g, or t
  misc_feature (152)..(152): n is a, c, g, or t
  misc_feature (165)..(165): n is a, c, g, or t
  misc_feature (173)..(173): n is a, c, g, or t
  misc_feature (224)..(224): n is a, c, g, or t
  misc_feature (227)..(227): n is a, c, g, or t
  misc_feature (286)..(286): n is a, c, g, or t
  misc_feature (303)..(303): n is a, c, g, or t
  misc_feature (346)..(346): n is a, c, g, or t
ccagttcctgcttcttgaaacatttcattgctgttttcctactggtatgattgggaggcttcctgagtcctcccagaagcagaagccactatgctttatttacagcctgcagaaccgtgagccaattaaacnccntttcatnatgatcatanagaaaataaagtnctgcgaantggagctatgaaatatcttcaatgacatttccccatcgtcttggctattancantggacttcttttaatgcaaatatctgaaggcttcttgaagtttccccctgaaaatgganttctttttcttctgcantgccaggctgcaacaaagatagctgaaaatgtaaagcaggttnagaagtgggtaacagccagaggttggagagtctggagatcttgaaagaagacaggaagatgaaggaaagtttggaccattgttggcccttatcgag

SEQ ID NO: 522334 - DNA, 604 bp, Homo sapiens
agcgtgtgctcaatgttgcccagtctggagtgcagtggtgtgatctcggctcgctacaacctccacctcccagccgcctgctttggcctcccaaagtgccgagattgcagcctctgcccagcagccaccccgtctgggaagtgaggagcatctctgcttggccgcccatcgtctgggatgtgaggagcctctctgcctggccgcccagtctgggaagtgaggagcgtctctgcccggccccccgtcgtctgagatgtggggagcgcctctgccccgccgcccgtctgggatgtgaggagcgcctctgcccggccggacccgtctgggaactgaggagtgtctctgctcgaccgcacccatctgggaggtcagagcgtctctgcccgggcgcccgtctgagaagtgagaagcccctccgaccggaagccgcccatcggggaagtgaggagcccctccgccgggagcgacaccgacgagggaagtgaggagcgtctccgcccggcaacgacccatccgggaggttggggggccgcttctggccggatgcaacccgactgagaggtgtaccaacagcccaatgaggggggccaggatgacagagggg

SEQ ID NO: 522335 - DNA, 241 bp, Homo sapiens
agatctagtgcctgtcggccaggaagccgcggcgctccctagcctgacgctgcagaaagaaggtgtgcttggcgtgaccgaggagcaggtgcaccacatcgtgaagcatgccctgtcgcgctacagtgaggaccgcatcgggctggcagactgagccctggagtcaggaggggccagcgtcatcagcacccgatgttctgagacctacgaggccaagacggacctcctcaggggtaccgag

SEQ ID NO: 522336 - DNA, 281 bp, Homo sapiens
tgcatcactgtcagttatatgcagaataagtggtcttctatgcagtataggatcctttggcaatactaacactttgggaaccataataatgtggggcccactctgtatcaacttctgaactagtttcatgaggttggtggtggcagcttctcggatggcgtatacctggtccacgaagccaggcatacataaagaattccagcttttcaacaaagaattccacatccaaggtggctggcagcagcggcatacactgacagtgatggtccgggtactcgagc

SEQ ID NO: 522337 - DNA, 330 bp, Homo sapiens
tgttaaagacctgggaataattttattgtataggacactattgatgacacatagaatgggagctgtaagtatgttgcattggaacaagccttacaaatattggattttaagaatacacacattttttacaggtggtctgttttaaaaaatttgaagttatagctacgacttaactacgtacagggaagcattttacgtatgttgagtgattaaagaagaggatgaatggttcaaagaaaagaagcccccattcttgccagctatttattgtattccttcaaaagcaactgtacatgctgccttcagatcatagttaaatatttctagtaa

SEQ ID NO: 522338 - DNA, 330 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtggtgctgggataactggctagccatatgcagaagactgaaactgaaccacttcttacaccacagacaaaaatcaactcaagatggattaaagagttagatgtaaaatccaaaactacaaaaaccctggaagacaacgtaggcaataccatcctgacgaagggggatgg

SEQ ID NO: 522339 - DNA, 974 bp, Homo sapiens
ggcgccacggagtcccggtgacctcagcaagtacaactttgagaacaagtatggcgtcccgggccctgcattgtgtactcagcacatcctgagccagactgagaacaaagtgcctgtgcaccaggataccctggaggggtcccagccttcttccgggacatgaagcagggcctgcatagtcttgtggagcatcaggtaggacagaggatctcaccaggaatgggtgtcgtggacgtggagaacgactgttccatcagcaaagttcctgaacccgaagtcctgggagctggacggtgcatcagacgcagaaggcccatggtaccagatacattctcagacgcccgttcgaacagacatcatcgagatggacaacgacgggagcgggcaaagtaccgagcattgggcgtcctggacccttggatacgaggatatccgagcgagactctacgacgagaagaagacacaagcagcgatgttaccataggcatctcacgggaaaacatcggcaggaccgagcagagttgagtcatatgtatcaaagagtacaggcgtgagatccaggaagggcattgaaagatgagagaagagaaccggctctttgccaataggatccagccttgagagacagtgaaaccggagggcccagccatatttagaagagggcaagttcaatagccccattctttcggactaaccgaacgggagtagcccggaaggtgtaaaggacagaagaaccgcacgaggaatttggccccagtgacgtacagggcgaaggcacgccacaagtaaacctacggacgagacccatgatatttacattaactaccaagaggttgtgttacccaagaggccccgccaaagccacatttagagagacctgagaagaagaagcacgcaaaagacattgtgagactggaccccagattgagacaaggcgcatttccctggcacgagacacagaaggttatacagac

SEQ ID NO: 522340 - DNA, 210 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgtgtccatcccccttcgtgctctctacctctgctactccaccagtctcttaatgttttaacaacag

SEQ ID NO: 522341 - DNA, 401 bp, Homo sapiens
  misc_feature (316)..(316): n is a, c, g, or t
gcgatgagatctcctgggcagtggcggggctttgcttcccacgctccagagctgcgtcaccagggcgcccagcttcctctaccccagctccctttcctccccgctgcctaaatctcttgctcgtgggcccttcgctgccagcctgggacctgcctgtcctgttgaaatccctggctgtagccccgtctccaggcgcccccctcccggctgcagcacctccaccttcttgggggttgcctggacttgtttcctctacggcaaggcttggtgcctgtggctcttcttcctgtgctggctgcctgcggcccgtccccanatagctgtccttcctttgggaagcctgttgccgggaaaggaaccacagagttgattgaagttgcagttgggtgagcctttccaag

SEQ ID NO: 522342 - DNA, 171 bp, Homo sapiens
  misc_feature (38)..(38): n is a, c, g, or t
tcgctaagattaggggtctcatcgtctcactgcacganatctttatctatcctgactcaatatcgatacaggtctctatttgcttcaagataagtaaatatgccgggtgttgtggctcacacctcttatccctagcaccttggatacccaaatgggttgtattgctttatg

SEQ ID NO: 522343 - DNA, 1007 bp, Homo sapiens
tcgggggaaccactgaactaggctaggtacgaggctggtttgagaggcaagctcagccagcctaaggcagaagtctgtcgaggcgatgaacgtggctagctgggctccggtatagtgcccgatgggagcatggttatcctgggtttccatgccaatgaggtttgtggtgtgtaaccctcggtcagacgagaagctgtcagcatcgtcaactgtggtggagggcaccgtgtcgtgggcattctctgatactgagagcggccgatggcctttgcgttgtcctcgaagggatggtggagtgtcagtgctgtacaggaggtctcgtgggttggcgtgcacccgggcacatcgtgattctcgcgtggagggtctgctgtggtccgtgagagtcgcttgtgttgcagcgtgtgggcacctagttgcccgtgtgggcctgaatatggagtgcccagcttcatgcgagtcctgatgactctggtgcctggcgttgaggggcccgactatgactggccattgtgatcacgtgtagctgaggaccactaactgtctgtagtcctacgtcacgtccctacgaacataggctcaagaccatgcactacacagctgtttgtaagccatagtctcctcggaacgtgctgtggctgtgtggggcacttggcaaggcccagtgtggccctcaggatcctcagtcgggctgactgcccatgtggctgtctgcgggggggcgggctgggactgcgctgctatcagacaatcagtgggtactcgccggtcccccagggaccccaagaccggctccggcgtggcattgttctgccttcccttttgtgcccagccggtagattagttttgtgggcccggggcgccattctgggaccgggctggcgtatggggcaccccagaggcctcgggggatgttccttggtctgtggtggcactggcgcaacggggttgccccctcggtggttccccgccgtgatgggcggcgagacgccttggggaatttgggc

SEQ ID NO: 522344 - DNA, 324 bp, Homo sapiens
gtaatcaactgtccaatgatcgccctctctcgcgccaaaagtaatctcacgggacccagatgggactcgaacccacaatccccagctccggaggctgatgccttatccattaggccactgggtcaccacaggatccggcttctcacaccctctccatacgcgatgccatcatcacgctcccgcccccgcacatcgcggtctcgcaccgagaggcaagtgatttggcagccgcccccagcggcggcggcgcgcgcctgcgctattctgcgtccctgtcgtccgcgtggacttcccgcgcgatgcaccatgggcccggagcggccg

SEQ ID NO: 522345 - DNA, 301 bp, Homo sapiens
cggatgaggcgctcaggttactgtgtccttgcccttagatccgagtggagttgaacatcctactccatctggtaggagcacatagtgcactatgcccagtgccatcacaggcttgatttcttcactggtccagtttacggcgatacatgatcatggcgtggctgatgtttcccaggcgggctgcctgaaagtctgtattcttgatgagcacaaggtccatgacataatagttgctgttacaccatagagagggctcctgccttcgaagcgtagatgtactcttcaccaccatgtcactcac

SEQ ID NO: 522346 - DNA, 835 bp, Homo sapiens
  misc_feature (169)..(169): n is a, c, g, or t
  misc_feature (298)..(298): n is a, c, g, or t
  misc_feature (347)..(347): n is a, c, g, or t
  misc_feature (565)..(565): n is a, c, g, or t
  misc_feature (614)..(614): n is a, c, g, or t
  misc_feature (627)..(627): n is a, c, g, or t
gtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattntctttctgagctggagaactggctttgcactttggttacacagaacattggtttccaattcagtttaactgaaatttgctgctgatatgttgagtttggtctttaaaaaatagctcatatatctcatcntttcttctgtcttagaagaacagacctaactagtgaatgtataatgaanatgcattatttagagctgcatgaagagttagctcttacttataactgtgatatgatatgcagctgatacatgtactatcatattaaaatattcacttctcttgacttagacctttgagctgataaactgcttgaaaatagctctgctacgatgcatacaaataatttttgctgataaaaatacttgatacaaaggctatctttcatggtttggatgcnaagagtgtatggtattaatattcattaataggtactgtaaaaaaaagcnggccgtcccatcnccttaatagcgttacaatactggcccgtttcacatcgattggaaaactggtacaactattcgtgagaaaaccctttcacttgggtatcaaagccctccatgccttcaaaattcgaccctaggaaggaatttgccgtattttaaaaccgaatttgtaaactttttcaacccaggtggacttataaactcatacgcatcttttgttgtcg

SEQ ID NO: 522347 - DNA, 120 bp, Homo sapiens
  misc_feature (59)..(59): n is a, c, g, or t
  misc_feature (91)..(91): n is a, c, g, or t
tgaggcctgacaggaggtgtatgggtcatgggggcagatgcctcatgaatagatccatncccttgggtatagggagttaatccttactctnagtccccacgggaactggttgttaaaaag

SEQ ID NO: 522348 - DNA, 366 bp, Homo sapiens
  misc_feature (185)..(185): n is a, c, g, or t
gagatgatggctggaatgttgactatgccagggtgtgagatagttgaaagtaagtcacattatgagggaggaactccatacagtctattcagtttctcccacttatcagaggaaatgacttaacatcttgccttgttgtgccaaagcagagtatagtgtatatatgtggttctcttctggttgtncctcttctggctcttcttctgagccactgaagcccagatctgtagagataggcaaaatgatgctctttccctctgatatttctgacaaaaagtattacaagtatatttaaaaaggttggaaaacaccatttttattgtgttggtctaatacccatcaatgaccttctggttcaataatgaa

SEQ ID NO: 522349 - DNA, 241 bp, Homo sapiens
atgtatgtgctgcgctagtgtgtgtgctggtgtgcatgtgtgtgctgtgtctttgtgtgtgtgctgtgtgctagtgtgctgtgtgtccatgttgtgcgttgctgtgcgtatgtgtgctgtgtgctcgtgtgtgtgctgtgtgtgcgtgtgtgctgtgcgtttgtgtgtgctgtgcgtttgcgtgtgtgctgtgtgtgcatgtgtgtgcgtgtgtgtgccgtgcgtttgtgtgctgtgtgtg

SEQ ID NO: 522350 - DNA, 753 bp, Homo sapiens
ctgagtacttggaggacacgaagaataaaggagatgtgaagaaacattctcagatttattaggactatcccattacgtctttttgtggagaaggaacgtgataaagaagtaagcgatgatgacggctgacagaccaacggacagaccaacagacacgaacgacaaacacgacaaccacgaacgacgaaacgacgtcggaacgacaatacctgaaacttgacagatgttggttctgactgaggacacgaagaaacagaaggatggtgacaagaacgacacgcaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgacagcatatttcagttgaaggacagttggaattcagagcccttctattagtcccacgacgtgctccttctgatctgtttgaaaacagaaagaaaaagaacaatatcaaattgtatgtacgcagagtttacatcatggataactgtgaggagctaatccctgaatatctgaacttcattagaggggtggtagactcggaggatctccctctaaacatatcccgtgagatgtagcaacaaagcacaatctagaaagttatcaggaagaatttggtcaaaaaaatgcttagaactcattactgaactggcggaagatcaagagac

SEQ ID NO: 522351 - DNA, 345 bp, Homo sapiens
ttaggctaacaggagaaatgcttaaccctggaggcgagttgcagtgagcccagattgcgccactgcactccagcctgggtgacagacgtgggactccactctcacaaaagaaaaaaaaagaacgcagcagcagcaaactctgcccagccttttgagatctcagaaaggccccaggtttttttctttgggttccaggttctccttttccgagcttttgggagcctttttctacttattcaccgggcacccggtctccgggttttttcttcccaggtcttctttgcctatcggaagccggcccgttttctttgaacgggttgcctcgttcgttgtgttaccacgaat

SEQ ID NO: 522352 - DNA, 664 bp, Homo sapiens
  misc_feature (475)..(475): n is a, c, g, or t
ggaccgaccttcagcagggctgtggctaaccatgttctctcgcgcgggtgtcgctgggctgtctggcctggaccttgcagccgcaatgggattcacagttcgaaatatggcacactttgaacagatatcaccccagggaagacttaaaatggtccaattcaaaaaaacaattccaggaaaaattaacccaaaggtctatgacaacctgggtaagcgtgccagccaaaaattattgcccccgaggttggcagcagcagcacgcctggaaagaccaaggctacggaaattacttctggggacattgcgcgcgacctcctattaaggcactcctgtggtacattgcaacacaaacacggctgtggaataattacaaacggggtggtgcccttgggaaaggacacccaaaaggaacgaagggaagaaagccaaggcctgtttcccccttgttgggggatgggtttggttcctcagtccnaggacactttcgaggaacgggcaacctatggattgatatcgcggagcggcataatcattcgaccagggtgtttcacgaattgccacaatgtttgtgggcatttaaaaacacgccaagggaattgttcggaccaagcactacagggcaatgcaaccggggccggctctctcggcgcatattaaaaccaca

SEQ ID NO: 522353 - DNA, 823 bp, Homo sapiens
  misc_feature (2)..(2): n is a, c, g, or t
  misc_feature (66)..(66): n is a, c, g, or t
  misc_feature (116)..(117): n is a, c, g, or t
  misc_feature (120)..(120): n is a, c, g, or t
  misc_feature (123)..(123): n is a, c, g, or t
  misc_feature (136)..(137): n is a, c, g, or t
  misc_feature (142)..(142): n is a, c, g, or t
  misc_feature (151)..(151): n is a, c, g, or t
  misc_feature (155)..(155): n is a, c, g, or t
  misc_feature (176)..(176): n is a, c, g, or t
  misc_feature (182)..(182): n is a, c, g, or t
  misc_feature (201)..(201): n is a, c, g, or t
  misc_feature (313)..(313): n is a, c, g, or t
  misc_feature (351)..(351): n is a, c, g, or t
  misc_feature (386)..(386): n is a, c, g, or t
  misc_feature (390)..(390): n is a, c, g, or t
  misc_feature (404)..(404): n is a, c, g, or t
  misc_feature (408)..(408): n is a, c, g, or t
  misc_feature (424)..(424): n is a, c, g, or t
  misc_feature (588)..(588): n is a, c, g, or t
  misc_feature (657)..(657): n is a, c, g, or t
  misc_feature (659)..(659): n is a, c, g, or t
  misc_feature (664)..(664): n is a, c, g, or t
  misc_feature (677)..(678): n is a, c, g, or t
  misc_feature (682)..(682): n is a, c, g, or t
  misc_feature (686)..(686): n is a, c, g, or t
  misc_feature (688)..(689): n is a, c, g, or t
  misc_feature (693)..(693): n is a, c, g, or t
  misc_feature (706)..(706): n is a, c, g, or t
  misc_feature (710)..(711): n is a, c, g, or t
  misc_feature (757)..(757): n is a, c, g, or t
  misc_feature (809)..(809): n is a, c, g, or t
anttcacacatttaggcctcatttagacaatgaggaggctgacctgtccctccacctcccattgcnatggttagagggcaataaccctccctaatactagctcagtgagtagaggnngtnacntacctaaccaggnngtccncattttggntganatggcacaggtcctgaacatnccactntgtacttccctgctccatntccccacacatgtaaacagagtttttgggctgagtttgataagatgcctctatgctttgagaaggaagtagggcatcccctaaatgcaaggggaatgtgcttggatttttantttggtcccagtacaagaaacagaaagcactgcctttnagagctctggctagtaaatgccacacatatctggnaggntgaggaagcttccncgcntttttcctcaaccacnatagagaagggaaatgggacagaccacgatgagggcacctgtttttgctctgcctccccaggagggttgggggtgccccacccaatggaacataaacagatttttggcagtgttgtgggactggggaggagagaaacacaagctccaccagaacaaggaaggcnctggggagtacaggggaggagaaggaggtgggaaacaggatcctccctccccgccgccacacacacacnanccccngttttcgttgctnnggcnctgngnncccntccagagaactcngtgnngggtgggggctctgtatccttcccagagttgtgacctaggggagtnggtctgattcccgccctgttggaagaggcagccttggttaagaatggcaganaacctggagatggc

SEQ ID NO: 522354 - DNA, 805 bp, Homo sapiens
gagtttttaaaaattgaggtgagatccatataacataaaattaaccttttaaaatgaacaattcagtagcatttaggacattcacagtgttgtccaaccaccacctctgtctagctccaaaacatgatatcacctcaaaaggaaactgtacccattgagcaattgcttctcattgcccacctccaccagcccgtgacaaccaccagtctgcattttgtctctatgaatttacctgttctgaatatttcatttaaaggaactcatacagtatgtgaccttttgtttctgcctcctttctcttagcatattttgatggtcatccactttgtagctagtatcaatctttttatggctgaataatattccgtgtgtgtgtgtgtgtgtgtgtgtgtgtgtgtgtgtgtatctcaaaattttatattttttatatattatatttttagagagacagagtctcactctgtcgctcacgctggagtgcagcggcgagatctcggctcagtgaaagctccgtctcccgggtacacaacattctcctgactcagacttccagagtatcgtgggaatacaggcgcgcgacaaacaggaccagcataatacgtagtaatacacaatagaaaagggggtaaccagtggtgtaagcaagagagcgagtatcagatccatccacagaacacaagagcataccagaccagtacaacgacgactcacaagaagtgactggagaattaacaacgacataaacaacaagaagagacgccggcacgtaatataaacaaagagcaaagacaagaaaaccatagaa

SEQ ID NO: 522355 - DNA, 1254 bp, Homo sapiens
ggacgcgtgggaggccctcagcccccaggtccagcatggtgcatgcgacgacgggcaccggttccacgaaggcctatcgctggatacatagggctgagtgagatcggccgccacatgcaggccgtgggccgaggccgtgggcccagcgttcagggaagcgtctgccgcccgccggctagcatgctgctggacaccacagaactaagtttccgctttctttcaaggctgtccgggtaactgatgctctggatggatgaggtcaacctgcagatggatgcccaggagcgtccccggggatgtgtcctccgcggcatctagtcatcaatgaactcatgcaatggcatcgagaggcacgaggatacgatggcccgggcacgtagccgcttctcctcctgcatcgacgtggggaaggagctgctggccaggagccacgtatgctggccgagggagatctcagagaatgctgtctcagctgcaggcacggcgccaggagacagctgagaagtggcaggagcacgatggactggcttcagctggaatggaggtgcttgtagttgggaacgagatgcagggatggcacgaggcctggctctgcatccaggagccactggtgcgcagtgctgagctgggttgcacggtcgacgaagattgagagcctcatcaagcggttacgaggccttctagaagtcagcagtggcctgtgaggagcgatactgtgcgctggaagcacgcttactgcaccaagaagagccgggaccaaggagcgaggcacaacacgagcgcggcggcaggaacgctggaacatattccggctggtccggaaaccacaaggcatatgggccctccggtggacctgtggggcggcccaacaggtttcgtgcacacgcgtgggaaagcaaccagcgccgaggaacacacagatcaaagagggacccacgggtgtcagaggaggtttgtaccgacattgagaaaggcctccagactccacttgtgtgcaacacacagagctcgtggacatacagcagctccccgagagggaggagaagcgcctaaaggaagaaggaaaaggaacctagaagaagaaagacggcacatgtctagtctcgccattcatcatcatagtctaaatagcaatagtaagctttacagcaaactagtagcaatatagaaggctactgatcgaaatacaaaagcacttgactacggcgtctaactaagcaagacacacgacgaaagttacatagtacgtaagaa

SEQ ID NO: 522356 - DNA, 999 bp, Homo sapiens
  misc_feature (621)..(621): n is a, c, g, or t
  misc_feature (623)..(623): n is a, c, g, or t
  misc_feature (632)..(632): n is a, c, g, or t
  misc_feature (641)..(641): n is a, c, g, or t
  misc_feature (660)..(660): n is a, c, g, or t
  misc_feature (662)..(662): n is a, c, g, or t
ggcggcgcggcggttggccgccccggctccgccgagtgcagcgcgcccgaaggccagtgcctgcgtccgtccgtggcccggcgccaggtgggcgggaggccgccggcagtcgccgacgctacaccgccgggcgtcgtttcgcgtcgcccgttccggccaccgggcgcattttgttcgcgcggaagcgccgcggtaggtgtgggaacccaagcgggagagccgcgggatttgccggccgccgccaatgccgttcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagcccaatgtttatgatttcaaaaccacatatgaccagatgtacaatgatctttcttaggaaagacaaagaaactcctatacacagaatgggattttacatatgctggacagaaataagagaatcaagccccggcagaaagattccagaatgaaaggacctgtttgatctgatcctcattgcgaagagaagagtgtatgaccagggtggtggaagatctgaattncnagaaacagngagacctgncagccttgtgcacgtggtnantgtggactccaggacaaccacggaggagggccccccttgggggcggttctcatcttgtgagctctggcaagtgtttccagcacacgggacagaccttgcggcacgagctccgcgagcttgtcgcaggagttcgaggagaaagagtgggcggcctttcttgagccgttggtctatgaggcaggccgtttggcgctctgggtccgtggcagagttcctctcgaatggttatcacgggttcgcgcgggggccacccacatcgtgttattggggggccccccacaagacgtttttcctttgggggtgacttcacacgagaggcgctatgttccccggcaga

SEQ ID NO: 522357 - DNA, 135 bp, Homo sapiens
cggcatgggatatgtagtcctgctactttggaggcgaggtgggaggatcacctaagcccataaagttgaggctgcaatgttccatgatcgtgccattgcactcccacctgggtggcacagtgagaccctttctcc

SEQ ID NO: 522358 - DNA, 405 bp, Homo sapiens
taagttttgacatttagcagaaaaagagtagctttaaaaaataaaaaaaaaattgtctgggcgtgttggctaacacccgtaatcccagcactttgggaggcctgaggcgggcagatcacctgaggatgggagttcgagaccagcctgaccaacatggagaaaccccatctctaataaaaattaaaaattagccaggcgtgttggctcatgcctgtaatcctagctacttaggaggctgaggcaggagaattgcttgaacccaggacgtggaggttgccatgagctgagatcacgccattgcactccagcctgggcaacaagagcgaaactccatctcaaaaaaaaattattttgattttttttgggggggattttattttctgattgtaaaagtaatccatgttg

SEQ ID NO: 522359 - DNA, 136 bp, Homo sapiens
agtagtcgggacgtagtgatggctgcgactctccatgctcctgtgcatggcctcctgtaactccatctgagtcaaatcccccagtaaagtgcaatcgacatcccaatagatgctgggaaaaaaatcttccccacgg

SEQ ID NO: 522360 - DNA, 388 bp, Homo sapiens
ccccctgcggctctcataattgcagtgtgtggacttaggtcctatgtctccagagggtgatagctggcgtctgtcacgtgtcctactgagacagcgcagcggagctagctagcgacatttgtataggctgaacgatatatacttatagaatacagtcaaagatacacaatctgaaacagctacatggggtgaactctaacagttgttgccatgttctagaatgagacttacgttctctgctatctagatctggactcctatggcttctttacttagttcaagccccagtctagggaaagccagttacataccacttggcgtcaggagtcttagagctcaccctgaatataagacccgcaaggggagaccaagcacgaatacgcagacc

SEQ ID NO: 522361 - DNA, 135 bp, Homo sapiens
ataggagggggtgagactggggaaaagtgcgatgcagaaatgcctttctgggagcaatgtagatgatgatttggtgggcagagatgttgagcctttcaaataggtcagtgttgtccaggctgacctcgaacttcc

SEQ ID NO: 522362 - DNA, 279 bp, Homo sapiens
gaaaaaaaaaaggggagggggttttttttttccccaaaacctaggcggggggaatttggtaggttccaaattttcccccggttttgccaaatggggggaaaatttccccaccccatggggccaaaaccccctggggggggcccaatttcccaaatttaaagccaatttttttggggaaaattttttttttttccgggaaattggggttttaggggttttttggtttaaaaaaaagttttgggaaatcctttgaaaggggggtttttttaagggttttta

SEQ ID NO: 522363 - DNA, 148 bp, Homo sapiens
aagctcggtaccccgaactggcgcgcgtcgacctgcgccttgtcgaactcgaaccagggatcgggctcgttctctcgaggtataactgcaaccgcgaccagagcgccttgcggttgtcggcatcgtcgagcaccttcttcttgacatg

SEQ ID NO: 522364 - DNA, 834 bp, Homo sapiens
  misc_feature (92)..(92): n is a, c, g, or t
  misc_feature (124)..(124): n is a, c, g, or t
  misc_feature (144)..(144): n is a, c, g, or t
  misc_feature (164)..(164): n is a, c, g, or t
  misc_feature (234)..(234): n is a, c, g, or t
  misc_feature (256)..(256): n is a, c, g, or t
tgtccacatccttcatgcaagactgctgccttcatgtaaccctgggcacagtgtgtatatagctgctgcttacagacgtcagaaactcatgngaagggccacctcagcgagggggatataatgntcgtgtgtaaatatcctgtnggttttctgcacttcaccangtatgaggtgtagcctcggaccccggcgcgccttatctggtttgcccaaagccgatccttgggcatctcnagcacttacactctcgtctatngtctgttctagcaagcaatacaaagcaagaaatacggagtatacggacactgctgggctttgcacaatagacagtggggtctccagcataccgttgaacaggcatacgaatttgacctctggttccgtaacagatgcagctattctcaaattgtgttacctggaaactgcaaccatttagcaaagaaggtgggtccctgtttccaggttgaaactttttagctccaatgacagaccagcctgtagttatcctgtgtaacacagtttacagcttacaaaaacctacttgggtaattattaccggaaaaggtgctcagtctcaattgttcagtgggtacttcctttcagggcaaaaatattcccttggccccaagaaactccttcatttgggcatttctaccagtgggccacgaggccttcatgtgccacgttctacgaccagcgggcttccacgggctaaatggaagtgccggccccgaattttttccctcttttgcgccaacttaccttcttcgctggcttttgggcacaggtttccccatatttatgtccccttcggacccggggcggaacaatttc

SEQ ID NO: 522365 - DNA, 102 bp, Homo sapiens
tctacaggatcccaagtatccagcagagaaggaagtttaatcataaggctgccgaataggagacaggggaaacctcaaatctgcctgtctgagccgtttagg

SEQ ID NO: 522366 - DNA, 120 bp, Homo sapiens
ttttactggagaatttttaatttttaatttcatataatttcacgcagacattctgctttatagactttgacttcacacctcccgtcttcaaagcggcgaaaattcagccacggctgcttt

SEQ ID NO: 522367 - DNA, 130 bp, Homo sapiens
tggtgtctatgactcctgcattatcttcaaaataaagaaacacgccaccgtttctacggtatgactttcgttgtcgaatgaccactggctgatgtaccttttttctgagctctggtttgcctttcttgac

SEQ ID NO: 522368 - DNA, 246 bp, Homo sapiens
cgattacaggtgtagacgctatcgcacccagccagaagccaacacattatatcaaagctgaaaaattcaaagttgagacaagccttcggcaaaaaaaacttatcatcttgtaagaaccaaagatttgctcaatagcgtgtatccgttaataagcagcagggctatggacgtcgcctctattttctaacggtaaaatctcaaaattcgtaggaataaattcattctttgtaggaagtttaaatttcc

SEQ ID NO: 522369 - DNA, 671 bp, Homo sapiens
cttatatgtagagctgtggctgccagatccttgactgtgcggaccgccagcaagacgtcgtgacttagcggtacgctgtcatgtctaggatatagaactcaataagcgttgcctctgctcctcgtgagcagaggggacaaccgactgccagcaggtgtgggagctagacttaacagagagacgtgtaccaagcggcacgtcagcgcaggtgagcaaagactatgctcgatagttaccacgtagacatcatagacgggacagagtatgacgacatgagagaataggaccatcaagcgagaggcgaacagacaatcccaatgataaatggccgcgagtgccttgcaagggaatagaaaccgcttcggagaactaacacagtttacagcaacgacgaaaggcaagcactcgaaatgataggtttccctacacgagttcactacgctttccgaaagatggccttcctgatggggccacttccatagaagagcccctattgggcgtcaccaagataatagatacaaccaaacgggacatacagtataaagagcccccattttgggcgatacacacatcgaaaccgagcacatgttcggcaatcgcttggaatcagcagtataggtgattatatataagaaagcagcgtgtcatccaactaataaatgacacaaaag

SEQ ID NO: 522370 - DNA, 510 bp, Homo sapiens
  misc_feature (443)..(443): n is a, c, g, or t
tgtcagtgaggagcccgcccagcccacaccttcatcgtggacttccagcctccaggagggggggaaaatcagggtctggtggtctaagctgcccagtctatgggacttcaggctggcaaccccggcagatggagaccaagcccaggtgacttctctcctgacggggatcggtgcaggcggctgtgtgcatatgtcaagaaagcctctttgccaggaaacaggcaattatacccacacttacctgctacctcaagagtcggcgaggggagagacttcaggagcatgagcaattactcgagttcccctcccaagtcatttcaatctcctgtgggttaccgggctcattcagtctgccccacagttctatggcaaacagagccctctgtgttcatgggacggttcaagaacaccaagggttcctgccagcatttgtctctctaatngcacgttctgcaaagcagaccttggactgggccagccctttgtgatctttttccccaaagaaaacac

SEQ ID NO: 522371 - DNA, 944 bp, Homo sapiens
  misc_feature (1)..(1): n is a, c, g, or t
nctactgctacatcagacaatacagtgcggacggcgtatatataggtcgttgagggagcctgcgttttatgccaccgtggtcttgtatctcgcatgtatcccggcccccttttggttcccccagtggttggaccctgtgggccattacgggtaggctgatcccctggtcgggataggaggggcctatcggcaacgcggcgtgcagttaagttcccccagtttttccccggctgcgcaaacctatcgggcccgctcgctgtcatcccccctgcgtggtagatttagagactgacgtcttgccgtgaggactcactgatgccgtatgtgcgtgccggtcgatgttttggatccggtcggcagcctcgttttgtggacgccacgttctcgtggccgacccgatgaatggctgcgcccggcgcaaaacttcctctgtttcgccccgcgatgctgcccctacgaggtgtatgtgctggaaatgtccgagtatgtctatgcgcgatcctagctctctcattatccgtcttcagaaggatcctctagacaattatctccccctcatagggattgtaccgagggtttgcgcctacgcgctactgtatccttgctgcgcgtggcgccccccccattgttgatcccacgcgggaggtacacccattagcctcctaaccccctgtgtctccctgacccacaaataactttgccccatccactggagcccttctctacattggtttctccacccatatcatccccgtcgtaacttacactgtttccccgcatatcctctaggtgttcccatctctcccccaaaggctactcactaataacccgtcttctccacccaggtataacacccctccttgttccaataaccctatcctcccattatctttccttgaccctaagacccccaaaacttccggggtttccccccaaacataaca

SEQ ID NO: 522372 - DNA, 235 bp, Homo sapiens
ttacataacacaagatttaacaattagctgggtgtgagtgctactgcatgtattcctggctacttcagagtgctgacggtggaaggatcactatgacgggaggagtttgaggctgcagatgagttatgatggcactgctgcactccagcctgggggacagagtgagaccctgtctgaaaaaaagagagaaagaaagaaagaaagcgcgagcacgaacagaaagcaagaaagaaag

SEQ ID NO: 522373 - DNA, 262 bp, Homo sapiens
  misc_feature (21)..(21): n is a, c, g, or t
  misc_feature (239)..(239): n is a, c, g, or t
  misc_feature (256)..(256): n is a, c, g, or t
  misc_feature (258)..(258): n is a, c, g, or t
gtttccccctcctgtggatgnaataactgaagcctagagaaacgagctagtgctactgaactgtttaaattatttttgtgttaatagtacactttgagtatctttccacatttaaaaagaactttccgaattataaatgttttccttacgttatttaacaatgtacactgtttaaaactgaattcaaaccttggggtttctcagcagccgttacctgtacatttgcactaactccgggnctgcgcttctgtaagantncgct

SEQ ID NO: 522374 - DNA, 142 bp, Homo sapiens
cttgccccggcccccatggaccatcagtctgaaaacaatgatatcgatgaagttatcattcccacagctcccttatacaaacagatcctgaatctcgctgcaaaacaaaacgctattgaagacactatcttttacttgggag

SEQ ID NO: 522375 - DNA, 2499 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 522376 - DNA, 1335 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagatcaatgctacatggggcagaactggaccccctcaggccctcctcgacgcgtcacggcgacaagtacgctcccacagggctgccccaaacaccgggcggccacacaccgcgcctcaaacgaaacgcaaggggcgcatcca

SEQ ID NO: 522377 - DNA, 966 bp, Homo sapiens
ggacatctgggctgctagctgcatgaaggagctacccgctgtgggtctcctctttgctgacagctggacacttgacagaatgacctgcctgaactcgggacctgcagaatgatgggactgaagaagctgtaacacaaacagggctaaaacacgcactctcctccccctgtccccagcgcccacccaattgccacattggacggtgatgagaaggagagaagagctgtggcctttcagggagcatagtcccaggggctctctgagccaggctgtgaaaccctctatccgggcactgcagtacctgggcatctccaaactttctgagtgccagcgcattccccgacgtccggatgcagggtcaatgcacagaaagaaaatctctctccatgacctttagtacaagggcacggataggaggccacagtccaaggatggttcgatggggcacccaagagatactgacaaagggcatacacgactgagacaaagttatgggaaacactctgcaagtgcgtgtagagacttgcaatttcacgtacataacatgagcttggtgggaacactgaaagtggagggcaagaactcacaacggccatttgccaaaacctggactatatgggccattccagtatcacaaatccccatggtcggcattgagacgacaagcttattaagatctgtgactttccctattaggaaagttggccctccaaaacggagggtattcccaagaacgtcgatttggacagtcaacaagggcaggaaacaggaagtccagcactggcaaggggtacagtaccacaagtccctctgaaatgacagctacaaccaacaccccattccacgacaataacgcaagtgagggcgccatagccacacttccacccacacatgtggatacagctcgcatcgcaggtaagcagcatgtggtagccgcacgccacagacactgcgaacagataccca

SEQ ID NO: 522378 - DNA, 1358 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggtaattgtgtagtatacttttatgattaggctaattttgactgtgttataattctatgattaggctagccctgttgatacttagtataaagaagataatttttaaaaggatacttaatttttattgtatgttttgtgaggatatgtatctgaggtgtcatctactagatatatgtgccattttgcactttgtggtgtgctgagtaattatcaggaaataggatgtaacagagctctgaaaggtttgggaaacgtttcttaacattataacctttaatgacctaggaaaaatctttaaaaaatttgttaattaaaaaaaaaaa

SEQ ID NO: 522379 - DNA, 391 bp, Homo sapiens
accgcagtatatcctgagcctgatggaacttatcctgtctcaggcactcacttccaaagactgctcaaattgaggtgagcactcccagccagccttcaagtcagtagctctgtcttctgacacatacaagctaccatcattgaaccagaaagaaacagaaactctaatcagaccaataatgagtaacatgatcaaaatagtagtaaaaaatctcccatcaaggacaagctcaggacctgatggattcagtactgaattcggcgaaacatttagagaactaataccaagtctactcaaactatttcaagaaactgaaggggggaatacttccaaattcatcaatgaggcgtagcataaccctgataacagaagcagagaaggtagagccgag

SEQ ID NO: 522380 - DNA, 1328 bp, Homo sapiens
  misc_feature (26)..(26): n is a, c, g, or t
  misc_feature (1140)..(1140): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggagtaagtattaaaatgcattttgtataattgcatatattataaataatatctacggaatgattggtaggtatgaacttgtaaacctctttggcttttttgactagtaaactgaatgtctttggtagcttaattggaaaaataacttcgtgtataccaatttaacacttgtcagtactgttttctgtggttaaaagtgtcaatttttcctggcaaagagcagtagaagaagctgcagttgagaccaggcctagttggaagcattcctgtaggttttagaatgtgcntttttaggtgtcacaagagccatttgaagtagaattctctttgtagtgattcaccattttacgaagcctaatggatcaccccagtttcaggcctaagttcaactttcctttcctatggcatggggggacattggtcccccggttccccagggctgtgcggacgaaaactggaatccctattatcccac

SEQ ID NO: 522381 - DNA, 163 bp, Homo sapiens
taaaaaaccagatcgggaggactgtgaccagcagttaacgccatgtagacttcccttgttcgtaagtgtttgaactcagtgtttatactgatccgttgtaactattttatatctgaagacggagagcctgtaatattcttcagattaaatgaagcgtgagaca

SEQ ID NO: 522382 - DNA, 230 bp, Homo sapiens
tggcctcgtggatgtcagcatcgactatcctggctgagccatttgcagttcatcccatatccacaagagagtagggctcagcccaggccatacacagtcggtgtagacccttgggcgaccccgtccggtttgactgcagatgcataagctgtcgattattctcacgcattcagtctgtcgttctacagtgtcgagaatgtagcatggtagtacggtgcagtctgttagag

SEQ ID NO: 522383 - DNA, 557 bp, Homo sapiens
gcaggttatggcatcgttgtagacagcttaggatcttctctatatcatcctctatctcctcattgtggttatgttaaatataaagatagtacttcttgatatttagcgctattcttcaagaatttactgtcttaaagtataaactattacaatatgaatattatagttgtcatagagatcccttactggtattacccttatcatatactgctatgattaatgctgagtggccatatgttgatagttgtcatagcttgtccctgaagggatagaaataagattttagagactctcgagtccagcattatctatataatatctgtgggccctcacactgctcctaagagattattttggccattaacaaagaactttgtatgatgggttatagagatggtttaatctggagtttaatcagaaaaaaaaaaattcttgggaaggcaaaagaaaagcctatgtagtgctgaagccaaatttattatacctatatttgaagctggcatttctaattcagggtatagacagttatagtcacaaaatttcttcaggtacccttc

SEQ ID NO: 522384 - DNA, 80 bp, Homo sapiens
gcacgaggattgactcactcaaggttatatagctaggtgtgaaggggctggaactggaatcggggtactccttttctaga

SEQ ID NO: 522385 - DNA, 136 bp, Homo sapiens
tgtgcagctacctgcacctaattcacaaggatagcctaggacgaatccaatgctaaagatgactgagtgcagaacggcctcctcccctcagccattatctgagagcgaatggcttcataagctcagccttgcagcc

SEQ ID NO: 522386 - DNA, 145 bp, Homo sapiens
gggaaaaaagtaggaatttattgacaggaacttcctttggcttttactctaaaacggggtatcaaagggctgaagataatgaagggcccccctccacctcttcctgcagctgtttttgtaccaaaatattattttactgtcttca

SEQ ID NO: 522387 - DNA, 283 bp, Homo sapiens
  misc_feature (161)..(162): n is a, c, g, or t
  misc_feature (258)..(258): n is a, c, g, or t
catacctggaccttctcatcatgatcaagtggtattattccccaggatgccaggatggtccaatatatgcaaatcaatcaatgtgatacatcatatcaacacaatgaaggaaaacataattatttcaattgatactagaaagcatttgacaaaagtttaanncattccttcataagctttcaacaaacactgggtatagaacggaagaacgtaatacaaagccactatgtgcacagactcacatcgctaatataccanaatggacgaatcacactgaaagctt

SEQ ID NO: 522388 - DNA, 188 bp, Homo sapiens
ctgcatgacatctcagagagaggaaaagctcttgtagaatgatagtgctaatactgaaaaggccgaaacacacaaccaaagcatggctacttgctttcggtataaagaggaaagaacaccacgtgcacacaaggatagattgctttcagaatttttctttaatgaggcttacgaaagctttattttgt

SEQ ID NO: 522389 - DNA, 249 bp, Homo sapiens
ctcaaatccggagtagtgtaaactctaggatcgacttcatggcacgtctgtgtcatataacaactttctgggtctgatacgtggattgggcttaccgggtcgtatccgcaggcagtcggttacaaagtgccatagcatcgatccacgccggctcacgcaggagcgggttcttaccatttaagtttgaaataggtgagatcgtttcggcccaaagactctaatcattcggcttaccggataaaactgcgt

SEQ ID NO: 522390 - DNA, 282 bp, Homo sapiens
  misc_feature (167)..(167): n is a, c, g, or t
cgctaagaccagcccacagatataccagactcaagtataggactcttcagtagtccgatatgtacacagcctaccctagatgctttaacgaaaagtaacttactttcacttatattactatatgtaaacaaacaaaacccacaaatgctgtatagtacagtactatngatgccaagcagtaaaaaatactgactccaatttagttagaaaatgttaactaagaaatctgaattgctgctatgaaaaaaaatagggataaaacaagccattcttgttggggac

SEQ ID NO: 522391 - DNA, 387 bp, Homo sapiens
ccaattttaaaaaaaaaaaaaaaaaaaaaaaaaaaaaagagccaaaaaaaaaaaaaaaaaaaaaaaaaaaaaaaaaaaaaaaaaaaaaaaaaaccatgtggcccgcttgggcccagccgattttagattggagaaggtttatgctggcggccgaatttggggttaattggcccaattggccttatgggggggggtattacaattaattggcggcggttttacacggtggggacgggaaaacccttggggttccccaatttaatcgcttggaagaaaatccccttttggccggttgcggtataacggaaggggccggaacggatggtttttccaaacggttgccaagcctgatggccgaagggaattggtaggcggaaatatttggtt

SEQ ID NO: 522392 - DNA, 738 bp, Homo sapiens
gagcggggtggcctggagtgggcgtgggtgagaagtgctgcgcgcgggtaaaggggccgcctcgagcgcggtccgagcgttcagcggactgcgcgcggcctcgatctctgtgactctgtcacctgccccatctccccatcccagcacagccagtcacccatgtgaaacctgtgtcgcaactcgcctgtgcctgacctgaatgctggtttcatggcagcctcaaatgaaggcaggatgtagtgggccattggttgtgggtgcggtggaccagggcaccagttcgacgcgcttctttggtttatcaattcagaagaacagctgaactacttacgtcatcatcaagtagaaagtaaatagcaacgagttcccaagaggaacggatgggtggaacagggaccctaacggaaattctacaattctgtctatgagtgtataggcgaaaacatgtgagaaacttggacatgctcaaaatttgactatttccaacataaaagctattggtgtcagcaaccagagggaaaccacttgtaagtctgggacaagataactggagagcctctctacaaatgctgtggctgttggcttgatctagagaacccagtctaccggtgagagtcttcagtaaaacgaactaaccggaagataagtaactttgtcaagtccaagacaacgccttccacttagcacttaccttcagctgcagtgaaaaccttcgttggctccttgacaatgtgagaa

SEQ ID NO: 522393 - DNA, 830 bp, Homo sapiens
agcgggtcctgaagctccgggaaccctggcggaatccggaactgacggggagagctggctttcgatcggccagggtcagctcagaccgctaccggctcgccactcgtaccatcatccttctagtccgagtcctcaggttacgcgtgtcctggggctttcggttatgcgctccgagttgcgcgtgtgtgagcgtgcttgtgtgactgcgcgactatctaatgatcgtctagcttcttgtccctcagtccctagtcagcggtcgcggcgtgtgcccatctcgtgcgtcttgtgggtctctagctgacgttccctctggagtcttgtactgaccttgtgcgcgggctacctagtgcggacgcaggagtggggatcggcgacttccgttgtggacccgtcgaatcgattaaaggcaacgctgcaatctggaaaatacacgtagacgcgcagaacctacttagactgcgtctctttgaatcttggatgcagtcggagaaagtactaatacggcactctaatctaaaccgttttacccgtaagcataacgcaatttgactgagacggattcaagcggagtggggtagttctgggcatgacatgtgttccctgatcagtctgcatcctgtgaaaagacagtgcttcagaaaaaccttgatgagttgttcactagtggcttccacgttaggtatggtaacggtgtcgggactttcactcacaacatatttgccaattccacagccactttgggaaaggtgtgtgtaaaaatggtaacacctccgggcaaatttttctcaaaaacatcggggggacacaacactcaatggggggaaaaa

SEQ ID NO: 522394 - DNA, 241 bp, Homo sapiens
  misc_feature (64)..(64): n is a, c, g, or t
  misc_feature (71)..(71): n is a, c, g, or t
  misc_feature (75)..(75): n is a, c, g, or t
  misc_feature (121)..(121): n is a, c, g, or t
  misc_feature (124)..(124): n is a, c, g, or t
tgggcttggcaaggagaaacgccatgtcacctacgttgtagccaaaaaaggtgtgggccgcaangtgcgcnggcnagctggagtcagaggtcatttcaaggtggtggactcaaggatgaanaangaccaaagagcacaacaacttaaggaacatatgataatactcttactgaagtaagcatatctgccaggttcccaagacatcatgggttcttagaagaaaggtttgtcatttgtataa

SEQ ID NO: 522395 - DNA, 246 bp, Homo sapiens
ggatcaaaaatattcaagcgagaaacaaacaagaaaaaaacaacagtaaaaaaagcaataacaaataatacaaactaaaaaatacagctagactgccaccgcactccagcctgagcaccaagagagaacactctgtctcaaaaaaagaaaaaaacaacggagctaaatacaatgggaagacaacgcaagggccaggttaaataaatcggaatgccaaacaatggccccccctctctatacacactg

SEQ ID NO: 522396 - DNA, 134 bp, Homo sapiens
agccctgcagcggcgttgcacccagtgcttgcgcgacgggactcgttgtcgggaacgtcctgactcgtagaaagtaccgttgctgtaggtactggtgacacttggtagcgtgctgtgccattacgcgcccgaaa

SEQ ID NO: 522397 - DNA, 239 bp, Homo sapiens
gtgtgcaggatacttgtaatggagtggtccttcaccaggacttgagggttggtatctggtaccttcagcagttgtaggagataaagtgggttccagtagaagtggtgacaggtgtgctggtgtcaacaggagttgtggaaagggtgctagtctcagaactgaccactggcgtggtgctgaaagacatatttgttagtggagtgcttccttcactataagttgaggttggcatgctagta

SEQ ID NO: 522398 - DNA, 308 bp, Homo sapiens
ccagcttcctgagtagctggaattacaggcgcttaccaccacgcctgactgcttttcgaatgtgtgcgtatgtgtgtgtatgcgtgttagagagaaagagagagagggagatggagtttcactcttgttgcccaggctggagggcaatgacatgatctcggcccatacaacctcagcctcctgggttcaagtgattctcctgcctcagcctcctgagtagctaggattacaggcatgtgccaccacacctggctaattttgtatttttagtagatatggggcttccccatgttggtcaggaagctggt

SEQ ID NO: 522399 - DNA, 610 bp, Homo sapiens
taaaggagtactatctggataagttcaaagagctccttattataaaatacaaactatttaatatcaaaatagaaaataccgagactcacactcatacacacacacaagcacacacacgcacacacacatatcacagttctggtcccttatgagttgaaaagtcaggaataaatgtgtggaaaagttatcgtggggatacaaaggaagaaatcttggggtgattccctgattagcactcgtgaatgtttaagttatgaacactttgtagctataacctggaaaatctacctgactctttgtaagagtatttaagatacacaagtgattgtgctctagaaaggtgtgacctggtcttctgtataaagcccactctgtagaccaggattgatctaagtgccgacatcagaagcaaacaggcaagatttaaacgttgggcaagtaatttctgtgcgcaatcggtacaggggaatccctagaatcgctcacgtacctgcacataaaggcatggcgacctcacgggtgtcgacccaggctgatctgacacctctgggggcacacggggacctccccaagaacgcgggaataacagtcaagaggccaaccggggccc

SEQ ID NO: 522400 - DNA, 971 bp, Homo sapiens
  misc_feature (6)..(6): n is a, c, g, or t
  misc_feature (8)..(8): n is a, c, g, or t
  misc_feature (33)..(33): n is a, c, g, or t
  misc_feature (102)..(102): n is a, c, g, or t
  misc_feature (106)..(106): n is a, c, g, or t
  misc_feature (114)..(114): n is a, c, g, or t
  misc_feature (135)..(135): n is a, c, g, or t
  misc_feature (170)..(170): n is a, c, g, or t
  misc_feature (175)..(176): n is a, c, g, or t
  misc_feature (179)..(179): n is a, c, g, or t
  misc_feature (182)..(182): n is a, c, g, or t
  misc_feature (763)..(763): n is a, c, g, or t
tcattngnaggattgactttaataacacgcctntactgaacaaatggcgattaactggggaaaacggaattatggtaaccgaggtaacggggtcggggactntttntccttcgntgcatgctgggtggcgggganagaccgctctgaggaggtttggtctgtcggccacngtagnncgnggngcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgncccgatttcctagcggccccagctccccagttcccgctcagagttagagatacaggatctcagactttggcctgagtaagggtctccgcagctcttttatccatttgggttttcgatttcccgtgtttgtttcttatttcaccaattctggtacacgctagttttaacggctggaggttctcgagcgctgctgccagggactccccaa

SEQ ID NO: 522401 - DNA, 87 bp, Homo sapiens
ggatttgctggtgcagtacaactaggcttaatagggctcgaattcgactcgaattcgaggggcaacagagtgagactctgtctcaaa

SEQ ID NO: 522402 - DNA, 763 bp, Homo sapiens
cggttagatctagtttgctggtgcttgttccacgttaccgctccctggctgccgcatacgaccacgctggggggcttgagagttagccccggagtcgtataccttttgtatcgtgttgtccccgtcgaattgagtgaggctatggcggtaaacttgacgttctatgtgatcgagagatagttcgataatgaggggtcggggaaactcccacgagggagagaacttgtgattcgcctcctctccgtcttcgcgcttacattatgtgtatagagagagagtctgctagcgtgcgaagctgaccctcctgtctcgtatctccctacgtaggttacatcaggagtcacccacatcacatagataaacatacatccgcgcttcttcttcacacacactcactctggactacacacacttacaagatgccgctattcacgacccttttcgcttgcctacaatatatcatttgggtgacacacacatatcatcttccgccactcgggtgcaattttagaacaccacacgtctatttgccccaaacccacactttcttgtgacaatatgttttttttgttataatatatgatcatttttttttatagaatgttttcggcgctttcttatatgctctccgccaccctcgtatctttctctactttttcttaaaaactttccacatatcagcacagttgtcagagttgttgagagagttaacccccctcttatacacccgtttattaccgcgcgcccacaataatcaataaaa

SEQ ID NO: 522403 - DNA, 137 bp, Homo sapiens
aatagcgacggagttgagaggaattagtgaattaatgcacctaagaaatttagaaccggatgtggcacaaactgccacgtgttagcgcagttattatcatagacgccctccgtgtgtgagggcatgtcccatgctct

SEQ ID NO: 522404 - DNA, 656 bp, Homo sapiens
gatatattgcacatgttctgtgataagaatattctataggtactgatattttgattgctgcagaagcggcggacctctatgagtttctgagagattatgacggacaccgatagaaccagaggagacacagctcaattttactctagagcttgctcttactgctctgtgagttactaagccttggcgggagaacgctccgtttgttaggagggtcgttctcaacttacggtggttctgaccgctctgcagaagatgttatgaccttctaaaggagcatcagggagggatgcatacgctgactgtatgggctgtacatagcaagcctcgttctggacagatattttgcgtgcctacagtggttgagtcaaaacgcacagcccgatgacgcgcatgtcacgtactacaggtgtgttactgttgatgcgagacgatgccatagttctaacgattatgcgcagttagcagagacggtatgtagaaggcagcagatgattgtagctgccttgtgggactttcggactatcatgagcgaacattctgagggtgagagtgccgtaacgtgccaaccatgttgatctatgtaataagatggctggctagaaggataccgtgggcgtagccgctcacatgtctgcttccaggggatttgactggcg

SEQ ID NO: 522405 - DNA, 372 bp, Homo sapiens
tgctgaacgcaaaaaaaagggtgggaatcaaccctttcctgtttgccctttgggtccctcctttcacctttccctcgattaaatttccccttggacacttggttaaacccctttcaggtcaggaagcccatttttggattgtggttcccaccaaccctggagcattatgggtttttcccccccttcccccccaaaaccctgtgtttatttggtgtttctggaaacaggggctcccacattttaggccttcggggaaactgcccattttccccccagttacttggccccccacgcataaatttaggtttaaaaacaagttttaatttttctttccaaatttttgtataaataaaaatttttggggcctcctta

SEQ ID NO: 522406 - DNA, 180 bp, Homo sapiens
  misc_feature (107)..(108): n is a, c, g, or t
  misc_feature (147)..(147): n is a, c, g, or t
gatcctgcagaagaataacctgaatctgctcagagacctaagctgtgcacattgcccatagcctcaggaacagtccagactggggcggtgtggtcatattacacagnnaggagggtgattcagagttcatgaatatcattgccaatnagattgggtcagaggagaccctcctgttcttaa

SEQ ID NO: 522407 - DNA, 156 bp, Homo sapiens
aacagagagatggctacagcagtgaggaggcgagaatgaggaagatgaggatagacaccgaggaggctgaagacggacgatgacgaagaagaagaagagatgactggtgccagggactggaacggcaacgtgttcagatcctctactgcagagaga

SEQ ID NO: 522408 - DNA, 928 bp, Homo sapiens
tacgagcccacgtggaggctgccgaagaagctgctcgtggagacggctggcggagcttgagggccgggagcaggtggccagggctggcagccgcacttcgcaccgccggtgtactcagcctgtgggctgagatggcctgagatcctctccctgtgaatgtgggctgatctgcacatgctggctcagtgcatgctgcagtggcttgaccctgggcaccagtgccctggacccctgagctgctcccacatgactggatgctccatcctgggctcctggacaagaactgccaccttcttcggctgtccattagaggagcagcagccccagaaggatggtgggacagacggagctggtacccagggagcgtgcaggacgacgccagagccggagggaggatgagccgaacgactgagagacagggctggagtccagccccaggccggagcatggagcccagaccccaaaacacgaggaaaaagcccaggacaacccgagacgcgggagcccagaccttggaggaggacagggcccaagaacacccacgaggatggaggaccccagccccaaggggtggccgacccaacacgcaagcaacaagttcaacggccggcctccagtcactacccggggagcacagaacaaagaccagacggccgaaatactggaccggctctggccacctccccagaacccatcaccacctgacaggtacccacgcgcgatgcctggacgacacgaggtcaccacggaaatcaccacggacctccgtgtccctatcagagctccccgggtaagaatcctggctgggcgcgattcacacggaaccaggtgcacttgaaaccggctccccactcaaccgggagattaccacagggaaaccgattgcccggggatccgtgacgtgattgcactcccctgtcaactgctg

SEQ ID NO: 522409 - DNA, 1604 bp, Homo sapiens
ggcggaggcttttggagctgctaaaatgccggattacctcggtgccgatcagcggcaagaccaaagcacggcatgaccacggacgacaaacccatccgagctctggcatgcagggggcctattgccttgcttgacaaacttactggtcagacgcaccttacctctagcgcacgactcaaggctaagctcgacagactgacacttcacgcacaccttcgtcatagaacatattacactgagcctcagctggctacttcacaagaactcttgaccaactggcccgtggacccacaccagtcacatcttgggcatcactggacttgcacgcactacacgccacgagcactttctcaagaggttgtaacaggcccattttaccaaaggtttgcccacgtgatgtaacaaaaacgacttcatttcaaattggcttgactttcagcgaacggggaacgctcagaatgacattaacaagttttaacttccaaaagccgattgagaaaatgatcaagcgctcttgacgccaatggcgtatataggctagcgcagtggagcaaacccttactaacgcctggcaacttcccagcgcggtttgcgggacaaactccccttaaacctttaggtaacccactttttcggcacaatgacacaatggtggcgaaactctcgaacgacaaccgcttggcgatgccccagattggaaggcactttacgcgcaccactcactttaagacaccttaactctaccacgagaccattttcggacaacaaaggtttcatccaacaaaacttcatgcacctactattcccacacatataaaaaacaaaacctagttgacaagcaccacacaaagatctcaatgcactgtaaccgaccccacacctcggaatcatgtgcccctcggcgccttgtctgcaaaaatggcaacgccagccaatcccgccttatgtcaaaactgcgcattggacgcccactctgtatgtctcacacggactcgggccaacatcgtcctcccgggcagacaaagcggacccccctggcacatacacacgtgcggaacagcagccccacgctccaccttacgcgtgacgagcacaataaccaaccttggcgcgctaacagagaccacggattagaaccaatctgtcagcaccaggagtccgcccacccctaaccttctacccgtttcctccgacagtcaccccaagaggtaaaacaccaccggcagcaaagagccggataaccaaaacaccgcgcgttattgtcgcgacacacgatcccgagagagcacctcacgacactccctcgcccgagaataggaccaacaggagcattcactcgtctggaagcaatcgcgattactaataaggagagaaccatggcacaacagcccaccgaggcgccaatggacacacgggtggtcgtaacaaccagacaaccagacaccgtctcctattgcgtgctgcgcgaccctagagttgtgccacagtaggaatatcaggtcccatccacagaacgtcacgcaggaaaagaccttctggaccgtgacgacgggggtatgagcacgcttataagatgttccaacgaacaacgtcatctacaacaa

SEQ ID NO: 522410 - DNA, 964 bp, Homo sapiens
  misc_feature (275)..(275): n is a, c, g, or t
  misc_feature (669)..(669): n is a, c, g, or t
ggcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtctgccggagcagctgcgggagctggaggccngaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccagtgctgacaaggagaggagggcccgactgcaggctgaggcccaggagctcctgggctaccaggtggacccaaggagtgcccgcttccaggagctgctccaggacctagagaaagaaggagcgcaagcgcctcaaggaggaaaaaacagaaacggaagaaggaggcgcggagcttgttgcattggcttgcagctgtgggcttcaagacccagcagnctctggggcacccaggctcctgaggctttgtccttcccaataaagctgctacctggcagtaccccttaatgaaaaaacaacaaatactaacaacaacctcaataaacacaaacacacacaaccaaacacaaaaacagtgaggaacataatacagagacagagaaacaacaccctacaacaacgaacaaaccacataacagttccccccacccaacaccctttttcaacagagagactaaaaggagtccacaaaagagggagcagataacgacgaacggaccatcacaacagacac

SEQ ID NO: 522411 - DNA, 181 bp, Homo sapiens
aggatcccatggagaccaggctgagaatacagtgtctcactgagacaggctgaggagacgatgaccggcgtccctggccccaggggtcgaagcatgtccaggaccagtcactcctataccctgagtcatgggccgggctctcatgcagtaatagacagccgtgtcttcagatctcaaacta

SEQ ID NO: 522412 - DNA, 126 bp, Homo sapiens
gacctgagactgcctcttagaagaaaaacgaagaagaaaaagaagggtgtcagcaccctttgcgaggagcatgtagaaactgagaccgggctgccatgctagcacggacagagaagtcacccagca

SEQ ID NO: 522413 - DNA, 1468 bp, Homo sapiens
  misc_feature (275)..(275): n is a, c, g, or t
  misc_feature (669)..(669): n is a, c, g, or t
ggcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtctgccggagcagctgcgggagctggaggccngaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccagtgctgacaaggagaggagggcccgactgcaggctgaggcccaggagctcctgggctaccaggtggacccaaggagtgcccgcttccaggagctgctccaggacctagagaaagaaggagcgcaagcgcctcaaggaggaaaaaacagaaacggaagaaggaggcgcggagcttgttgcattggcttgcagctgtgggcttcaagacccagcagnctctggggcacccaggctcctgaggctttgtccttcccaataaagctgctacctggcagtaccccttgaaggagatctgagtcactctcaaggtgtgtctcttcctgggtccccctggttcctcccccaatacttactagctgtggaatcccccacttggttgtactcaaaagggggagagtggactcttgggtcctgcctgagtaaatgagggcttcagatggggaggataatagggggggttgtaaagggcgtccaggtagtggacgatgtgagtatgaattacaacgtacgatagggtttgtcaatacataggtttatttacagataattataccattataaggatgatggggggagtgtgtatagagaaaagagattgtggtgactgactggtgggcaggctgtgcagaaaaaggtcttttgttacagttagtaatccgtaggttatttatgcttttggaaaagttgatatactttggggggagagttatactggagacgtttttaactagtgcaggggattgaccgatatcctctagtattaaaaggagtggggcaccaatgaggtgttagtcggatagattccctataaaggcaggtctagtagggccggtatcaccgaatagagagtaaagagctagttaaagtttttatgtaaagcgtgataaaaatgagaaggttggggagagagcggggaacaaatgcgttaaagtagagtagagcgcacaggaggagatcagcagattgagaggtggacaattagagaggacctctcaaaaagtagagcacatgtgag

SEQ ID NO: 522414 - DNA, 430 bp, Homo sapiens
ccccactgataactcttcatcatgacacttggacacaactgagtagctggcttctcttatactaacccagagttcgtcccttactgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttaactttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaa

SEQ ID NO: 522415 - DNA, 112 bp, Homo sapiens
tagcgggtctcatatcacgaacagcaacgcgaccaaaggtggatagtctgagatgctctcaacacacatgggcttgcatggaaccatatcaacaatggcagcatacaccaga

SEQ ID NO: 522416 - DNA, 405 bp, Homo sapiens
  misc_feature (65)..(65): n is a, c, g, or t
  misc_feature (184)..(184): n is a, c, g, or t
  misc_feature (283)..(283): n is a, c, g, or t
  misc_feature (392)..(392): n is a, c, g, or t
tttttgaaggctcagtgtgctttgtgaactgagttcttagtgtttagtggcaaggcaggcccgcnttttgcttgccttacaaggtcatttcatctctgttgtacaaaacacggctgctcctgctctacctctctgttaaagcaaagcaagtcacattcttgaagactggaatgcttactttttngtttgtttcttactgagaaccttgtataagcagctactactgccaccttcagctcctgatgatctgtgagccgggttctagccattctttaagatcctnggtcagactcccttcccttcgctctgtcagcccctcttaactattcctgatatcagacagcatgcagaaacattgtgcgcatgttgactcagatgctcctcagtgactngaattctttcagg

SEQ ID NO: 522417 - DNA, 532 bp, Homo sapiens
ggcggtaccagcggcatctctgatacagtaatgaaacaggcaaaaaagaaatcatgaaggtatctcatttataatagctacaaaaagaaaaaagaaaaaagaaaaaaagaaaaaaaaacccaacaacctaggaataaatttaaccaagaagatgagagatctctacaaggaaaactacaaagcactgatgaaacaaatcgaagaggacacaaacaaatggaaagacatcccatgctcatggattggaagaattaatattgttaaaatgactcttctatccaaggcaatgggtagattcaatgcaaccgctatcaaaacaccaacatcagtttttcaaagttagaaaaaacaatcctaaaattcatatggaaccaaaaaagagcccaaatagctgaagcaatcctgagcaaaagggacaaagctggaggcatcacactaccggacttcaaaatatactacaaggctctagtaaccaaaacagcatggtattgacctaaaaacagacacagaccaatgtatgcagagaatgctt

SEQ ID NO: 522418 - DNA, 1368 bp, Homo sapiens
  misc_feature (569)..(569): n is a, c, g, or t
ggcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtctgccggagcagcgggagagggagcagcacatcgcagagtgcatggccaagatgccacagatgattgtgaactggcagcagcagcagcgggagaactgggagaaggcccagtgctgacaaggagaggagggcccgactgcaggctgaggcccaggagctcctgggctaccaggtggacccaaggagtgcccgcttccaggagctgctccaggacctagagaaagaaggagcgcaagcgcctcaaggaggaaaaaacagaaacggaagaaggaggcgcggagcttgttgcattggcttgcagctgtgggcttcaagacccagcagnctctggggcacccaggctcctgaggctttgtccttcccaataaagctgctacctggcagtaccccttgaaggagatctgagtcactctcaaggtgtgtctcttcctgggtccccctggttcctcccccaatacttactagctgtggaatcccccacttggttgtactcaaaagggggagagtggactcttgggtcctgcctgagtaaatgagggcttcagatggggaggataatagggggggttgtaaagggcgtccaggtagtggacgatgtgagtatgaattacaacgtacgatagggtttgtcaatacataggtttatttacagataattataccattataaggatgatggggggagtgtgtatagagaaaagagattgtggtgactgactggtgggcaggctgtgcagaaaaaggtcttttgttacagttagtaatccgtaggttatttatgcttttggaaaagttgatatactttggggggagagttatactggagacgtttttaactagtgcaggggattgaccgatatcctctagtattaaaaggagtggggcaccaatgaggtgttagtcggatagattccctataaaggcaggtctagtagggccggtatcaccgaatagagagtaaagagctagttaaagtttttatgtaaagcgtgataaaaatgagaaggttggggagagagcggggaacaaatgcgttaaagtagagtagagcgcacaggaggagatcagcagattgagaggtggacaattagagaggacctctcaaaaagtagagcacatgtgag

SEQ ID NO: 522419 - DNA, 1631 bp, Homo sapiens
gccgggaaagggatacgtgcttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagacggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 522420 - DNA, 1499 bp, Homo sapiens
gggtgccaagttatgataggtcgagccgggtgttaatcgtgcacgtggcctggccgctccgctgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgccccttccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 522421 - DNA, 737 bp, Homo sapiens
ggccactcgagtgcgctggcgcctggcgaattaccgggtctcaccatggagcggaaagtgcttgtcgctcctaggccctgaaagaaaaggaccaaggccaggaaggacatagcccaagggaaattctgaaatctctagcgaccgagggctctgctccccattctgagagtgatctacctaggatgcaggacagaggagattctggggatctgatgatgatgagcgaagaagagtcctaatgagttactgtgaatggaggttatcatcttgtgaaaattggagatctattcaagtgggagatagcagtgtgatccgagagttaggctggggacactgttataacagtatggttatcatgggatagttcaggggaagaaagtatgtggcgatgaacagtagtagaaaagtgctgaatcattagagatggagagacagatactagatgaaatccggttgctgaagtcagttcgcagagttcagaccctaatggtccaaagtagcagacattggttgttcaagatactagatgacttggaacttatcaggagttaagtggaacccagtatctgcagtgggtattggaagctcctgggggcatcattcttgtcaagttggatcatccaaattccaatatatcaggggctgcccactgccgttgtgtcaaaaaagaacttagttcaagacacgtgtccacagcgttcttgatgtatttacatagccaagtgcccgtatcatcc

SEQ ID NO: 522422 - DNA, 334 bp, Homo sapiens
  misc_feature (289)..(289): n is a, c, g, or t
  misc_feature (313)..(313): n is a, c, g, or t
  misc_feature (322)..(322): n is a, c, g, or t
ggacatgaggttagatgtgcctctcttctgacccatggagaatgacagatgaggccagaagtttttaacagtgtagtttcagacaacagtgagaatcccgagaggagtcatatctgatactcgtatctgccctgtgttctgtaggctggggtcccgcttcatcttcagagacagaatccaaggctgcaggaacccattggcgtcacgtgcataggctttctgttaaaggggacatacatgtactctagtttttccttcaggggagctggtataggactgttcgctgtangttttttaaccggcacgagtgagngcctcttgnttcctcaacaac

SEQ ID NO: 522423 - DNA, 233 bp, Homo sapiens
ggctcagacagccaggagccctgggcgggaggagggagaggcccggcctgaccttgccccggtccaggacatgaaagacccattcatggtcgcagaagcctgggtggcagctgagccaccggtgggggtggggcctccctcaaggcctttgtccctgaggtctctctgcctagaacgtcctccccgcacacccctaccctcacccccctgcttggatctatggtccctctaag

SEQ ID NO: 522424 - DNA, 1172 bp, Homo sapiens
  misc_feature (40)..(40): n is a, c, g, or t
  misc_feature (42)..(42): n is a, c, g, or t
gtgggagactacagagttggggctccccaacccccagggntnaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 522425 - DNA, 1463 bp, Homo sapiens
  misc_feature (40)..(40): n is a, c, g, or t
  misc_feature (42)..(42): n is a, c, g, or t
  misc_feature (462)..(462): n is a, c, g, or t
  misc_feature (622)..(622): n is a, c, g, or t
gtgggagactacagagttggggctccccaacccccagggntnaacatgactcccctctgacaataatgggtgacctgtcacctgtttttggtatttgatatcttaaccccattctcccagagaatacaattcatggaaatttttacctaacttggcatggggttcatggagctcaggttaggaggcccagaactggagagctaaggcatacttcatcagcttagcacatgacgactgtctctccagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtgagtnaggggctatgatgggtgtccttcgtgtgccatgaaaatctctggcaagggtcacgatgtggaggacacctggggctgggtttcctgtcaagcccacttggcggagggtggccccagggctgcccattccttcctgtaccagggaccaggcctctatgctnactgagcctgggttgtgcgagaaggtggcagagctctccctcgtgccctggggactgtcctgggcccatgagctgatgagagcagagtctgagctgcactgccttatcatttcttcctgcccaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 522426 - DNA, 1464 bp, Homo sapiens
gggtgccaagttatgataggtcgagccgggtgttaatcgtgcacgtggcctggccgctccgctgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgccccttccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctgcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgttgag

SEQ ID NO: 522427 - DNA, 242 bp, Homo sapiens
gtgacttagaggatttcccgactagccgacaggcattcattccatcatcatctctccagccatcatgtgtcatcactccccctccctccagccttccatccatccatctacccacccacccatccagccatccagccagccagccagcgttccattccatccatccggcgctcaccatcaaccctaccatcgccgagggcccatcccctaccagcgagggccgcctgtcgggctagtcgggg

SEQ ID NO: 522428 - DNA, 195 bp, Homo sapiens
gttagggaaggctggtgcaatgacacgcgagctgtcattatatcgagagctagcgtcgacaagtgaagtacgggttgtcttgaaggttgatattctagttgatgtaaattccgtttcaatataggtagctgctatctatgggggaacctactaaactattagttaggcctacatattattgccgaagcttgatca

SEQ ID NO: 522429 - DNA, 1500 bp, Homo sapiens
gggtgccaagttatgataggtcgagccgggtgttaatcgtgcacgtggcctggccgctccgctgaggtgagccattggctggggtgtcggcgagtgtgttcgtggagcgcgtcctggggacgactcccggcattatcggccaggttgagtccgctcctggcattccgcggaaagatgggtgggtgccgggcagaggtgtggccacctgcgatggggattgacctccgaggggagggggcccttctagacgtcgtgccgtgggataggtaccttctgctccctccccgccaccctgcctcagatcagcacaaggtccttactgctgcccatctgacagttgggaacatcgaggcctgcagcggaggggggtctcatccaacagcctacaaaacccttatttgactctgtccccagtgagcacccccagctcttgcctggtttcccgggacactagggtggggcctgaggagtggagtggcagctgaccctgtctgtgccccttccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttgggtgtgagaggtccttgttaggcgtatagttctccctacgtcatcctctatccttcttctttcaacctggcccggctcttgccacatttgtctcatcctatggcttaaggcctgctggctaatatgtgatctagcttttgcttttgcttctttacagtcttgttcccctgtattttctattttccagctttctttccttcgtgtttgtctattttcctagctgtctcagttcgtctagctacagggttaccctcttcgtataaatatcttttaatacctttgtctcctattgccattatatgcttccttcg

SEQ ID NO: 522430 - DNA, 232 bp, Homo sapiens
  misc_feature (107)..(108): n is a, c, g, or t
  misc_feature (110)..(110): n is a, c, g, or t
  misc_feature (113)..(113): n is a, c, g, or t
  misc_feature (159)..(159): n is a, c, g, or t
cctaggattttcatgtgtatgggcttttcaagtgaattttgtatacagagcaaggcgattactttaaaacatgaaaaaaattagcgctgggggttaaaggcaaaatnntnctntgggctttcctctctcctgatgagatgatgcaaatggactccatanagaaacgctgcccgtgtaacaatgcagttacgcaacccggtgcatgacacatgaattgcagcgcacctgaaat

SEQ ID NO: 522431 - DNA, 129 bp, Homo sapiens
cacagagccgtgtctttcccaatacatctaagcatattcctcactgtttatctcttgtctgtacaacatcatcaaggcagaaacagtttcccaacaggttatattttctgaatgcgtccgtcgaagttg

SEQ ID NO: 522432 - DNA, 943 bp, Homo sapiens
cttaattatgtaagagatgtatccgcattctggctagtattcatcatcgcatcatgcgaagcacacaagctatattggtctggttccccagtccttgtaccgtcgtcaccgtctcataacatcctgagcgcctagatactaaactatctgaccttaatgaggctcactctccactgatggtctcgtctcagattggctcaatttattcacatgaggaaaccacagcatgaatcgatcgtataagcatgctcttatcaccttctcattattaccctaagaatttctccccattatcgtatctcgcttaaatttaatatcttttacatagttcaatggaagaagtaatagatgtcctactacttcttcctgtccgaaaaaaacctacctacaattactgccccaagcgcattgggtctaatcgaattcgatctcaccggagtgtacggcgaggccacaaagctctatgagaccgccattgaagatcagcgtgtgtcacaactaacatattcattcattctcataacgatgcccataagatatggggcgtacgcacattttcacgctcattaacttccaatgcggaccactgaatttctcaactaacattcaagcatatcatccacataaggggcatctacattatcattaaatttcgtacttcacatcatgtacttaacttgtcacatagttgactatcagagggcacatgagccgacacttttcgttagaatattgactatgacgtggttgaaatatagtcatctatctatgtgcgagattactcatcaatcatcgcgtagtcgaaattttatgaccagcgctagaagcactcgtggttggtaaccccccggtgtggttgggttaaaaaacgtaactttgaccggcatgtatctaatggggtacctatggcggggatcatgggaaatggtagggcggtagaaca

SEQ ID NO: 522433 - DNA, 227 bp, Homo sapiens
cgagagacgtgttgcagtgtctctccacatgtagtagtagtgacttgaaataggaacacactcttcatctcaaagtcaggcctcagcttctgccgtggggacctgacatgctgcgcaatggtctgcagagacgtatttccacaaaagggaaaccaatacagaacacttcaggcccacgagtcctagcttgggtgaagtcacctggttgccccattgcaacacggtct

SEQ ID NO: 522434 - DNA, 198 bp, Homo sapiens
acagcaagcaaggatccaacttctgcgggaagcaataacagtcccgcggttaagtgttggttcagttactagcagaacaagtactcccacactaggcacaccaagcccacagaccatgtctgtctcaactaaagtagggactcccatgtacctcacaggtcaaaggtttacagtacagatgcctacttctcatgtcat

SEQ ID NO: 522435 - DNA, 519 bp, Homo sapiens
  misc_feature (454)..(454): n is a, c, g, or t
tagtaaaaataaggttttgggcttgttgcccaggctagtcttgaacttctgggctcaagaaaactcttgccgtgttttgggccctcccaacatgtgcgtgggatttgcaggttgttgagccaccacgttcgtggcctttgactctgctttcaacacttttagcctcttctagaaatttcagaaaaagtggtcatcggatgttcaccgcctgtggaaccctttcttgtgtgggtgggctctcttatacgtggtaagtgcctttgtgagaatttcactctgtggtgccgtgttgagtgtgctcctcgtgcagctccatctcctctcgtgtgtggagtgtgtttctccagtagtctccattctcccctttctcacgtgggcgtgaagtataggatattctcactgtggtattacattttatttccacttattttgtgctctccattttcacataagnatttattaacacgagcttggggcttggcttttcaacaagaacaaaacaaaaacaacaaaagaggg

SEQ ID NO: 522436 - DNA, 730 bp, Homo sapiens
tctatgtactatgcccatgtggttaatcagtcacgattgccacaaccctgacagtgactccacgcctgcgcacgctgctgctgactgcgtgcatggatacatgctgtgaccctgcgcacccctgcggtgacccctggagtgctcgggctggagccctggagagccctgcttgaaactggcttcccccagtgaagttgagtggccaaacaatggacgatagccagagggctgttcccatggagccaggtctgttggcagatctggcccatattcatggccagtgggcacttgtgagtgaacagacacctcgtgactgctgctgaatgaacatcctactaactgccccagaatcttccatcctgatgcctgatgtcggtagtgaatgccatgtgccatgcacctgcatggctggtccaaccctccagacaagatgaagcatgttgctgtgcagccttggatgctagcaacttcctgatgctcgatgccccccacaaatcctggactccagtgtctgctgtgcccctgtgccaggatgtgaaacagatggcttgacgactgtcagttgtttcatgcatgggatgtgtgaccaggagctgtctctctcccaagagcctcaagggaatgcttgatgcctcttccctcaccagatccctcaacctgacctttgccacacctcttcagccacagtcagtgcagaggcctggctttggcccgcagactccagcccgcg

SEQ ID NO: 522437 - DNA, 441 bp, Homo sapiens
aagtatcccccacgatcgtctcagctactccggaggctgacgcaggagagttgcttgaacctggtgaggcggagattgcagtgagctgagattgccccactgcactccagcgtgggctacagactgagactctgcctcaaaaaaaaaaaaaaaaattaccaagatcaatttttacctccgctgggaacctcttgtaaggtgccccagacaagatttgcaccagaggctttctgtccgcggcggttcttgaccggctctgtgaaccatgctctcctttcccctgaagaactcctcaggcttgtccctggtggctcacacctgtaaggtgccccagacaagatttgccctgagggctttctgcctctgaggacagcctttctactgctcctcagctgcacctccccacagagagagcgtcagctgaggaccatcgttggggtc

SEQ ID NO: 522438 - DNA, 305 bp, Homo sapiens
tcgtaatgatgtatagagtcatgtgtctgatcctacaaaagaatgagatggagattttttattttattatattgtattttttttagggttgcccccacagcatatggaggttcccaggctaggagtctaatcggagctgcagctgctggcctacaccacagccacagcaacgccggatccaagctgtgtctgcaccctacaccacagttcatggcaacgccggatccccaaaccactgagcgaggccagggatcgaacccgcaacttcatggttcctagtcagattcatttctgctgcaccacga

SEQ ID NO: 522439 - DNA, 455 bp, Homo sapiens
ccctcggctgcaggttcggcacgagagagagagagagagagagagagagagagagagagagagcgagagtgacacactgcgcccgacatatctgagcgctactcttctacaccgggtttcctcttcttctcctcgctgttctctctctcctgccctcatcttattcacctgcctccctctcctcttgttcttccattccctgtctgcacctccttcccctttccttctttctgccattttctcctttgcttttcctcctctccgttattccttttttctcctccatctctctccttctctctttcctccttcgtcttatcccctcgcttttctctctctcctccttccttccccttcccttcctatccttcctgttcttcccttgtccccctctctcttttcggttccctttccttctcttctccttccttcctcttcctctccctttctctcct

SEQ ID NO: 522440 - DNA, 568 bp, Homo sapiens
taagtggggtgatgaggaatagtgtaaggagtatggttatcattggtttggaggttagttggattagtcatggtggggtggtgattaagtcgggtggtgtgatgaaatatttgggaggtgggggatcaatagagggggaaatagaatgatcagtactggcgggcgggtaggcctaggattggtgggggcaatgatttgaagcgaacagattttcgtctcatttgggtctctcagggttggttataatttttaaattcttatatggggctttgggtagacggagacggtacggtgggtacgttggtggttataatattttatagtggggtagactgaggacatacgtggtacacggagtactgggggtacattattggtggggccaataccggtagtattcagtgggggcatgggatgtagggtgtcagggtaatggtgacggtaagtcaaaggccaaatggtggtgggaaattggaaactatgtagggctaggcccacgggtggtttcagcagggggcaaagactagtatgggaataaggcccaatattgggctcaagagggagtggg

SEQ ID NO: 522441 - DNA, 395 bp, Homo sapiens
cacctaccaccggtattggcgctcctgtttcccggcggggcggaggcgcgggtgtacgacatgtaccggagtgattctcccaagggcgcgttttgcgacgcgatcggggatgcgtgcgtggcggacctcgcggtggagaacgccttcttccagaatcccgccgtgctggccaccggggaaagcgactggaacttcgacggcgacatcgcggccaagaccaacctcgagccgggatccgatcccggaaatctcgtcacggaaacggagtcgaacgggggcgtgggaatttccacggggaggttcggggtcggtgcgagcatgagctggcaaaaagacgccgtggaaggaaagctgctgatcttcgacgaaaacggaaacccgctcaccgcgcgcat

SEQ ID NO: 522442 - DNA, 968 bp, Homo sapiens
taagggaccccttaccttccggctcttctcctgatctgccattaaaataatttatggtccaagtgatatagctcaacaacctcaataataactccctactatgcgctagcaagggaagtacattacgagataagttgttcaataatagctagtttgtgattaacgcggtccaagagccactcgcgtcattatgggaaataatgggtggctacttagagaatactcaaggtgctttgacagacagtgggaaaggaatttggtcgagagattaaaaaaatgaactgaggtgtggaaatctcgaaaggtgtatataggacatagacataaggtgcttaaggctagacctactggagtttgcttacacaggaggtccgctccgcaggcaccatcgaatattaacaaatccactgccccttggacggtgggccaaaaccacgccagctgtacttgctgacattcgatcggacaacccacccagaagcgcttaattacattaaggcactcattcccctcgtacactacttctctcgcacccccacacggtccagcctcaccaacgccttatcttaggcttggtttcgccccaaacgcttttgccctccgaaagccccccttacaaaactcccacttaccgtaaatatctaaatgttaagccttgcatgcttagcgcctcaccaactccattgggcaacaggccagcggccatctttaatcccaagtgaaacccacgtattccatcgacacagacatcctaccttgctctaattctaattctgcccatacacaatttgccgttaacttaatacctgtcaccaggcacgagaacctcactcatattgcatcacacgtctgacgaaaacacgactgtatcccacctggctatcatcagccgacgtaggaccaggcataacgcctgatgcagggcaatctgcccatttacaactgatatggcccttcctactctgccg

SEQ ID NO: 522443 - DNA, 131 bp, Homo sapiens
tgtagaacgtacttctggtggtgcactgtgctggaatccttgcgtgctgccctcagtgagctgcctgccttgaaaggcatggcctgtctcctcacttgagttcagggtccatcgaccacagccctgttctg

SEQ ID NO: 522444 - DNA, 474 bp, Homo sapiens
cgcaaaagttaggtcatgaaagctgtccaattgggccccctttagggtaagacgcttcgcccggcgagttacatgggccagttgagtgtcagccctctctatctggaaccttgattccagtaccttatccattctcaggatgaacttgggtgctcaaagttctaaaacccctttagcgttgcatttcacccccgggcatggccgtccctagttgttcttgcggtcacgcacccaggggtcgctgagagccccctcttgggtggttaaccgtctcccttcaatcacacctgtgccaacaatgttgtagggccgccgggcatacgccttcctaagttctgggtcggtttcgtccggtttcttggcagggtcagctggattaaacgtcagcggcgttccgctagggctcccggtgtagaggctttgtatagcattctctcacctccgccccgccgcgagatcctctcgcggccccct

SEQ ID NO: 522445 - DNA, 499 bp, Homo sapiens
cctctcatttcctttccatcatggaaatctatcctcaaggagatcacttctcagtgttccatctgctattctactacccctcagggattgttcaggtcccctccctttcctacacatcaagctcgaagatttgtccctgcccaggactggcaaattgacttaaatacctcttagtctagtcctcagtcttcaggaaaggtagaacggactaatggtcttttaaaaacacacctcaccaagctcagccaccaacttaaaaaagactggacaatacttttaccactttcccttctcagaattcaggcctgtccttggaatgctacaagtcatactcctattcaccgttctcagctactcatacatgccctgctcttgtttacactgccggtttacactgtttccccaagccatcacagctgatatctcctggtgctatccccaaaccgacactcttccactcttgaagtaaataaataatctttaaagaaaggaaaaaaaa

SEQ ID NO: 522446 - DNA, 370 bp, Homo sapiens
gtcatttagctcttcctctccagggacatcgtgcactttcagattttctcattactcagccacagaatcgccaccacctgctacacacatgcacaccggggggtgacttaggtttcgagagtaggtgtcccccttctctccaccttgaccccctgcttccctcaacttaattttcatctgtacaatcttcagcacgtaaagggttgaaggaaaagccccgatgctgcacggtcagctcaccacaccccgtttacaccaaggtcgcgcgcattttacaggtgttccgataccgtgggaggctacgtcgtctgcctcgcatattgggttacaggggtgaactcgctatgttgggcacgccacctgttgtacc

SEQ ID NO: 522447 - DNA, 356 bp, Homo sapiens
tacctagaggatcccgtgccccctgtggattgtcaggcagcatcaggtgatggtcaggcggttgttatgctgcctctctaaaatagacacacctgaagctggtgattggcagcttcctgataagattgcaggagttgggcaagtagactcaagcacatgcactaagaggcaaaatggtggagttaactagtctatgaccttcctctaggaacactcaactactaaggggaaaatgcctcaagggagcatgtgcacagcttcagtgaacactctgcgcacggggcccctcccaagtgctgtgcgggcacactcctgttgatagcccacccccagggaagaatccaaggagaagggag

SEQ ID NO: 522448 - DNA, 176 bp, Homo sapiens
gaggtcttccggaaggcctcctctctcccccggtgtggatccgctcgtgggagaagccctacgcgtgcggggactgcggcaaggccttcagccagaacatgcacctcatcgtgcaccagcgcacgcacaccggggagaagccgtacgtggtgccccgagtgcgggcgagccttcag

SEQ ID NO: 522449 - DNA, 137 bp, Homo sapiens
ggggcccctttcccccgaaaaaattaaattggggccccccttgggtttaaaagggttaaaattcccccgcctttttttaaaagggggagggggggcccccaaaaaccccttttttaaaaaaaattccccccctttta

SEQ ID NO: 522450 - DNA, 130 bp, Homo sapiens
caacaccattctggcactcaaaaaacggatcagttacctgcttcaccatgatatattctgggaaagcgatcatctaatgaagtgaagaacgtgcacccaagggaacacaacagtagatgagttaatgatg

SEQ ID NO: 522451 - DNA, 428 bp, Homo sapiens
  misc_feature (81)..(81): n is a, c, g, or t
  misc_feature (123)..(123): n is a, c, g, or t
ggccccctttttatccctctcctagacacttggggcgggagaaaaagggagaaacaagccctttcccctcccttcacccantcccccgggctttatcaaaacaaaacagcttacccctctcancctcccctacccaattataaaagaaatacagttgctccttgacttacaatgggattacatcccaataaacccattataagttgaaaatattatgtcaaaaatgcatttagtacatccaacctactgaacatcatagcttagcctaccttaaacgtgtgcaggacacttacattagtctatagttgggcaaaataatctaaccaaagcctatttcataataaagtgttgaataggcttatttattttattttcatttatttatttatttgtctatttttgagacagagtccagcctgggcgacaga

SEQ ID NO: 522452 - DNA, 90 bp, Homo sapiens
tctgaggacacggccgtttattactgtgcgaggggtccccaggagatatggtatgatgttgccgatcaatttgaccactggggccaggga

SEQ ID NO: 522453 - DNA, 263 bp, Homo sapiens
attactctagacggcatggttaacattccacgaagaaaaataacccactgcttttccctaggaacagaaacttggcgtcatggatgtcaaaggaacctaatggttggttctttggaacagagcaactgacgctcaaagacaatcattttgttgaaagatcaaacataccaggccaggcattgtctattgctgatctctgatcataatctctgatcaggtcatctgctgatctctgaacataatttacccctaagcattaattt

SEQ ID NO: 522454 - DNA, 1681 bp, Homo sapiens
tcccaaaaagggatattttttttatccaaggtaagcggcaaattgaggaaacaccagaagagaggggagccccgagggggggcacaaatccgagtggctatacccctctccccaaacgagaacacgaggggggagggagggtggcccctaacaccctttatagtgggtcgaatcggggccccctgtgggatccaactctcgtgtgggtgcgagcaactcctatgaggggcgaggggccccacactcttctccgcgtgggacacagggaggatagctcgggctcacacccagagctctgtgcgcaagtgcgccacaagagcgcctctcttctcccaccacaagagagagagtatatctgtggggggagacggggctactgcgtggggcccagaacagcgaggagagcgccacagtgagacggggagtgcacacccttgtgtggcgcgccgtggtaatagccaagccgagccagagtgaagcggaagtggctccacaaacaagtggggacacctgtggggacacacaaaaaaacacacaccaacaacagctgtgctcccgagagaggctataagttgtcggggacacacgagaggaggcggcacacaaggagtggggacacacgccgagataaaccgtgtggggggcgtgcgccgaggggtacagtgacaccccaaggagaggggggggagttttgtgaaaaacgcggggcccgagggggtgaaagcccatcctgtgggataaatgtggggggtcgcccctacatttctgtggagggacagggggcgcagaaaaaaggtgcggcgtagcaagaggtggggggggcagaacaccaccacaacacgataacggcgaggcctaaacaggggagacaacaaaacggccccccaacaagacccccaaacaccctacaaaggggggggcgggggcaccccacaagagggtgcgcccctaaggggggaggacactcacaaccgtggtgggaccccaaaaaaagacggtgtggacacggctgcgaaattctacgcaaaaattacaaccccaacaatatagagttggttcacccaccgagaaaactcccccaaggggcgggggcaaggcgcaccaagaggaggcgggccctggcaggtgcccacaagggtgaaacaagaacggagcgagcaagtgggggaacacctacccacccctatcggggaccactactccagtggtatgcccccgaaaagggggggggcgtgccgcaccaacccaatatgacgacggggggggcaaataatgggaaacaatgtggggggacaatggatgataacaaacatggtggggtgccccccaaggtgtgttaggtacaaaacaaaacaaagactggtggtgggggggagcaaacactgtgtgggggtcgaccacaccccccccccctgttgtgtgacacacccaggatgtatgcgacgcgaccatctgacatgaaagcgagtcgcgcgacaaaaaagaggctggggggcccccgctaagcgggggggaaacacctacggacgcccaacgttgataaacatcagacaaataatagtatgagagaggatgaggccggccacacaaacaagcagtgaccaaccagaagtagtgacacagatggtcggagttgaatgatcacacgagagatgatagtggaaggaacgaagaacaaaca

SEQ ID NO: 522455 - DNA, 375 bp, Homo sapiens
ttccagcttgatttcgttcacgacccaacgctcatgcaggagcaggttatttaatctccatgtatttgcatggtttggaaggttccttttggagttgatttccagttttattccacagtggtctgagtgagtgcttgatataatttcaattttcttaagtttattggggctcattttatgacctatcttatggtctatcttggagaaagttccatgagctgttgaatagaatgtgtatcctgtgggttttggatgaaatgttctgtatatatctgttaagtccattttttccaaggtatagtttaaatccattgtttctttgttgaatttccctcttgatgacctgtctagtgctgtcagtggaatattgaagtc

SEQ ID NO: 522456 - DNA, 123 bp, Homo sapiens
gcggattcgccatcgattttcaaaatggctgcagctcctcaagcacccggggcgggggttctttccgttaaggacaaggccctcttggtttttaaggacggtgggtttggccaacccattcca

SEQ ID NO: 522457 - DNA, 241 bp, Homo sapiens
tttgaaagtatatttctttcataaatgcagtcctataataaaacgaaatcattttgtaatattgattttacttgttttagatttgcttcaaaatatagagaagtgggagagtggatgggattgaggttgaggcaggaatggtcatggtgagtcattgttggggccaggtgatggatagatggtgattcattatactatatgcttactttttgtatatttgaaataaaccaattaaaagttg

SEQ ID NO: 522458 - DNA, 1878 bp, Homo sapiens
  misc_feature (1878)..(1878): n is a, c, g, or t
cgtgacgcggggctcccaccccaagccgctttcacaacactccgtttacttaccgtaggtttctcccctcacgccgcccagtggcgagcgacacggctgcggacgcctaacgccgcacacaccgagccgcctattcccgtagaatactcaacacacaccactcacctcacctcaggatacaccatatgatccaacgacacccctgccctccgccgtacacacaaagaactctcactcgcacgcactcctaccctcctcccacgcaggccgcaccaactccaaacaacacaaacacaaagaaaaacaaccacaaccatcaccaatcaacacacacacaaacactataaaaaaaacaacaaaacgagaacacacacaagacaaacaaaacaaacggaaaaacacaacaacaacacccaaacaacaacacaacacatcaccaacaccacccaatcaccacacaaaaatcacaaacccacacctacacacaccaaccacaccaaacaccctaccacccaaaccaacaacaactccaaacaacacacacaacaccatacatactaccctaccctcacaccataccacacaaactacaaaaactacacagctcaaaccacacaccaagagagaacaacaaaacacaaaaaaaaaacaacaaagccacagacaaaccgagccacacaaaaaccaatacagcaaccatccaccaaaccgaacatcatagagacagcaagacacaagcaagacacgccacccaaaccagcaacgctaagcacactcatataccaaacacaagccaccaccagacagaccgacacacacatcacccgcaacacgaaacacggcctagacactccaaaaccatagcataggatatccagcataacagaaattatgtacgacacttgagtctgctactcactataatatatacggctcaccagcgtctatctactcgacaagaagcttcagcataaacgaagcagcctacaacgcgagacgcaagtaccagtacgcatcacatcaagagatcaagcttacctgcactacagaccaagtatcaatgactcatcacacaagtctgcatcaagacagatatacaacgcacatgaacacgcgcgacaacgccgctaacagctatactacccaacaccaatcaccaaaatcacactacaatcactaacataatccacacattcaaacacaaactactacatcacatcagatataacataacaatgacaatacaaccatcctacaccacatcaaccaactcacaaacacacaaccacatacaacagataatcactatccaatctaaaatatcaacacttatcctaataacacaacaacgactacataccactcgacccttaccaaatcactctaaccgctatacacatatacaaatacacacgtcaaattcacaccatacataatataacatccaacaatactacactacaataccacaccaactaacaaacacacacaacaaatccatacacacaaccttcaacacgaacatacactatcaatctcaacataacatcctctatcactccttccacatcaacttacacacaatcacactaacatatctaacatataatatacacactcaacactactacaaactaaacaaacaaccatcaacccacactacacaatctacaacacacagacacttatacacttacacactaccactcaacacacaacaaacaacacactaatcatacaaatcacatatatattataatatacagacctattacacaattacactaacacaccacgaacacacatcacacactaatcatatcatcaactaatacacactacactaactcactacacactctcactcctaaatcacan

SEQ ID NO: 522459 - DNA, 826 bp, Homo sapiens
gagacgttcttcgccgagagtcgtcggggtttcctgcttcaacagtgcttggacggaacccggcgctcgttccccaccaccggtctggctgcccatagcaatgacctccgtcacctcttcacacgcaccctcggacgtgacccaatggccacacccgccagactgcatccagctgcctgatgcaagccacacgaacaggagacccggcagaacatcatccattagatccgccgaccatgaacgaccgcgtaccacactcgacaggtgcgccagaaattaccaccaggactcacgaggccgacatacaaccgccaagatcaagcctggagctactacgcctcctaccgtttacctgtccactgtcttactacattatgaaccgcagatgactgtggacgtttgaaagaaaactttgccaagactacctatactctcacccacatctccattgagcgagaagggacgcactgcctgcagacacccacgactgaaaagctggctgcaacccagaccgacggtggacacgcactcttcactcccacgactcatcccaggaaaacgcacccagaaccgcgggggaactgaacctggggccacaagaacggcgacatgcacagctgccaacgcggaacggaggtgccagtgacccctcacgcgaccgccacaaaccggcgaagatcaccggcccagccaacgccgggacaaacgcggcaccacacacacaggcagcccacaatgaaccgcaacagacacaacccccgaagaagacagatgccatccacctccccataacccccataaccctggaaatgcgccgcgcgcgcac

SEQ ID NO: 522460 - DNA, 308 bp, Homo sapiens
  misc_feature (298)..(298): n is a, c, g, or t
tgtatgtcagaaagcaatgtaatagatagaccaagcacagtggctcacacctataatgccagcactttgggaggccaaggctggaggattgcttgagtctaggagttcaagccgagcctgggcagcatagtgagcccccatctctacaaaaaataaacagaatttgccagacgtggtagtgcatgcctgtagacccaagtatttggaaggttaaggtgaaaggttcgcttgagccctggaagtcgaggcttcagtgaggcaagatcacaccactgcgctccagcctgggagagcaagnccctgtctcc

SEQ ID NO: 522461 - DNA, 273 bp, Homo sapiens
ttagaggatcttgaaaattagcgacggaataattcgctgtggaatctgaatggtgacaagagtgaaatttatggtcttggaggaattttttgatcaaaacattagagctcccaataaagtagagagaaggttaggttgatctgaggaagtgaaatattgatgagtaatgattgagaaaattaaatgaaattaaatagagggtgcctaagatagcgtctggtacaaatcagccacttagcaagcagtagttcagttctctttccttccgagatg

SEQ ID NO: 522462 - DNA, 307 bp, Homo sapiens
  misc_feature (3)..(3): n is a, c, g, or t
ggngcaagaacttgattgtaaggagaacgatttactattttttatcaatattctacaaaacctgtctcttgtgtgacccatgcgacagaggtgagtcttctctcctggactctccagatgcctggacaagattacttcatgatataccatgtttcccagttggctcatgggaaatggtaatcttggactgttgtttggtagaatcaacagctgcattttaaactcgaagttgctctaaatattccctgccaagagcctcgtgtcctgtgagagcgactcaatgagagtgctcagctgttaaatacct

SEQ ID NO: 522463 - DNA, 100 bp, Homo sapiens
aggaagtctcgtggggggaaactggaagatgaacgggcggaagaggagtctgggggagctcatcggcactctgaacgcggccaaggtgccgaacgacacc

SEQ ID NO: 522464 - DNA, 174 bp, Homo sapiens
gacttatgagtgatccaggcgctgttacggaggccctgttacggaggcgcgttcgttacggaggccgctcgttacggagggcgctcgttacggacggcgctcgttacggaggcgctgttacggagccgctcgttacggaggcgctcgttagggcgctcgttactggagtatccg

SEQ ID NO: 522465 - DNA, 375 bp, Homo sapiens
ggaaccaaaaaggcatcatagaagcaaagacagcacaagatttcatgaagaacgaagagtacatcaagaagaaccagtaggctatggtgtttgcagcttctggagggaggggctgctgtggttaactggcataactaaccctgactctcctggctttccctcccagcctggtgcagtgagcaggatgtcatagtcagcggggctgaggggaagctgcacttcccagaaagcctccacctatattatgagagcaagcaacggtgtgtctggaccctgctggtaccagaggaaatgcatgtgttgctcagtttttcccacctagatgttgagtctcgtcaccacgtcgaaacggccggaatttagtagtagtaggcg

SEQ ID NO: 522466 - DNA, 879 bp, Homo sapiens
gggtgttcctctcagccccgattcttctgagaacaggtgaactggcagaacagcccctgcgccgttggcccagacgcagctctctgtgttgcgccctatagagcctctgtgccctcagttccgtcctgctcttggcaaattccagaccctttcagaaagtggcctgaagccctatagtcctcgtccgtcactctgcagctccgcgaaaatacagaacaactttacggagtgcttctcttgtcgggtggtggtggttgttgaatctccgaggagagtttacagagaatcgattgctccgaccgaaaatgatgaatattgagcaattcctcccataagggggggcggactgtgacttatgtcgccctggagaagagcgccgcgaaacgagccaagggtcactagcccaagcgatatcaggtagcgcgaggaggaggagcccacatgacaacgaggagggcaagatctaaacaggaacaaggagggcggcgatcgtcgtagacaatgagagttcactgcaacacgtgacagcaacaaggtggcacagagtgaggaaaaactgtccatggcgtaggacgaagggaacgccgtttattaatcaagggggcggcgggggagggacacacaaattagggagatgggcgtggatggaccaccatgtagagaagggtaattgctagccggccgtaagagggggagatacgcaatttacgagaagtctttgcgtcaccctggtgatacccaccggtagtttgccactaaaccgtgggaattagacggctcttaccgtatttgagcccatgtcggcgctaccactggggaagttcacttctaaacacagacatttagtgacccccagcacggtgctgaggatataacggt

SEQ ID NO: 522467 - DNA, 339 bp, Homo sapiens
  misc_feature (279)..(279): n is a, c, g, or t
gtgagttctttccattttagagccactaagaacaattgtgattcatgggaggaggttaacatatcaacatgaatcacaattgttcttagtggctctaaaatggtgagttctttccataaggttttcaatttactttgcccagatccattagaggaatcgccatctacagcagctatagccttacgaaatgtatttctgaatactaagactgaaaagttgaaattactccttgatccatgggttgcagaatggatgttgtgttagcaggcatgaaaacancattcatctcttcgaacatcttcctcagagatctcaggtgcattgttaatgagtagtaat

SEQ ID NO: 522468 - DNA, 414 bp, Homo sapiens
  misc_feature (5)..(5): n is a, c, g, or t
  misc_feature (41)..(41): n is a, c, g, or t
  misc_feature (63)..(63): n is a, c, g, or t
  misc_feature (157)..(157): n is a, c, g, or t
  misc_feature (210)..(210): n is a, c, g, or t
  misc_feature (217)..(217): n is a, c, g, or t
  misc_feature (303)..(303): n is a, c, g, or t
  misc_feature (319)..(319): n is a, c, g, or t
  misc_feature (344)..(344): n is a, c, g, or t
tgtanccggttccaatctcacacttgcctataaagaaaatnccctgagactgggtaacttatnaaaggaaaaaaggtttaattggctcatggttccaatgggctgtacaggaagtatgacttggggaggtctcagggagcttttactcatggcaacnagcaaagccagagcaggtatcttcacagggctagagcaagaggaaaagagagnggggagntgctacacactttttatgcaaccaaatctcatgagaactctatcacgagacagcagtagggggacagtgctaaatcattcatgagnaactacctgcgtggtncagtcaccttgcaccaggccccacntcccacattggggattacaattaaacatgagatttgggtggggatacagatctaaactgtatcattactc

SEQ ID NO: 522469 - DNA, 1069 bp, Homo sapiens
gatacatgtgttgccataatgacatctcatatgtgtgccgtcgtctttgcacaaaattatgtgggctcttcccccgctcatgttgtggtgtccctgcccttctttagccccgaagctgaaatgtcgggtctcacaaattgcttctcaagaaaatcgtttgagccccctttctttgcaggacctatccagggaagaaaatggtgggaagccgggcgcccctgaaatggctggcaccctgtccttaaaagacttatggccaaggctttttggcaggctcatttggttgggtttcccccaggcatcccttagttccccggatcctctgccaagagtagctcattggacctgagcacagcgctttcaggaggactgtactggttgttcccccggaccacaagagagtcacttttgactccatcaactttcaaggggacagagcctaggcagcagattctcctaatttttaaccctgaaattcaaggaaccagtggaggaaagaatgccttactacccccgatagaaataggggaactcatagaacttctcgactagtacctgtcagctctccaaagcacttcttgtgtctttgcttgagctgcccaagaagggtcaccacaagctgttcttcctccactggaagaagtgccctcggggttgacacgggctgcaaagtgacacactgcacctgaatgaccctttattttttggctttggcttattatttagcacctgggaggcccacggggaaattggtgattacacgtagcacctttgggaaagttaaagccccccttgggcttgctttggagagatgatggcacatgcttggtattccactttggataatcacggaagcctccctagtccacatccactattgtgtcacgaggtgggagttaaccacacccctggaaagagtcccctgccacaaaagaagtagttgctttcactggaaatttcccaaagcttttggatttttctggatcacagtaacccacctttttataaacctcgaggtcaaggagttcgagaccagcctggtaaacatggtgaaaccccgtttctatta

SEQ ID NO: 522470 - DNA, 331 bp, Homo sapiens
gtactgccactcatagccccacttgcccacgcgagccacgcggagcggcggttgaagcgggtatcttgagagcaagatattgaccgtacccttattaactggaagccgcaaaggaaggaggagtcgtggctgaagttaatgcagtagagggtggcagggtcagtgcctcggcgcagctccaccagtttctccttggattgtggtgtcaagaggcgaataagggtacccttctgggaggcttgaagccactacagtgcctggcttgtttagagacacacaggctatgtcactctgattgtgcattgatcgtgaatggagcagacgaggtgcc

SEQ ID NO: 522471 - DNA, 786 bp, Homo sapiens
  misc_feature (14)..(14): n is a, c, g, or t
  misc_feature (120)..(120): n is a, c, g, or t
  misc_feature (144)..(144): n is a, c, g, or t
  misc_feature (206)..(206): n is a, c, g, or t
  misc_feature (224)..(224): n is a, c, g, or t
  misc_feature (233)..(233): n is a, c, g, or t
  misc_feature (251)..(252): n is a, c, g, or t
  misc_feature (254)..(254): n is a, c, g, or t
  misc_feature (260)..(261): n is a, c, g, or t
  misc_feature (309)..(310): n is a, c, g, or t
  misc_feature (315)..(315): n is a, c, g, or t
  misc_feature (331)..(331): n is a, c, g, or t
  misc_feature (356)..(356): n is a, c, g, or t
  misc_feature (360)..(360): n is a, c, g, or t
  misc_feature (365)..(365): n is a, c, g, or t
  misc_feature (367)..(367): n is a, c, g, or t
  misc_feature (394)..(394): n is a, c, g, or t
  misc_feature (411)..(413): n is a, c, g, or t
  misc_feature (415)..(415): n is a, c, g, or t
  misc_feature (417)..(417): n is a, c, g, or t
  misc_feature (430)..(430): n is a, c, g, or t
  misc_feature (434)..(434): n is a, c, g, or t
  misc_feature (451)..(451): n is a, c, g, or t
  misc_feature (459)..(459): n is a, c, g, or t
  misc_feature (497)..(497): n is a, c, g, or t
  misc_feature (508)..(508): n is a, c, g, or t
  misc_feature (553)..(553): n is a, c, g, or t
  misc_feature (563)..(563): n is a, c, g, or t
  misc_feature (675)..(675): n is a, c, g, or t
  misc_feature (786)..(786): n is a, c, g, or t
ctcaggcctaaganggtagatagatatatgaggcaaggaacccaaaggcactgtgcttatcataggaactggagagcaattgtaaaaaagggaaactgaaagcatggacttaaaaactcnggctgacggcagactgattacttntagtataagctaattatagacaattgattcagctaccaggagagaaaattaagtgtaagaancatgataccaaactatantaaaaaaanaccatcatcctactttannantaaaannatccaacggccctaatatatggatgagaaaaaagaaaaacgtaaaagnngggtnatccccctccagtgcntataacctagttgagggatccaaanaagnaaaancngacaaaaaataaggacaaagaacaganccagaaaaggtgaaggnnnangnttaatggtcagantcanaggtccgtctcctctgntcaattgnccagtctttgactagacctgctacgtgaactttgtcanagtggcaagtnagagctagcgtggctgagaatcctttgtgggaggaaaagtaaggnattgaaaatntaggtgtagggaatacacccccagaacactgccagggaaggcagcagagcaggctgctgcagtgagcggcccctgacactttctccacggtcccctggcacaggaagacaantccgagagagagcgctggcagcacctggctgacctggccgacttcgcgctggccatgaaggatacgctcaccaacatcaacaaccagtccttcaataacttcatgctgcgn

SEQ ID NO: 522472 - DNA, 710 bp, Homo sapiens
agcggaggcgccgccgcagccggagcggctcccgggccctgggccgccgccggccaggaagaaatacttgtgtttggctgcatttccagggatgctaccacgagctcaaggctgtcacctgggtcttgcccattaacgagcctgttcttagcaggcagtgactttgatgaacgtgctttccttgctgactggaagtaggttctgctacgagcttggccattgcgacattacgataccgcttcgatgtgagtcctattactaacatactgccgttctgcagacagacgttcactagtgcaagacacgttgaaacatgccgtggcaagcatctctgtgtgttctttcatctaccttatcactgcgctttttcgcagtcgctgcgcagatttggagtgatatgactattccagaggggcaccttacatcaaagccattcttcaacaggacccacctggcagtaagattgcacacatacattcaacgatggccagtcaagcctcctgaagacactgcggagtctcaggcctctgatgagctggagtgcaaaatctgttacaactcgatacaatctgaaacagaggaaacccaaagtgctggagtgttgtcatagggtttgtgccaaattgcctcttacaagatcatagactttggggactccccacagaggtgtcattgtctgtcctttctgcaggtttgagacgtgcctgcca

SEQ ID NO: 522473 - DNA, 141 bp, Homo sapiens
atcctaattttgataggggggtggactactaactatgtggggtacttctcgggcgtgaggaaaatgttctggaattacctcagattgggtgattaggtcacacaactttgtggataaactaagaaccatgaagttgtatac

SEQ ID NO: 522474 - DNA, 262 bp, Homo sapiens
gaatccccctttgtccagcagatgtggcatatggcctgtcagggtgcatgagtgcgacactgaggatgcaggatatggaggggataatcacaggaacaaaatgtttgaatctgcacgagaagatgggacctaggacacagtagaggggcttgcctacagaatcatagcaaggatcagttgcatctttgtacaccaggcacagcacaagtcatcatttgcagtcactgcatcaacacgcactattggttagcatttgcatcat

SEQ ID NO: 522475 - DNA, 118 bp, Homo sapiens
aataacatgatacaattcgagctcgtacctctcatggaactggttgacacactatggaagcaaacagaatcaaaggctgcacagacaacttgactctcactgtagccagatctgaaca

SEQ ID NO: 522476 - DNA, 356 bp, Homo sapiens
aattgcctatactggtgtctaagtctccagcccttcactcaatctgcctaatggaccttcaggggaatctgaccttccatgcatatccatttccagctcacaaacagttttgtaaaaatggactaagctcaaccacaggggaagaaggaccataaaccttcaaagccaaaaggaagagacttgggtgaaaacctgcctgtgtgacgtcatctctctgaacttcaatttccttgtctgtaaaatgggaaaagaaatgggacctaccatagggttgtcctgaggtatgaatgagacaatgcacatttaaaatccttgtatgttcaataaattatctcgttgacttgaaaaaaaaaaaa

SEQ ID NO: 522477 - DNA, 1956 bp, Homo sapiens
taggcttttgaggcagcctagcgcagggagcttctgtggtgagggggcaggcggagctatgaggaagaccggcagatagctgtcgtgatcctcttggcccagactagtggagataaatacagtctagttaaaacattatcgtcaactaggtccctacgtatatgggcttaggcgtaaaagttctcaaagcgataattaggaaaagtaggcttacccgaacttacacgcggacgatgaatacgtgagaggactctcggagaacgacggtcagcctgttgcgggcaagggtccaccggcctaacggcgggttccataaacacgcagttaacggcgagggttcggagacttgaagggctttcctatccagtgggtaggtaccacgacacgtgtttttctacctacgacccattgggcgatgaaaagggatattaggaagaagcccgcggaatttgaattgaccaatatgagaaggggggcataggtgcttgaacagcatttaatgcgtgagggtgttgaattaataacccagtttaaagaggtacagggttatacaacagttgtgtacgggtgagacaccaatcaatagggagaggcgatcttttgactaaagagattaaaaatgcgagggggtgattaaaaaacagagcttttagaaaaactctgaatggcctggcaggggaatgacttttgcgctcactttgacgacggccctaaggtacaacggccattcatcctaacacaggccagacggaccactgggcacccgattacatgtggcgggggtggtccggtcttgccacccattggggggcgacgacaagactttgggtgtgggcacctggcgcacacaacgactttcggggaccgcgacaacaccactcttcgacgagcgggctttcacaccacacactctgttcccgcaccacaagcactctccgggcagagtgggggcgacaaccaaccacaagcacaaaaacatgtcgtcggccgccgggacgctaaccattggcgcgcccggagcatactaatctatcaccagtgtccaagcacggcatggttcatcgccgtccgtcacgccgcgagacgcagcagcaacgacatacgcaacgagccagcagaaagaaggactacgccacgaggacgagacagccaggccaccacaacgagcgcagcaagccagcaccgaaagcgcgacgacaggagagaagcagggggaacgcgggggagcaggcagagcgagacccggagccagacgcagagaagaagagcgaagcacagacgcgggacccgcgacgcagaggaagcagaacgcgaagcagccgcgggggacgacaacacgccagagaacggagagcacgcgcgacgcgaacaaggagagaagaccggagagaaggggaggaggcggaacgcaggaggaggccgggacacaggaagggcgcaggagagagggcgggagggagcgacaggcaaagaagagcaggaacgggcaggaagcgaccgcaccagcgagaggaggaaagcaccgaagggacaagccaggaggggaagagagaggaacgagcggagcgaggactggggagtgcgaggcggggacaggagagaagggagggcagcaagagagatgaacagggcaagcagcgcggcagaggaggcgaggagggaggagcgagcggcgggcggaaagcgagcgcaggacggagagacgccgagagaagcagacacgagagcagcacgggaagaggccacagagcaagcgacgcacaagaacaagagcaacgagcgagccagcgccggcgcgacgagagcgacgacacaggagaaggacgtggaggagaacgcaagggaaagaagcagacgggacgcgacagcgacaggcctacacacggccaagagacgcgggcacgaagggacggcgaacagacagcgatgagacaaagaagaagagagcgagcaagt

SEQ ID NO: 522478 - DNA, 541 bp, Homo sapiens
cccctttctctctctctctctctctctctctctctctctctctctctctctctctctcgctctctcgctcttcctccaacttccttcatacagtgacagagaaagcctgtgtgccttttctctctcgtaatagaaaagtggggagccgctggggagccaccccattcatccccgtatttccccctctcataacttctccccatcccaggaggagttctcagcgcctggggtggggccccggtgtgtgtgcgggggaccgatatccaactgctgtgtgctgacgaaggaacgagacttctctcttgaagcagtgtggctgttgtatacatatttgaactctattaccaagtagaggttgtgtgttaaaaaaacacaaaaaaaaaaaaaaaaaaaaacaaaaaaaaaaaacaaaaaaaaaacaacacaaaaaaacacaaaagcggaggcggggcgcgcgacatctcacatctaacccgccagggggggcggccttccgcgcatcgccccccgacggcagcgggctcgcaccagtggccccctc

SEQ ID NO: 522479 - DNA, 356 bp, Homo sapiens
ggaagacaatcagtttgacgggctacattgctgatgattactgctagactagcaggacaatgatcacacacagaaacacacatcagatacacccatagacacacagatgccacatgaggcattcacagagaaacacccgtagtacacaccaggatacactttcacacattgattcaccactcatagacacacataatcacatcatccatttggcacacacccattaggcatcatcatcataaatgagacacacacagacacacaccctttgtacacacactcacacagaagcacccaccctttgggctcacatcatcatgacacatatatgatcacggtctatctgacccatcctt

SEQ ID NO: 522480 - DNA, 155 bp, Homo sapiens
tgctaagatctagaagtaatagaaaagatccaattacacttggaggtttcaacactctaattaatatacagaactagtagacagaaaatcagcaaaaatatacaagaactgaacaccatcatcaaccgtcattacctgacatgggtagtcacaga

SEQ ID NO: 522481 - DNA, 228 bp, Homo sapiens
attagaggatcctggagcaggaactggttgtcatcagtacactaattctagaaattttcatcataccaaaaagaaacctgtattcattagcagtccacatcgggatgtggtagagttaggcagttcacatcgggatgcggtaaagttaggcagttcaccatctgggacgaggtttaggccagagttagagttcccatcgggatgtggtaagttaggcagttcaccatc

SEQ ID NO: 522482 - DNA, 318 bp, Homo sapiens
agtgctgtgacggaatgtattttagcaacacgaacgatatagaggttgatggatatatcacactatttttcgccgcaaggtttaccaaaaagatgaatcaccattgagagcaaaagttaaaagactgatgggttttcgaggtatgcagatgtaatacattcaataattgcaacatatggaggtggttaaatgcaaccgatatcaatgcaaggtgtctatgtttaactcggagaactacaaattcaactctcagggtactgcgaaaagctcagagtgtactcttgtatacctacagcctcctgcatacgatttacacaa

SEQ ID NO: 522483 - DNA, 105 bp, Homo sapiens
atgagtgactccaaggaaccaagactgcagcagctgggcctcctggaggaggaacagctgagaggccttggattccgacagactcgtcgtaatcaaaagtgctga

SEQ ID NO: 522484 - DNA, 487 bp, Homo sapiens
gacccacacgtacgagtacgccacaccgcactggcaggtcgatgtgccattgagtgcggtggtgagcgtagactcgttgacgtcatggcagtcacgttgaaaccggggtaccgagtgcgtaacgctccgccagttctccgttagcaagcttgggtgaatagaccagagctgacacaccgacaagtaagccgcctgccgtgcttgcgaccaactccgtcagtgcggccactgctgaccgaatggcagcttgcagcgtgatggtaatcccttctgctgtagcgataggtcccgactgaggtcatgactatcgcttgagtcgcagaagcagtgcccgacagtcgatcggtattggctactcgtaccgcttcaatacgcgcttgggccgttgctacctgctgcgcacgttctgcgaggtcgctgattgcattggaggcgttggcaagaaaccgcgcggactctgacttcagcacaaaatcatggtggctga

SEQ ID NO: 522485 - DNA, 1054 bp, Homo sapiens
  misc_feature (11)..(11): n is a, c, g, or t
ctcctgcagangtgatcctgtgacagtatttgcctcactttccccagaggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttaaaaaaaaaaa

SEQ ID NO: 522486 - DNA, 1054 bp, Homo sapiens
  misc_feature (11)..(11): n is a, c, g, or t
ctcctgcagangtgatcctgtgacagtatttgcctcactttccccagaggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttggaaaaaa

SEQ ID NO: 522487 - DNA, 215 bp, Homo sapiens
cagtgtctcgatcactgtactagctagaaccaaagtggagattacatatcccacgtatgcgtgagccctatagctgcagagcagtttaaattcacacataagctgtctcgccagatcgcttctacccatatcttaaaactcataggacctggcggtgcttcatactccctcttgaggagcctgtgtggtattcttgtcctcccagatcaacctca

SEQ ID NO: 522488 - DNA, 709 bp, Homo sapiens
  misc_feature (42)..(42): n is a, c, g, or t
  misc_feature (49)..(49): n is a, c, g, or t
atggggggctacttccggtgttctactgcaggatgcaggttntttctcnggacctccccataccagggtctactctggctccgatccatgctaccaacatgctgatggttggtaatgaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttggaaaaaa

SEQ ID NO: 522489 - DNA, 580 bp, Homo sapiens
  misc_feature (42)..(42): n is a, c, g, or t
  misc_feature (49)..(49): n is a, c, g, or t
atggggggctacttccggtgttctactgcaggatgcaggttntttctcnggacctccccataccagggtctactctggctccgatccatgctaccaacatgctgatggttggtaatgaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttaaaaaaaaaaa

SEQ ID NO: 522490 - DNA, 1183 bp, Homo sapiens
  misc_feature (11)..(11): n is a, c, g, or t
ctcctgcagangtgatcctgtgacagtatttgcctcactttccccagaggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttggaaaaaa

SEQ ID NO: 522491 - DNA, 1363 bp, Homo sapiens
tttttttggggggtctaaagggggtaaagggggggcaaagagggtaaaataagcgggccctatatttacaaagatattttagaggggaatataatttcctaggaacaaggggcctatgaaaaggggtggttgggccccacagtatttacaaagccttgtgccgcgttgtttataccccgcggttgcggtgtgtagcggggtaaagaggtggttgtgggtgttataaagagttcggggaacattgtggatttgtgtgttttataaccctcataatgtgtgtgggggaacaagctctcagtgagagtgtgaaaaagagtttgtgtgggaagtgactaattatattatatatcgcacagacgggggggggctctcacaagcggcggggagttaacatcccctcgcaagtggggctcaacgcgcctcagaggagagtctcgcagagcgtgtgcccgcgggggatcccataggaaacataggagggcgggggaaagagttatagtgtgtgagagagagtgtgtgaaaaaataatttaaatcctcgcccgcgcgagtagaatgttgggggaaatatatatttttttataaaaaactcgcgggagagaagggggggggcggactctcccacaaaagagattatatctccccctcgacgaggaggggggggggccccacaaaatggtcttttatcagcgcgcggtattaaccccacgaggattctaatcgtcttgtgtgtgctacacacaggaggggtggtgggcgtcccccaataatatgagagggaggaaacgcggcggaatatttattaatataacgacgcctaaataaaagagacccaccatggtggggcccccgaagacagcagtagattaccaccacaaaaagcgctcctccgagtacaacacccgggcggcgaacacccacaccgcgtgccgacaataacccacgtgggagggagaacccaccccttgaggggcggcagaaaaccgcgggaacacccccctatataaaccccacccagcggggaggggggggggggggacaccccattatatcatggtgtggggggcacccaaaaacaaaaatattaaaacccctcctaagcagagagaagaataatttttaaaaagaaagggctccttcatacaagggaggggggtaaaaacaatacattattttctcaaacaaaatttcttttatcaaaacgacaggggggggggtaatatacacacagcggtgtggtggtgtttaacacacaagataataagagcttcgtggacgaaattataatggtacccagtggtgcaggcatgcgtattggtaaaaagaaaacattttagtggggacaataaaaaacgcgaggtgaa

SEQ ID NO: 522492 - DNA, 277 bp, Homo sapiens
cagccagacagataatgatgggcccccggtcccggtgtttttatgagaagtgtggttattcaagtgttttttcaaaggcatgtgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttaaaaaaaaaaa

SEQ ID NO: 522493 - DNA, 630 bp, Homo sapiens
ttattattattattattattattattattttgaaacagagtcttgctctgtcacccaggctgtagtggcatgatctcggctcacgtgcaagctctgtgctttcccgggtttcatgccattctccgtgcctcagcctccgtgaactagctggaactacaggcgcccgccaccacaccgtggctaatttgtgtgtgtgtgtgtgtgtatgtgtgtttttatagtaaaaacggggttttcctccagtgttgtggctcaggcgtggctcctcgaaacctcccaaccctcagtgttgactcccaaagtgtgtttaggcattacacgggtgttgagccaccacaacccagccagttagtgtggcttttataaccttcttcaggcgtggagttacaggtggcacgaatcacggcttcacgtgcagcctttgaccttctgtgggtttcaagcagtcctccttacctcagttccccaaatagctgaaactacaggcacgcacaaccatacctgggctaatttctggtatttcttgggtgaaaggcaaggtttccaccatggttgccccaggttgggtctcaaactcctaagcctcaagcgatacctcccaactcgacctaaccaaactaacgaggcctt

SEQ ID NO: 522494 - DNA, 127 bp, Homo sapiens
aagaacttatctttatcggagagcctaagacatcataacaataacaaatggccgggcatggtggctcatgcctgtaatgccagctactcgggaggctgagacaggagaatcacttgaagccaggagg

SEQ ID NO: 522495 - DNA, 699 bp, Homo sapiens
cgagtgacaagtaatttgtcatgtcgacgaggcggtaacctggtgcagttggccaaagaatttgactaagtggcactgtatctagggccgtacttttaagagcggttaacccaacacgttcaaattctgcatttaaaaatggtaaatcaaaattaacattgtgcgccacaaagattgtgccttgtagcatcgcaagaagtgtcattgcgacgtcttcaaagaacggtgccccttttaccatgttttgggtgataccggtcaattgtgtaatattgcggggaatttgctcgcccggattaaccaatgttgaaaattgattaatgatttttttgttttgtacgaatgcgaccgcaatctgaataatacggcccgtttcgctcgttgtacgagttgtttctaagtccacaaccgcatagatgtctctatttagcatcagagcgtaccacgaccttcttttataatatttaaattataccatacgttttactgattcatttccctatttataggcgggtttggtatgatagtagcagtttaaaaacaaaaatgagaatggattggtggtttctaatagtggaaaagctagcgagtggttctagccacgccaaagtgatcttgcttggcgaacacgcggtcgtttatggccaacctgccattgccctccctttaccggacttggcaatgacagcaacaatcgag

SEQ ID NO: 522496 - DNA, 1159 bp, Homo sapiens
  misc_feature (388)..(388): n is a, c, g, or t
tgaaacactatgccagttcttaaaatgctgctttgtcctcggtgagaacatccataattcggggcccctgagttttacccagactcaaggagttggtaagagggttaatagccagatagtagaacccagtgacggatggattgcggccaacagattcttgatatcttgaaccaagatgtgaagacatagaaatgcttgtgaggtgcgattctaagcagatcctccatggtctaatttagcaacctgttgtcgtggatgcgacagcttctgaccgttgcttgactacaaagcctgtggaggctctgatgatgtcccttgaatgggctgctagacctcagaggactgcaccctgagcaagtgtaaacggacaccattcctttacttgtgncccgtgggtgcaaaagccaatgctgagtgacgcttatacagacttacctgtatgtacttgcccaatactgtgtcgatacgaaccatcgtgctgagaatcgtcttacatgcatacatttatgtgtagtttgcttaacaggcactacaggaaagttggaacaattgaccgaacaaggtcaggaatgcacgacgatttggtgcccgattcctcaatatttcgtgtcttgctagattaatgtagtaactgccgagcgtgaaacttcagtctagtacacaggtccacggaccgaacatatgccaccagatgagtactagtttctatggtcgtatgcaacgtacaggctcatattacactatgtccccctggccacaattcactcagtcgtccagtctgaccgaacgaagcacaagatcttcggaaccacattgttcctttcactgcctgttttagcacgttggccaacgtataaaaggtagttaattttcggggatagagagggcacggacgctggtgtacaccacacgactcccacaaacgtaatgtgttccaagcactttcaatacacaaacagaaaattcatgggaccgccattttcgcatataaaacaacgcgccaaaagagcatcacttaagagccaaaggcagattgccgcaacaatgtgcaacatgaggcccaacaaactccccatggatacgtgtagggcgttacccagcagttggggggataatcctggacacataatgatgtgtcgccaccaacatgttcccaacc

SEQ ID NO: 522497 - DNA, 230 bp, Homo sapiens
ggagcaaggaaggccacaaaagcagacacagaaggcaagacactcatagactacctcatgccatgaaggataccacacacctttctccacaacaagcaggccacagaaattagaattcctcttctcaaagatgagttatggacactagactccctcttcctcaaaaccagccatgaaacctagatcagttactccaaaaaaccccaaccctccacgtacgtgtgtagtag

SEQ ID NO: 522498 - DNA, 200 bp, Homo sapiens
gagcgctcctgattgtatctattcacattagtatatagcgaatttcaaacatcagttatctgcaacatgctggcaacctttaactgatatttcaatcaaccggtggaggaataaattaagaaatcccttcacggatattccgtgcatttacactgcttaaaacggtacacgtgttcatataacagtgtaattctcggttc

SEQ ID NO: 522499 - DNA, 547 bp, Homo sapiens
  misc_feature (31)..(31): n is a, c, g, or t
  misc_feature (53)..(53): n is a, c, g, or t
  misc_feature (91)..(91): n is a, c, g, or t
  misc_feature (107)..(107): n is a, c, g, or t
ccccccttgttaaaccagccccatttgccanttgcaaaaatggaacttagccnaatgccatccattcaccaagcaaattaaagaaacgtgncatatatatcttgtgnaatgctactcagccataaaaaggaacgaaataatggcattcacagcaatctagatggagttggaaaccattatgctaaatgaagagactcaggaatgaaaaaccaagctggtggcaagcacctgtaatcccagctactcgggaggctgaggcagagaattgcttgaacctgggaggtgaggttacagtgagccgagatcacgccactgcactccagcctgggtgacagagcgagactccgtctcaaaaagaaagaatgatacagtggactttggggcttcaaggggaagggtgggaggggtgtgaaggataaaagactacacattggatatagtgtacactgcttgggtgatgggtgcaccaaaatctcagaaatcaccactgaagaagttatccatgtaaccaaacacaccacctgttccccaaaaacctgttgaaatt

SEQ ID NO: 522500 - DNA, 178 bp, Homo sapiens
atgatacgagtcgagctcgtgaccttttgattgaaagtgagagacgtgttactcttcctttcacttgaacacttacaggtcatcataaggttattaattggcctaatttcaacactgccgtgtctccaggaataggcaggctcagggagaggaagagagacagaggaaggcccggtgg

SEQ ID NO: 522501 - DNA, 331 bp, Homo sapiens
  misc_feature (286)..(286): n is a, c, g, or t
tggggcaacacagcaagatcctatcacttaaaataataataatataaaaaattaggctgggagtggtggcttactgtgatcccagcactctgggaggctgaggcaggcggattacctaaggtcaggagttcaagactagcctggccaacatggtgaaaccccatctctacaaaatacaaaaattagccaggcgtggtggaacatgcctgtaatcccagctactcaggaggctaaggcaggagaatcacttgaacccgggagggagcagttgcagtgagccaaaatnacaccactgcactccagcctaggcgacagagcaagatttcatctc

SEQ ID NO: 522502 - DNA, 306 bp, Homo sapiens
ggcccagttcttacccttactgggaggtggagcttgcagtagccgagattgcaccactgcactccagcctgggcaacagcaggagtctcaaaaaaaaaaaaaaaaaaaagaagcccaccatgcaaagctctcaggatagttgccctatgtggaaaataccagggggagctgaaatgtggcccgggactccagagcagcaccgtccaatggaaccttgggcagtgatggaacgggtctacaaattctgtgctgcccattagttactcattgattttggaccatttgggaagggtggcatatggcaaa

SEQ ID NO: 522503 - DNA, 153 bp, Homo sapiens
gtggaagtgacatcgtctttaaccctgcgtggcaatcctgacgcaccgccgtgatgccagggaagacagggcgacctgaaggtcaactactttccttaagataatccaactattggatgatatcccaatgttcattttggggagacaatttgg

SEQ ID NO: 522504 - DNA, 521 bp, Homo sapiens
  misc_feature (138)..(139): n is a, c, g, or t
ccagtttgaatttcgttgcggcgaagaagcggggggtggtatctcaccgagggtccgattagccttttctctgccttgcttgcttgagtttcagcggaattcgaaatggctgccggtaaggctggaaaggactcctanngggggccgtattcatagacacctaaaatctaggacgaccagtcatgccccgcccgcgcgcgactcccgctgtgtacagcgcagccatcctggagtacctaaccgcagaggcacttgaactggcaggaaacgcacccgcagacgaagaatcggctattttcatcaaggttacctttgcttgttggtcgcgcccattccacaccaccacagaccttctgctttgtgaagaacggtccccccccgccctgtctaaagccatgcccgagaattctctgttttctcagacctccaaatcaccttaaccgcctcccccacgcatctgccacccccgcgctcctcccactctcggcacaagccaccggctgcaactacggaaagtcaat

SEQ ID NO: 522505 - DNA, 430 bp, Homo sapiens
agagacctagaccttccctctgacagagcctacccaaatgaacaaaccctggtaatatgacaaaacaagacgcttcaacaccccccaaaaaacatactagttcactggcaatggatccaaaccaagaagaaatacctgatttacctgaaaaagaattcaggaggttagttattaatcagggaaggaccagagaaaggtgaagcccaatgtaaggaaatccaaaaaatgatacaagaagtgaagggagaaatcactcagggaaatagatagcttaaagaaaaaacaatcaaaaattcaggaaactttggacacatttttagaaatgcaaaatgctctggaaagtctcagcaatagaattcaacaagtagaataaagaaattcagagctcgaagacaaggtcttcaaattaacccaatccaacaaagacaaa

SEQ ID NO: 522506 - DNA, 2430 bp, Homo sapiens
tcagctcgcactgcatatgcaacgcaactcaactcatgctgcgtatgcaactcaactcacactgtatgcaactcagctcgctctgcatatgcaattcaactcgcactgcgtatgcaaatcaacttactgcatatgcaactcaactcactgcgtatgcaactcaactcgcactgcgtatgcaactcaactcgcactgcgtatgcaactcaactcgcactgcgtatgcaactcagctcgcactgcgtatgcaactcaactgttgcaagtacttatttccggccacttcctttttctaactaccacaccaagccagtatttctcctccctgaagtcagcccaggatgaggcactagacagcaggacatgctgtatgcccttgggcctgctggaagtatgcagactagccagccccagacttcatcctgccctgtcctgcctttcctgtgaaaaccctgtggcctctgcctcccctggctctgacttctgcctcctgcccagctctgcagctccccttgggccctgcctggagtgatgtgccgccttctcttgacactgtgagtgataaactttccatgtcaggaacctgtgtgtgtcactcactcaccttgacgagtccgcgtctaggccccaccagtggtgtggttttcctcatagtctctctacctaagcacatgtctgtgacaaggtcttacccagcccagggattcttgaactatctgtaggaactgccatgttgactcctgggcagttttattctttctctctactcgttcaaccttcttagggagtgacgttttttccaaagtggttgtgaaacagcatctccttggggtgttggtttgcacttctcttcattactgatagtatgaacatggttttgcttacgctggctattttcctttttggatgaagtacctggtcttgttttttcctggtttgtttgatctttgttcttttttagaaatagtgaggctgttgtgaggtgagtcaccacttgtgacttagaagattgcagtggtttccacttcacctgtttccacttttgtgatgatgccttaaggaaaaagattgtgccaggtgtggtggctcaggcctgtaatcccaacactttgggaggccgaggtgggtggatcacaaggtcaggagatcaagaccatcctggccaacatggtgaaacgccatctctactaaaaatagaaaaattggctagatgtggtggtgcacgcctgtaatcccagctccttgggaggctgaggcaggagaattgcttgaagatgggaagcacagattgcagtgaaccgagatcgcgccactgcactccagcctggcaacagagtgagactctgtctcaaaaaaaaaggaaaaatatttcttaattttggcatactcaaatttatacaacctttcctttatcttcatcagaaatttcttttctcctaaggccttaaatatgctgtactattttggcttccacagtttctatgttttatcccaagttgcttaatccatttggagttgatttttgttgaccgtatctgtagagtgtaatgtcatttttcccactatggacataaaaatttttgcaaggcctcttttttttaatgaagaaaagaggtttattttgttcacaattctgaaggcctggagggtcccagaagcttggcaccagcacccactaggctccagatcggggcctcatgctgacttccgttttcacacaacgagtgggaaacaggtgtcctaacactgtgagagaaaaaatcccaaagtttagtttttcccattcgcttgccctggcctccaggcattcctgcagcagcaaacacatcatcagccttaggagctggcctgtgaggttgaccactctgtaggtggacaagcctcgcccgagaagagacatgagcagttctgcgtaggctttaagacagaatcaacatggaaagcacgacccacatggtttcaatagaacttgcctcctgaacctgactaggttactcgcctgatgaaccagtatctccatcacccgtgggactgacagacccagagtgtcataacctaaaattcagaagtgtagactataatcttaaattattcagcatatgtgcaacagccttggggagcagtgttatgataccaaatggctaacattcatgacctcagtatcctggaagaaaaggagaaagtgtgatgtagtaaaaccacttgaaaaaataatgatgaaacatttctcatatttggtgtaagataaaaacttaagtttgaagaggttccatgagccccagacaggataaacctaaagaaaaccaagcccaggccgggggcggtggctcacacctgtaatcccagcactttgggaggccgaggtgggcggatcacaaggtcaggagatcatgaccatcctggccaacacagtgaaacctcgtctctagt

SEQ ID NO: 522507 - DNA, 1429 bp, Homo sapiens
cagcccaccagggagaagagaagccatgagaggcaggcccgcaccctgtgtccacagacccgcaccttcccgaattcccattagaaccctgccgagtccatatcatcatgacgctcatggaacctcgtttcttgtgagtcattcttattatcattatatctcccacctcttattatggcttctaaagaaaaggtcatattatgaatgcaaagggtcacatgaactggccagtcagcatcacgagagatgcacatccatgccagatgagaccacatttatacactggacattatcatcattagacacgcgaccgacggtcatggccatagatgaggaacctgccatgaacaatcaaacgattggcatattccaagaaagaaccagggacacataatatatgacgcaatcatcagtattatacccttgggtgaacccatgaattttaccatggatggtacccaccatcggaaaggcgggcaagcatggatgcacaaagcgaagacatcgttgcccacagtgattgccacatgacaagaacaattacacatataaggacacaaaccaactagatcccagatatacaccatatcttaatggggccgcaggaaccatcaccatggagtatcaatagaccacagtggacaatcacaccaatacaaattcgagatagacattcacaattccctgggaaagtgtaagagccacaaaaggaattgagcatagaatcccaaaggacaaattaggagggaaggtgaagatagacataatgaatatggagatatgacgaaaaactgagatataagggagatcaacgggagattccaaggatcatggaaaagtatagtgaagagcaagaatacaaaaagtataggacatataaaaaaacaattagccaatgatagaaagaatagggatattataaggcaatgccaagcaggggtccctagcaaaaacacaacgaccaatggattacaccacaaccgcaatacgtgcgaagacagcacagaagttaaaccaaacgaaggaacacaacaaaggaagaaatgtgcggcacaaaacgaggacattgaggcgaccccagaacgcgtatgaaaacacgacagcaggaaccggaagacaccaacaaaggagacaacacaggcaatcacaacgggtgatttcacaaacaaagcgagaaccaacggacatcagaaacaagagaacagcagaaatggcccatagagaatgatgcaagactcaagcgccaacgtagaaaaagacacgacacaagggagagacgagaagtacccagacaagccaacagaaccagcaattcaggaggtcaaaaatgaaacaaggacatgaaataagtgccaaaaaaaggacggaacacaagcacaagagccgacaagacaagagagaaacgtagacgagagaagcatggaaatac

SEQ ID NO: 522508 - DNA, 316 bp, Homo sapiens
attaccttctgtattgccacgttgatagagacaatctggcactcagacaagccagctactctctctactcatctcgacaggccctactctcaggccgcacttccacagatgtccagctagggataggtcattcagaaaaatgatgatgtacaaagctgatggctaaagcccctccatgactctgggggtcacagccatagacccaagctgtaggtcatttaaagaagtatctccaacataaaatcttagtgtcatgcacacaggtatggccaatgccctctccactcatgttgtcagggctcaacgggttggtttg

SEQ ID NO: 522509 - DNA, 308 bp, Homo sapiens
gctgggggaaggctgcgtggggaagacgtcgctggtgctgcgttactgcgagaaccaggtttaacgacaggcacatcaccactttgcaggcatcattcttaacaaagaggttaaatattggtgggaaaggggtaaaccttgccattttgggatacggcaggtcaagggagattccatgcattggggtccactttactacagagattcacatggagcgattttagtttatgacatacacatgaagatcttttcagaggtaaaaactgggtcacagaattacgggaaatgttggggaaatgaaatctgtt

SEQ ID NO: 522510 - DNA, 135 bp, Homo sapiens
cgaaaaaaaaaaaaaaaaaaaaaaaaaaaaaaaaaaaaaaaaaaaaaaacaaaaaaaaaaaaaaaaaaacttatggaccccgcctcctggcggaccatctttccctaccgggagtcccggaccggctcgtggtgg

SEQ ID NO: 522511 - DNA, 351 bp, Homo sapiens
cacgaggacgacacctccacccatgttatcctgaggggcgtaacaaaccatacccaatttcgcgcgtatgttgaggtgaccctgatcccaagatgcgcagttttgaccagcgccctcaaaatgcaaaactcgctgaatttccccattatccccacatgatgtcacatgagaaagtcaagcacacctctcaagttctgaaggctgcgagaatttctgccaaaaattacaaagtccaaaggtatccgaggcctgtattacagattcagtttctgcgtgaacggtaccatcatataccgagcagcaaaattttgtcttgtgcagagggtgaaaggcaccatccacgaatccaag

SEQ ID NO: 522512 - DNA, 843 bp, Homo sapiens
  misc_feature (27)..(27): n is a, c, g, or t
  misc_feature (86)..(86): n is a, c, g, or t
  misc_feature (107)..(107): n is a, c, g, or t
  misc_feature (156)..(156): n is a, c, g, or t
  misc_feature (161)..(161): n is a, c, g, or t
  misc_feature (173)..(173): n is a, c, g, or t
  misc_feature (176)..(176): n is a, c, g, or t
  misc_feature (190)..(190): n is a, c, g, or t
  misc_feature (194)..(195): n is a, c, g, or t
  misc_feature (221)..(222): n is a, c, g, or t
  misc_feature (254)..(254): n is a, c, g, or t
  misc_feature (353)..(353): n is a, c, g, or t
  misc_feature (465)..(465): n is a, c, g, or t
  misc_feature (591)..(591): n is a, c, g, or t
  misc_feature (661)..(661): n is a, c, g, or t
  misc_feature (688)..(688): n is a, c, g, or t
  misc_feature (751)..(751): n is a, c, g, or t
  misc_feature (802)..(802): n is a, c, g, or t
aagaggggggtgtatgaggggcatctncggggtgggttttctttaagaggtgagaacttggaatcttgcaagcactgggagtggantcgcggcggcggcgcgagacngggagcagggagcgtcctcgggccacctgcctcaggaagagtccctctngcggncgtccttgcctntgncattctggtgctgnccgnngctcttcaggggtgcagagccggcgnngtcatcatccaggacgtcctcgggcttccggngcttctcgtagatgaagatgatggtgaccagcaccagcacctcagccacgatgcccaggaagggccagagggcggccaggtggctgcgcacgcggaggnacggatggcctggtcggagcccttggcagctggtgccgttgcaccggtactggccggggtcggcctccatgtgcaggttctcaatgtgtagctctgaccggccctgcgaggnactcacgaagaacctgcgctcggagccgttcatgagggccttgtcctcagagtcagtgatcttgtaccagcgcccagttagtgacaggtggcacggactctgacttgcagaccagcatggcgcgtntccccctcgttgatgtgtgctgagcgacttcacagccttcactctgggaggcccgtggagctggatgtcngccgtgcccatgggctcggggaggaanacgcaggagtactctccccactggtcgtccgagtgcaccttgaactccgttttctggccgggnagcgcatcctccttcagcaccacgccccccttcagccagcggtgccctgtnacctctgtcgcgctgtcattcaaggagcaggtgaggagtat

SEQ ID NO: 522513 - DNA, 1051 bp, Homo sapiens
tgttgtgggttgtctggcgtttgcgtctgtgtgctttgctcgccgtcgtgggttcccttttgtgcagtttccgcccccgctgcctttgtggtcccttgtgtctgtcctttgactaggcgagggctgtagccctcgtgggtctcggcgcggttcaagcttgtgcgccgccctttcccacgggtgtgtagccccttttgggggcgtgtacaagttgtccgcagagcgttgcgagggtgtgcgcggtggttgcgccgctgcgggccgcttgtgggccagtgcttgcctgttgcgccgtggtcagggcgtcccaccgtgcagaggtggtccagattttgaccggaccctggtgcggcaggtgccgtttgctttcgccgctttccagagcagatccgcgaagcctcagccaccatcatcgagccagcgggcgagtcagacaaccctttgcggtttacctcgtgggttgtgtggttgccctggatggtgatgccaccctggagcactgtccacggattccttcagagacacctgttaaggtcccggtcttatatcccgatggcccggctcacgatgattcccccccagcctgcagacttccggaatcctggccccgggcggcacccggctcactcacctccacggtgttattcttctcgccaccacccgccttggaccacgaggcactgcccacgcgtggaaagtgaggctgctgctggcctaccaacatcccagtgcgtctgccattcccacaaatgcccctggatggagggtggtgagatgtccacccccaggtggaaacccagccatcgagggcccccattccccttccagccaagcctgtaaaagtttataataatagccccaacctgcacggcgctaaggccaaaacaccagtcttccccacccgtggcctagagggccctttctttaggtggtccagaatgagcccagcctgaagccacttcacctggaattgatgtgtaggcttaaggagtatgtgacccttaccagtctcatctggtatccaaccccggctaccttgttttttccatta

SEQ ID NO: 522514 - DNA, 1096 bp, Homo sapiens
tagtactctgcgttgttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgcaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattatta

SEQ ID NO: 522515 - DNA, 1390 bp, Homo sapiens
gctaaacctagccccaaacccactccaccttactaccagacaaccttagctaaaccatgttacccaaataaagtcataggcgcatagcaacattgcaacacctggcgcaatagcatatagtacccgcacaggcgcaacagcatgcaacaacattataaccgaaagcgataatcatagcacaggcactaaccccatataccgttctgccatcaagtgcaattcaactcagcaaatcaacgtttgccaaggcagcagcccgaagcagctaaaaacccgcagaagaccagcacgcagctaccgtaagcaacagctcaacgcagagcgacaccccgatctatgtagcgaaaatcaggtgggcacagcattggcatcagagtcagaggcgcacgaaccgtaaccagagccctggtgcatcagcgtggtctgtccaaaggaataggacagtctatacgagttgcaagcttgtacaagttgtgccacacgagacacccagtctaaaattcaccgcgttgattacacactcgtcaaacgtgttgtagagttcccacaagcaaggcaacacacagcgtcatatcgagcaccacataggggaaaacacaacccttggtatagcacgacgaggtacaaagacaagattggaaaccaagccacgacttaggttaagtgcactaaaagatgcacggaccaccgaatttacacgacaaggccgattaccaagccatcaaccgaggcgcaagcataacccgtacaagaagaatcccacacaagaaagtaattaagcttgaaacttccctacacaagacacaacattggggagaccaaagatcctgagttcaagccccccctaatacaggaacacggaaaacgcatcaacagcggacgacaaggcactcaacgggacaacaagcaggttggaaagcaaagccagtatcagacgcgaggtccgggacaaatacacgccaccagtgcagggacccaacggacactgtagcagcaccagccagccgtgggaaaccgaggaaccaacagaagcaacacaagggacgcccagcgaactagcagaaggaacgcgcaaaccccaaagaacacagcacacgcacgccacgtctaacacgccggtcacacgaggggtacaaaacaccccagacagcacgacaacgggacagtgcgcgaccacacgaaacggggacacacgggcatcacagacgacaccaacaggtgagacgaccgggcacacaccgagaccaagacacacgaacgcccgccgggagcggagagagacgacagagagaccacacacgatcgaagggagtccaaccacacaccggacgacaggcgcagcgcaagcagcaggcccgagaagcaacacaggcagcacaagagcaccgag

SEQ ID NO: 522516 - DNA, 1743 bp, Homo sapiens
tagtactctgcgttgttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgcaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaattactgttgtgctctgcatttcgtgtgttagaagctgattctaggctgaggaaagcaagagttctctacttttgctcaatattgaggcttacccagtttgactctacagctagtgaagtggtttattgcttcaataaaaatatacttgaatgatgaatttatttatgttttgttttgtttttatttagagatggggttttgccatgttggccaggctggtctcgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaacctg

SEQ ID NO: 522517 - DNA, 640 bp, Homo sapiens
  misc_feature (8)..(8): n is a, c, g, or t
cggggtancgggatgtatcttctctcttttctggagttagattagtctgaagccgcaccagccccaggcccgcgatgcagaagaaaagcgggagggaacggcggaggccgccgcctgacctgcaccgccctcctggaggccacttggagagtccggaccccgaggaggccatggccacaagtgcccacagctggccccagggagcagtcctgcccctccccgagcctgcagtctccatgtcgatcactgatgttggaggaggtcccacatgggggtctggatgtgacccatccttggcctgggggcagaaggtctcagaagatggccttggacccatcctctgctcaccagccagacctgtgcagccctgatcgcagagaacatgccgctatcctgtcactttcattcaagagcaaggatgtgatgattgcaacggcctggtggcaacttggagcacggatgggcaagcacaggaggacagaaaactactggtgagtggccatacccactggacaccagactcggcccggcaccggaaacatacctgaaaccgggactggcgggcaaaacgacagttgaccgacactggagactcctacagacagttgggaatcgatcctacaaaagacacacctggaac

SEQ ID NO: 522518 - DNA, 93 bp, Homo sapiens
gcggccgcctactactactactgctcgaattcaagcttctaacgatgtacggggacatgcttttttctgtaaaggaccagataataaatattc

SEQ ID NO: 522519 - DNA, 502 bp, Homo sapiens
tttagtagacgtggggtttcaccgtgttgcccaggctggtctcaaactcctgagctcaggcaatccacctgcctcggccttccaaagtgctaggattacaaacgtgagccaccacgccctaatttttgtatttttagtaaagacgtggtttcaccatgtcggcaggctggtctcaaccctgacctcattattcacctgcctcggctctcaaagtgctgggattacaggtgtgagccaccatgcccagcccagaaacttttcaaaagatctctttcttaaattcaaaataactttttaaatcaatttcaaaagaagagtgttttaattcctcacaatctgagacattcaacgagatccaatgctgtcaatgagagcctagccttatacactagtgggaaaaaaaaaaatggccttgtctgaaacacttttcacttgtcaatggttattttaactcagttaaaggtacaaaggtagttggaaagaaggtttcagtgctaattcc

SEQ ID NO: 522520 - DNA, 1258 bp, Homo sapiens
tagtactctgcgttgttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgcaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaacctg

SEQ ID NO: 522521 - DNA, 671 bp, Homo sapiens
  misc_feature (226)..(226): n is a, c, g, or t
  misc_feature (283)..(283): n is a, c, g, or t
  misc_feature (512)..(513): n is a, c, g, or t
  misc_feature (536)..(536): n is a, c, g, or t
  misc_feature (539)..(539): n is a, c, g, or t
  misc_feature (567)..(567): n is a, c, g, or t
  misc_feature (574)..(574): n is a, c, g, or t
  misc_feature (577)..(577): n is a, c, g, or t
  misc_feature (581)..(581): n is a, c, g, or t
tatttcagtgacgggctggcgttcgttgaacattacgttaggacctggggtgtacaattttaaggtagtgcggactagcggtgtgagcagagcgagccacggggcccgtcatgcgccggcggcctgacatgggcgccagcgggtccaaagctcggggcctgtggcccttcgcctcggcggccggaggcggcggctcagaggcagcaggagctgagcaagctttggngcggcctcggggccgagctgtgccccccttcgtattcacgcgccgcggctctatgtnctatgatagagggatggggatctggcatcacggagatactaatagaggagacaatcgtaaacacaagaaacgggacagaagcgggccaagctgaggcgagtgccataaggaatctgattcctcagggcatcgtgaagctggatcacccgcggatccacgtggatatccctgtgatcctctatgaggtgtgaccctgggaggtggcagacagaagcaccccctgccccgnnaagaaactcccaggctcaatcanggngtggcttccattgaggagcccaggctgnggccaanccntganataaactctgttggcccataagccttacagtctgtgagcgtggtcgggtaccacacagtattggttgggtgtcggtttgtgtgtggacaa

SEQ ID NO: 522522 - DNA, 421 bp, Homo sapiens
  misc_feature (409)..(409): n is a, c, g, or t
gaagcgaggtgactgacagccctgtggagccccgtggagcgtccctgcagaggactccggccagcctgagtgacgcaatccaaagagcgctcccgggtaggaaatggccccggtggaacgccttgccagagcagcgcatagcaggctcccgagaaggattaacactggctgaacaccgggaaggaaatggcacttgaagtccagacatctgaagcttgtcaagactagtctttggaacttgccccactccatgtgagtggaagcatggcctgatcacccacggtgtgcctgtattggcacctttgttctggttttgactcggcttgacttggtaggactagtcttttgaacttgccccactccacctaagtggaagcgtggcctgatcaacccaaggtgtgcccttatnggcacctttgtt

SEQ ID NO: 522523 - DNA, 496 bp, Homo sapiens
  misc_feature (226)..(226): n is a, c, g, or t
  misc_feature (283)..(283): n is a, c, g, or t
  misc_feature (337)..(338): n is a, c, g, or t
  misc_feature (361)..(361): n is a, c, g, or t
  misc_feature (364)..(364): n is a, c, g, or t
  misc_feature (392)..(392): n is a, c, g, or t
  misc_feature (399)..(399): n is a, c, g, or t
  misc_feature (402)..(402): n is a, c, g, or t
  misc_feature (406)..(406): n is a, c, g, or t
tatttcagtgacgggctggcgttcgttgaacattacgttaggacctggggtgtacaattttaaggtagtgcggactagcggtgtgagcagagcgagccacggggcccgtcatgcgccggcggcctgacatgggcgccagcgggtccaaagctcggggcctgtggcccttcgcctcggcggccggaggcggcggctcagaggcagcaggagctgagcaagctttggngcggcctcggggccgagctgtgccccccttcgtattcacgcgccgcggctctatgtnctatgatgaggtgtgaccctgggaggtggcagacagaagcaccccctgccccgnnaagaaactcccaggctcaatcanggngtggcttccattgaggagcccaggctgnggccaanccntganataaactctgttggcccataagccttacagtctgtgagcgtggtcgggtaccacacagtattggttgggtgtcggtttgtgtgtggacaa

SEQ ID NO: 522524 - DNA, 150 bp, Homo sapiens
acggtgtaagtggagcctagtaaaaaggctacaggtcgtagagcactgaagggagaaatcataaccaaagaagaaaaatcagaccttgtaaactatcaacccaaagagcctccatacagacgtttctggagtgtgtccaaacaataatca

SEQ ID NO: 522525 - DNA, 93 bp, Homo sapiens
tcgacgggcatgaatgccgaaagccgtccaccagggctccccgtccggcctcttagccggcggcccggggggctcgggtctgcgggcccgcca

SEQ ID NO: 522526 - DNA, 403 bp, Homo sapiens
ccatcgcattatattatccgcagttttgctctatctagcaaccactggggaatttttacactggcagttgaatgtgccttgacctatcttctcttcatccccattgacgaggtgatcaacctcaatttggcctattatgctgctgtgctctggatacagaactcatcatattcatcggcccctgtgtgaatttgttgtcctctagacagcgaatcctagtgtaataagaactgctttgcttcgcttactgatgttttgggaattccctttgtgtatccggattcatgtactccagacagaagtgtttcccacagagattgcaagagaaacagaggtcataacggtaaagagccgtacgcatctcccaggagattgggaaccttatgaaggagatcgagaccct

SEQ ID NO: 522527 - DNA, 373 bp, Homo sapiens
aactactgcaaaggagagaaattactctctagacactatggaagaaggcagtttaattttactgtatctgttcaagtccgcagtagaaactagggtctaccctaggctttaataatttttttaagtgttcgtttatagctttattttatttttatttattttgagacggagttttgctctcattgcccaggctggagtgcagtggagcaatctcggctcactgcaactgccgccttctggtttcaagtgattctcctgccccagccccctgaatacaggcacccaccaccacgcccagctaattttttagtagagatggggtttcaccatgttgccaggctggtcttgaactcctgaccttgcgaactaccca

SEQ ID NO: 522528 - DNA, 448 bp, Homo sapiens
cgccttcagcttccttgagtaactgggatcaaccacagctgcacatcaccatgcctggctaaataaaaaaagttttttttctgttagagatggggtctcactatattgcctaggctggtcttgaactcctgggctcaagtgatcctttcttccaacttgatctctgaaagtgctgagattataggcatgagccaccgcaccgtgccgcccccaggattcttttaagaataaaaagaaatgagtgtggacatgaaaatacagtatttcgggggaagggatagcattgggagatatacctaatgctagatgacgagttagtgggtgcagcgcaccagcatggcacatgtatacgtatgtaactaacctgcacattgtacacatgtaccctaaaacttaaagtatgataataataaataaataaataaaatacagtatttcataaatttaa

SEQ ID NO: 522529 - DNA, 1014 bp, Homo sapiens
  misc_feature (123)..(123): n is a, c, g, or t
  misc_feature (262)..(262): n is a, c, g, or t
  misc_feature (273)..(275): n is a, c, g, or t
  misc_feature (291)..(291): n is a, c, g, or t
ggtgttatcggcacgagggtcacagaagcctagtgtgtcacagaggtccactcagtgacaaacacacactgaaggcctgaggaagacgagatgtcacagaggtccactcagtgacaaacacanactgtaaggcctgaggaatgacgagatgtcacagaggtccagctctagtgacaaacgactcactgtagagggcctgaggaaggatgagatgtcacgatgaggtccgagcgtcgagtgacgaatatcgactacacgtgtngtggccgtgannngaatattgaggatgtnacagaggtccagctcgagtgacgaaacgacacgtggtgtgtgtgccgtgatcgactgtgttagggatggttatcgcgtagaggagtccagatttcgagtgttagatcgaagagcaactagcttgttcgtgatttgctcctgacgtcgaagtgccgggagcgagtgaatgcgaaagaacggggtcccacaatccgagttcgagtaaatagcgtcagggtgggtagcacgaggtgcccctggagtgaagtagctttggatcggaaagtgattattagcaagaaaggggttccccacactgcggaatatctgaggaggcgagaaagaaatcaagctagactagttggatgtgccaccgtgtgcaagtgacagatagtcgtcgtgacgaaatccttcttagcgaggaccgctgctttcccagcagtggcgagtgtgagagcaaagagaaataaagacatagcgtggtcgatgtggcaccttgaacgcggagatctgtcggcccaaaccgactaagcgaggacagggttcctacaaatgaaggtctggacaaagagcgacacacgagaacgaggcggaaggtggcatgaggacgagaagcacgcgccgcaaatactagcgggaaccgcgaccaccaaatggccttagaggaaaaagacacaaggcgattgacctggaccttagacagagcgaccccagaaaagctaagagggagggaccacacagggg

SEQ ID NO: 522530 - DNA, 138 bp, Homo sapiens
cgcattgactgagagggcgaattccatccactggggagctctggcggggcctgtctgtgtgaggccctgccagtgtcgaaagccgctggacatacttgtcacgcctgtgtcacgtgaatggttaccctgtgctgcaat

SEQ ID NO: 522531 - DNA, 843 bp, Homo sapiens
cctggctggcctgaaggctggcctggaaggggaatggggctagcagtgtgtgtaaacatgatgggttccatcaggctggtggcagggtgtgcctgccttcctgcacacttgatgtgaaccctcccctctccctcgtgtgacatcttgccctgcccctcagcaccctgcctatgtctccatgtgagtgtcctgaatgctctgtgtgtgacctcttgtgtggggcaatggtgtgtgtgttgatgtgcctgggtgggatgtagtgtgaggtcagtgctgtggtctagagcccacatgatgcatgtgagatgcttgccagtgtcttgcccatctgaccatgtgtttgctatgtgtgcccctggaagcccactgggtctaggtagattgccatatgcaagccaccacctgctggctgcctatgtggcttgctggcatgtggactcgtgcctctgtggatgtgtttaccatctgcccccactctgtgcccccatgctcatgcccccctgcactgcatgccctgactatgcatgtctatgatggcctgagtgcttctgaggtccttgagttgactggtggctaggcatgaccccagagggtgtctgtccatgccaagtcctgcctcagtctgcaagaggtggtccctctgatgcaatgctgccctgtgaagttggtgccattcgtgaacattaggacataattcccaaagagccaaattgtcaccaatttgtggaaaccaaaattggccttgagatccaaaacgcttcgaaagaccccaaaatacctgcacattcgtcatgaaccaaccacccaatgaaaatcctggcaaccaaaatggtgaccaggagg

SEQ ID NO: 522532 - DNA, 129 bp, Homo sapiens
acgcggattcatggggctttcctggtcccattccctgcaaccccccagtgtgtaaaatcctctttctcctttctccagagggccccagagtacctgcagccccccggccatttcccattgcccccatta

SEQ ID NO: 522533 - DNA, 1056 bp, Homo sapiens
cgggctggctgggcgtagtggggctgcgcggctgccacggagctagagggcaagtgtgctcggccagcgtgcagggaagcgggcggccagacaacgggctggcgctccggtggctgccgccgctggcgcgggcgcgctagcggctagggcggcgggcgtcggcgcgggccgctactgcatctcctaccattgcctgcagtaagggcggccgcggcgagcctttgaggggaagcacttcggtcggtagtccctaaccaggagatgtctctgagtcctggctgtggatcccccggagcgtcacatcacatttaccgatcacttcaaaagtggttaaaaaactaatatttatagtacagaagaaaaaagatgtcattccgtaaagtaaacatcatcatcttggtcctggctgttgctctcttcttactggttttgcaccataacttcctcagcttgagctttgttaaggaatgaggttacagattcaggaattgtagggcctcaacctatagactttgtcccaaatgctctccgacatgcagtagatgggagacaagaggagattccgttggtcatcgctgcatctgaagacaggcttggggggggccattgcagctataaacaggcattcaggcaccaacacctggctccaaggatttttttctacattgttactctcaacaatcacaggcagaccatctccggtcctgggctgcaacagcggattccctgaaaaggcatcagatacaaaattgcattttagccctaaacttttggaaggaaaaggtaaaggaggatcctgaccagggggaatccatgaaacctttaacctttgcaaggttctacttgccaattctggttcccagcgcaaattaaggccatatacatggatgatgatgtaattgtcgaaggtgatattcttgccctttacaatcacgactgaagccagacatgcagctcgattttcagaagattgtgattcagcctctactaaagttgtcatccgtggagcaggaaaccagtacaattacattggctatcttgactataaaaaggaaa

SEQ ID NO: 522534 - DNA, 103 bp, Homo sapiens
cccaaaacagcttcctccatttcctgaaagtttattgatcaaagaaatgttgtcctgggtgtgttttttcaatcttctaaaaaataaaatctggaatcctgca

SEQ ID NO: 522535 - DNA, 191 bp, Homo sapiens
  misc_feature (149)..(149): n is a, c, g, or t
accaagatcaagccactgcactccagcctgggtgacaggagcaaaactccatgtcaaagaaaagaaaaaagaaagaaagcaaatattccagattaaatacaggtcacttgattttggactagcatgtcgtaagtgtcatgtacacctanggaggtaatacttagaaacaattggggtatacccaaaccctc

SEQ ID NO: 522536 - DNA, 955 bp, Homo sapiens
cagaaacaaagacacgggcgaaagaacaagaagaaagctacgacgcagaaaagagtgaagaacagactaagaaggaagtgaacacggtggaaaacaggagaaagtgaagcaaacaggctgcgaagtaacagaagtaccgaaaacaccatcaaacacccatagaaaaggaggacaatacgagaaacgcaggctgtgtcagagcatgaatcagaaagatcagttgatgcatgtctgtcgatatatgagttgagcatatttgtccatggggatttaaatacaccaaggacagaaagcccagccattccgaccctcccttaccgatcggaacaagcttccagaaccactccgggatcacctgtccttgatagtaacacaacgagaccgggaatggacgaaggctgagaagaaatgttacttcttgatgacgacaattgaacgagagatcaggggaagatatcacaaggaacagtgagaacggaaactgccattgatgtgggagaacagaaagagccggtacacagctgctgaagccaaacaagggactgtaaataacttgctgccacaagctgcttagaaggttgatcagaagggcgattccaagaaaagctaaggaaactgcggaggaacaccccagggacggcggaaaagaagaaatcgtgtggaccgcagcacagtcaccaaagaagacactcagtctagtgacaacagtaaggcagactgacggcaggagacatgggggtcagtaacacgtccggaaaggagagacaacaccagagtggcgaattgaagacattggggacctcctcgagataaccttaggagcagcagcgtcctatgaaaacggacaaatgatgtctgaatcacccatgaaggagacccttggaacctttggtccccagttgtgaagtgtaccaaaactttctcgtctacgcactcctctgaaaataactatcgc

SEQ ID NO: 522537 - DNA, 107 bp, Homo sapiens
gtccctgcatgctgcttcctcttcaccgccactctggagcaggcgcgcacaacaaccggtttcgagagatgactggactcctctcatatccccgtggtcccagctct

SEQ ID NO: 522538 - DNA, 120 bp, Homo sapiens
cgactgtgggccttaaatatcgcgggatcgatgtagcatctggagcgacagcctctactccggacgcacatggcattccccgcgcccctccagccctcgccgccctcgccaccgctcccg

SEQ ID NO: 522539 - DNA, 425 bp, Homo sapiens
atgaaaaagcttagagtattgtgagaattaccaaaatgtgactcaaagacatgacgtgagcacattactgttggaaaaatggcaccaagagactttctcaatgcaggattgccacaaaccttcaatttgtaaaatatgcagtgatctggatacaatatacaatataatctgtgaagtgcaatggaaacagatatgcctgtgtatatagtgttcaatactatatggtttcagggccaggcatggtggctcatgcctgtaatcctaacacttagggaggccaaggcaggcagactgcttgaagccaggagtttgagaccagcctggccaacctggtgaaatactgtcactactaaaaatttaaaaattagccaggtgtggtggcgggcgcttctagtcccagctactctggaggctgaggcacgaga

SEQ ID NO: 522540 - DNA, 258 bp, Homo sapiens
ttcaatttctacacatctggggaagacatgagaacagtaagtgcactggtcctgaggcagacaaagtggactgtccataatgtaaaaagatttgagtacttggagtggaataagagagggagctgtggcctgaaatagcaatagagaaacaggacagggcagatcacactggactttgtaggccatggccagaggcatggattttgtcgtgtgtagaaattgaaccggtgaagagacatgagaggtgtagaaattgaa

SEQ ID NO: 522541 - DNA, 168 bp, Homo sapiens
cgggtgacgctggttgttggggtcccagtgccccactcttggcaggcagtgcggctgccatccatccagtggcatcttgtcagcctgtcagtgtgggtgtgtggtcaccatccgtggcagtgggtgtattgtgcagcctgtcaccatgtggtgttctgttgcagccca

SEQ ID NO: 522542 - DNA, 907 bp, Homo sapiens
ggccgagtgggtgtcggggaggctgcgcaatgggggcgatgcccgggcagccggcgcaacccccgaccccagccgcacccacctgacgccccagcagcagcacaaggaagagatggcggccgacggctggggaagccagtggctgtcccaccatggacgacgggtttagtgagcctggactctgccctcctatgtcctgtacatgggacagagcagaatgggctgatatagatccggtgcctgcagaatgatggccccaatcccgtggatccagatcatttatagtgacaaatttagagatgtatatgattacttccgagctgtcctgcagcgtgatgaaagaagtgaacgagcttttaagctaacccgggatgctattgagttcacactgcagccaattatacagtagtggacaatatccggagagttctttagaagtcacattcaccaaggatctacatgaggaactgacctacatcactgcaataattgaggagcagcccaaaaactatccacgtattggcatcataggacgagtattcagtggcaatggctaaggagatccatctcaggagcttgaattaattgctgatatactatactcaggatgcacaagaattctcattgcctggagccgcaatcgacaatggggttcatccaggaataaaaccttacggcgattactgagctgcacgtaatgtggaccgaaattctgcaaacgaaggattgatgacgcaaatacaatctggtctaggaaacccaagcgaacactttctcgtcataacctaaaaagcccacctgggctaacacaatgacatagtgcctgccacttagcaagacaccgaagatccaatcaccacatccagacaccactgactcaccagtacgacacccacattaggagaac

SEQ ID NO: 522543 - DNA, 116 bp, Homo sapiens
gctatgccagaaggaccagtccttacagctcccttctctgtcagtaatgacgtcatcaggcaggctggaagcattaatgaactaattcgttttgacacatatataccaagcttgca

SEQ ID NO: 522544 - DNA, 816 bp, Homo sapiens
tgcccctcattcactataagtatcatactagcatccaccatctcactctctaggaatcactagtagatcgctcacgcctcatatcctccctactatgcctaacaggaggaatactcactagtcgctgtgcattactagctacctctcataaccctcaagacccactccccgtcttagccaattattggtgccttattggcctatactagtcttatgccgcctgccgaaggcatggtgggcctagccctactagtctcaatctccaacacgtatggcctagagtagagtacatacctgaaatcgtactccagatgtcggtagaactaatcgtcccaacaatgtatattactacaaagtgaggatgtaggttttccgagagagaagacacgataatttgaatcgaacacgaaccaccccacaggctaatgtataagcatcatcgcctctactattttgtaacgcagagtcaagcaacaacctatggggctgtgccccaacctttacctccgacccgtaaaaaaccgctcctaataataaccatgaagagactgagagccaagggtcggacctgaacttttggggctgcgtgtggccccttgggaaactgtcaagacggatagagtcggcagggaggcccacgcaaggtacacgagaaaactccggacagatggttgcccgtcgagcgtcccgggctgagagatggatcggggcgcccgcaccaaataagaacgcccggggactcgcggagctggaagaaccggacaaggcacgcagaagtatggggctagaggggggggccgagagcagatatgcgga

SEQ ID NO: 522545 - DNA, 279 bp, Homo sapiens
ggtacccctgaattgctatgtgtcttgggtatcatccatccgacattgaagtgttactgaagaaatggagagagaattgaaagaagtggatgctattcagacttgtctttcagacaaggaactggtctttctatctccttgttagctacacttgaattcgccccgcgactgaaaagatgagagagtattgcctgtccgtggtgatagccatgtagacttatgctcactgccccaaggatacgttaagctgtggatcggagaacatgctaagccagctac

SEQ ID NO: 522546 - DNA, 160 bp, Homo sapiens
aacagagtctcggatccccaggctattggtggatgactgactgacaccttgtatgacatccggcagagactggaccaaccagcggctcaacactcaaatcacccagtggagttggtcccactacatggaaatggaaatgcctgagccagggccagcgggg

SEQ ID NO: 522547 - DNA, 326 bp, Homo sapiens
tttgtttttgagacggattttgctctgtaaccaggttggagtgcaagatgtgatgacagctcactaaaaatttaaactggtagactcaagtgattctcctgcctcagccttccgagcaagccggatcacaagtgagcagcaccacactactcaagttttttttttttgtaaagataggtctcaccatgtttgcaaggctggtctcaaactcctggcctcatgcaatcctcctgcctcagcctcccaaaatgctgggattacaggcacgagcaccaaaccgggccccatatgttatttttaatggcagaagaagaaacatttttgta

SEQ ID NO: 522548 - DNA, 132 bp, Homo sapiens
cggcccatcttaagcatacccgattccgctacgacatcatacacctcctatgaaaaaacttcctaccactcacccttcgccctattcttcatagccgaatacacaaacattattataataaacaccctcacc

SEQ ID NO: 522549 - DNA, 498 bp, Homo sapiens
  misc_feature (11)..(11): n is a, c, g, or t
cttaatagatncaggccttgagctagttacttaacctctttatgcctgtctcttcatctgtaaaactgaagataataactgatatggagtgatttctagaatattttgaagcaagctgagtgcaaaaaaaatttacgatatactccctttcatgtaaaaagaaagacataggaaaatacatgtgtatctgttcatttttgcaaaagaaatataggaagtggccaggtgcggtggctcactcctgtaaccccagcaccttgggaggccgaggcgggcagatcacgagttcagagatcgagaccagcctggccaacatggtgaaaccccatctctactaaaaatacaaaagttagccgggcatggtgatgtatgcctataatcccagttacttgggaggttgaggcaggagaattgctcaaacccgggaggtggaggttgcagtgagcagagatcgtgccactgcactccagcctgggcaataaagtgagactccgtctc

SEQ ID NO: 522550 - DNA, 179 bp, Homo sapiens
ttcacttatctagggagagaaccaaatcccaaatctataaagcctctagcccaagggtatccaatcttttggcttccttgggccacacataaaatacattaacactaacaatagctgatgagcttaaaacaaaaacaaaaaaacaaaaccctcagtattttaagaaagtttacaaattt

SEQ ID NO: 522551 - DNA, 806 bp, Homo sapiens
tgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggtttctttaaaactagtgttaagaaatgcttagggatttttttttttttccttattttgcataactaaagcctttcacccagagccggcctctgttggcacttggcctgccgactttgcaaaacttttgggcagggtgggagactgagtctcatctctgtcacccaggctgggatgtgcagtgggcccgatctcagcttactggaacctctgccctccaggttctgggcaattccgcctcagtctcctgagtagctggggattacagggcttgcgccaccacaccggggttaatttttggtattttaagtagagaccaggttctcatcatgtggggcaggatggtcttgaaccctttgacctcaggtgatcgtgcccatctcggctctcaaagtgcctgggatcacaagttgtgagccatcggcgcccggccttgcaaaccttttgggaggtattgcgtgggtcagacaaatccttaaggttaacttcggcggaggtcggggttgcctagctcctggtttcccaaggtcgaaactacctggggcttattttgtggaaattatggcctatttgtgctcggatcctgtgacaggggagcaaccctttgggaactggtttgcgcgcacgcaaccccacttgtttcggcgtgtgaccggtcacgggggacc

SEQ ID NO: 522552 - DNA, 212 bp, Homo sapiens
ctcccaggttcaagcgattctcctgcctcagcctcctgagtagctgggactacaggcacatgccaccatgcctagctaatttttgtattttagtagagagaggatttcaccatattggtcaggctggtctcaagctcttgaccttaggtgatccccctgccacccctccctgccgccccaaaggctggattatagggtagcactgcactgct

SEQ ID NO: 522553 - DNA, 300 bp, Homo sapiens
tttttttttttaaacagagcaatcctccatcttttaaggtgataactttccacaccctctccaggtagaggcacaaaggagctggtcggggaagttggtcgggagggtgcagaagggtcaggcgggacggccggtcacatccggagaccacactaaacctttataagccatggtctcggaccggtatggtagccggaaaaataaagcaaagtgagtcaaacctcgggctcccacttccggacccagggctccccacacccatcttcaaggacccctccggccacagtccggcctccggat

SEQ ID NO: 522554 - DNA, 1002 bp, Homo sapiens
  misc_feature (1)..(1): n is a, c, g, or t
  misc_feature (156)..(156): n is a, c, g, or t
nctgggcccacaagatgagattcttgggtgtccgggaacatcccccgggtcccacgtctagaatttggggccgtcaaagcccacggggtcttccccggaggccccccctgcaagatgcgcgagccacgcggtagaagctgccccacttaagggatncccccacccccaagtgtgtcccgagactgtagggcccccccctgctagcggggccacaaacaagggacagaggcgcccggccaactgcgttgagatacacacagacgcctgagttggacacctccaacgtgggcccgtggacaatcagaagattgcccccccctctccagaggaaaaccttctgtggacggccgagagaagaacccccggcctttgagatcttggggaagccagggaacacaatgagtatttctactaccgggtaggacacccccccaaccggcgtaatatccaacgagtgtgtctctgtagacctctggcccctattgtgggggccctctcaccaagaccccccgccgtctcaaacgtttacgcacaccctgggcggtcccgaccctgttgtgctcttgtgcgccgggctccacgcttccttcacacccgcaccacggtcctctccacgggcccgtttggttgtttaaagaagagttcgacgaacacacgctctgatttggaacacttgggtgttctgacagtgtcctctcttgaaagttcctcggccccacgtggtacacagcttccggcaggccccttcccccgcctatacccctctccttgcgctctgccccacgagcctctgggagataggaaggcccctatagcacagggtgaacaaacttgggggacaggaaacaccacctgagggtcaaccctatccctcaggcccccctggggggatttaatacctggggacacccccttgcccaagccttccaggtaccaaaaccaatccattgctttttttttttggtcccaaaattaaacctcaggtaactcttcccaattcca

SEQ ID NO: 522555 - DNA, 979 bp, Homo sapiens
acgggcctttcgaatttttgcacggagaacggcttgcaacacccccgaatcccagcagggcacgtcccggttgtcaatacagcccgcaaaatgcccaggggagttatccggagacgttaccagaaacatttttcggcacatgtggactggtggatccccaagcaatctgggaattggtgaaaatgtcaagcagggcacataaactccatgttctgatcaaataaatgcaggtgcatggtcaataaatagagagctcacagaagatggaacttgaaaaaacttgctgccaatactctgggtgtgtacattctcacgaccggcctgatccctggttgctggagaaagaacacgacccccgagtgataaccgtctcctcaggaggaatgttggttcagaaactgaacaccaatgatctccagtccgaaagaacaccatttgatggaactactggtctatgctacaaaacaagaggcagcaagtggttctcgacggatcgcgtgggcccaagggcacccggccatcccatgattcgtcaccaggcatccgtggctgggccgacaccccacggtgtgaggcaggcgatacacggggtgtccacgccaggttcgcgggaccgcccgcgctccgaggcccagggcgtcgcgacaaccatgctgtggctggccctgacctccgctcgcacgaacccgcaagccagcccagcggccagcctttcgtaattcaagcatcggaagccagtttctacacacttgcctctcgctacagcgtcctcctcaccgcgccgaagaggacaaactcattgacaatcgtggaaccagctggctcagacatttaaataggccaacccagacacagtgcgagtaccagaattgccttagcagataccagaaggtgacggtctagggaaccagatgaataagaagaccccacttcaacttcccctcgaagacgttgtgcctacagtaagcgctagcacgga

SEQ ID NO: 522556 - DNA, 268 bp, Homo sapiens
aactttagtctggaatgagtacaaaaggagcccattttataatataaaccttgatgtacatgtggagatattgggacaatgaaaatgccttaaaaggaatgcatatggataaagtggcacttatatcacccttcaacaaaatctaattttaaatggtcttttccttttctattaaggggttttcttttcaggtggtctaccattggtacttataactggttattaaattaccaaattcaaacaattataaaaggcggtaacatttcct

SEQ ID NO: 522557 - DNA, 1032 bp, Homo sapiens
ggaagccttcaaacaaacttcaaactgaactataacgcggattgaactgcggagcttcgctacgcactgggaacactgcgacagcagcgcaacacaggagtaaaacatgcgaatactcccaactctggagcttagaatgtatgtgcggaaacgtagtagtagaggggcaggtgaaacagccagacttgtgaggggatctcagctgtcacattgagcacactcttggcacttgactactggcaaagtcagctaaaggacgctaacagcagcttgcttgactgtgcgacttcttcttttagcaaggagggcacttaatggctagacaggcacaacgcagcaccacgcaccacccacacctcctgggcctcccccggcgccaccttgctgctccccgccacgcccctccttccggcccagctcccccctcctgcctccccgggcgacctccccgcctctcccgcaccccccacggcttctctccacctccctgctccctccccagcctgcactccaccggcccctggaacgctgccccgtgcgccacgcacctcacctggcctccacctgaccagcccctctggccctctccccgcggccatccacgcgtgactcccctcccccacgccttcagccccctccccgcagctcggccctggggcacccacagggtggcatgggcaccagggcctgggcctaactcggtccgcgctcactcgccccgacgctgccggccgtgctccccactgcctcagtccccaaacggcatcgtctaccgtaccacaaaacaaccccctgcacccactttactacccttgaacatcccaccaccccatacccttctaaagcctccactctcaaacctgaccattacaaacctacccacaaccacacttcaccccctccccagccccacccacgaaccacacaaacacctcaaccactcacaccgaccaccccccccaacatccccacccccaaccccccaccacatccccctcactctcccccgacacccccatcccagcccaccac

SEQ ID NO: 522558 - DNA, 271 bp, Homo sapiens
aacatcatctacgttaatcatacgggtggatggatcgcacttttccacttatttcaacacataatttttctaactagtcatgaatgattagcacaccatttcggccattaagcttttaccccaccacacaccattattcattcccatttccagcctgaatcaggtagtaaattgtcaaaacttgcatgcatccaaccactcaccagcatcactttttcaagcacatctcgttggctaacgccgcccaaccaccagcacgatcacattcagt

SEQ ID NO: 522559 - DNA, 926 bp, Homo sapiens
aaccacgagctgcccaaactgagatcacatgtctcatcaacgtgaatggtattatgctgggttgaacggatcggctgtgatcttgcgcggtacccctgatacgtccgtgcacataagttttgactcagtgaacaagtgtatgagggcacgtctgttgaatcgtcacgcggacatagctgccacaggccctgtgagaaccgtgcttgtggcagagacactcgtggcgacgccgacacggtctcaatggagaatcgatcaatcacagctcgcttgccagtcgtgcctgttgggtcagaacatggatctgtcggcttcacaagtttcagacaattgaattttagccgcttgcacatcacgaggactagaatgctgtgtaagtatgtcgacatgtaactacccctgttaggagagaaatcgccgcaggacccgttcgatgtttgaggaatatacatgagattggacaaagtgtgcatcgtcatctaggtcgctgtcccgttaattgacggaccatgctgtgtgcgatcggataccccaagggcaatatatgaaatgtgctgacagtcgctgaacataccttgcttggattagaaagtaagacctgcgcggtggaacgccacgcacttcttgggacatgcaatgcaactggctgtcaacagtcacgcactactggaacagaatgcttggttgccataacagaggtatccactgacatagagactttcatccaccctctggtcagagcccatgtgttgacaacatgtgatctgcctacaaaagcaatgggtttgataagggcctgtgacccttccgttgagacaacatccatttgcttaaaacaggcgtcgtcacccattactcgttgaagtgagacaccgttttgacaacgtaatttgaccgacttagtcaacgttgcagacacataccca

SEQ ID NO: 522560 - DNA, 178 bp, Homo sapiens
cctcaacgcagacacggcttaccggagcatgcttcaagatcgggaggaccagtccattctatgcacaggcgagtctggagccgggaaaaccgagaacaccaagaagggccaactcagtgacgatgagaagttcctctttgtggacaaaaacttcatcaacagcccagtggcccaggct

SEQ ID NO: 522561 - DNA, 500 bp, Homo sapiens
  misc_feature (96)..(96): n is a, c, g, or t
  misc_feature (114)..(114): n is a, c, g, or t
  misc_feature (117)..(117): n is a, c, g, or t
  misc_feature (206)..(206): n is a, c, g, or t
  misc_feature (232)..(232): n is a, c, g, or t
  misc_feature (235)..(235): n is a, c, g, or t
  misc_feature (262)..(262): n is a, c, g, or t
  misc_feature (291)..(291): n is a, c, g, or t
  misc_feature (306)..(306): n is a, c, g, or t
  misc_feature (371)..(371): n is a, c, g, or t
  misc_feature (403)..(403): n is a, c, g, or t
  misc_feature (434)..(434): n is a, c, g, or t
  misc_feature (443)..(443): n is a, c, g, or t
  misc_feature (482)..(483): n is a, c, g, or t
atttactatttattgcacataactcagggtctttaactgctaaccaccgaaggttcaaaggactatttttccatgaagtttaacattaacattagngaattcatttactcatgnggngttttttattgtaaacatctgaatgattcacattgccgtagatcctgaactcataagcgtggaccatgcacaggctggcagcaagccanaaagccactctgcaagcaaacagatnctntgcataaagaggaaattcatagcacancattgaatgtccaacctaagtcatctcanaattatacatatatngactttttaattcacataaaatctggaactcaactggttggttggttggagatggggttagaccntgattttcgggagaaatattcctggaaataanttaagggaaatggggggttcaatcttttttnttaacctgnttgggtcctccccaaaccccttaaaatttttttttttcnncctttttaaaccttttt

SEQ ID NO: 522562 - DNA, 257 bp, Homo sapiens
ttcccagtcctgttgaaggctttttcgcccagaatctacaggctgagcggggagcccaggatctccccaggggctgccctgcagctgatgctggcggtgcgagacccacataaagcccactttctgttctgccaccgctccccagccctgttgcatagagccacgcgttggagtatcaggtagatggagcggcagccttgaagagaagcatgcacggtgccactcaccacctccgaagatggcagcgccttggagga

SEQ ID NO: 522563 - DNA, 200 bp, Homo sapiens
cgccacgaagttagggaagcgctctctccagggtggactggcccgcggtccgggagaggactgcccgcgaaggggtcggggtgggctccaggctgggagaagatctgactttgctgacctcgaagcctggatgggaagctgcccccaggagaagatgattgccccgcgaaggaaatgaagttgctaagaacagcctggct

SEQ ID NO: 522564 - DNA, 400 bp, Homo sapiens
gttggacccctatgcgtgaccaacactaaattcaagctgtcattaatgaataacaacatgaatttcaaactgtcattattgaataacaacagaggagattaaaactgttcccaacttgcagttattacaaatgtgctaacaaacacaatttgtgttccttgccccttctaccgtcttggaaaaaaaagcaggtttttttttttttgggtttcgggggggaaacaaaaaatttttgctccccaagttatataattttttttttgcctaactttaaggggccctacttaccatctttgggcgggtttcttggggaatttcccaattttaagaaaattttttgagcctactcccaaggtttttttacaactgggtttttttttttgggcaccagccttgaaga

SEQ ID NO: 522565 - DNA, 794 bp, Homo sapiens
agcggctcggcttctatctctctccaattgccctccctggcctgtggccgaccggtcctccttcccagcccagtgcagccaggcacccgggttcggcttgctcaggtctctgtccgggactgcgaagccacggagggccgggaacagtggcacactcctggcagctcaagcttcctactctctcatcgctgagtaactaccgtgcaggactgggtggacacagcaacagcatatttaggtccttgatgggctgctgggtggatggagctggaaagtgatgggcactgctttctggggcgtgcccacggttccttccgacggtgctcgcgttttcctggtgctacgaagcgggaacagcagcgatggggcatgccgtatcgcgaagacgcaaatagtcgagaactagctatccggggagaagcaggtgtctgtggggcccaagagaagtaccatctcgttaaaaacttcatgattgaactagtcttacaaatggctcccagaagatccactccctgtgggaacacagcagttgtggaacgtgacagacaccgactggacccacgaataagggttcaaatactgtggggaaatctgacctctaaattcttataagtcagagagtgactgaacaacagcagtgagacatcgaagagtttaatactctgctgtaaaccttggtgacctgattcatttacttctctaagactgaatccaaaaaggcacaatggaatactataataagctgagacagccatggtgaattccagaaaagcctgagattccctaatagccaa

SEQ ID NO: 522566 - DNA, 161 bp, Homo sapiens
tcctttatccaagcagtcgcgggggctgaggctgtaggtcctgtggcgtgacatgagctcttgcttgggctcgagtatcacacagagtcggaggtagttagagagtggaattggacagcccacaccgagtgatgtttttaggagagctgatccaacatctg

SEQ ID NO: 522567 - DNA, 506 bp, Homo sapiens
tttttttaagttccaaacatctgctagtatataatgcagatttaaactcagtgaggtgtggagtgggggaagttgattgggtctagaccccccacctttgacgaacttgcccagagccctgcatgcatcagacctacagcagacattgcaggcctgaagaaagcaccttttctgctgccatgacaaccatgcaaggaatggaacagtccatgccagggcctgctcctgttgcgccccagttgcgaaacatggctgccatacattcacatcctgtggaaaggattgcaagagaagttcttgaagggagaacccaaagtcctttggcttgcgcagattctgcctgccctgctgagccttatcatgccaataaccactgatttctatcgcatctaatacttatgcaaagcaccctatttccgtgtttttcgggtccacaatttggtcgttcactaatgcttattatctcagcttcctttacaaatgccccttcactttttcccccctcg

SEQ ID NO: 522568 - DNA, 192 bp, Homo sapiens
acctaaatgcactacactacataaaagtaaatggacatccagaatattgatgtgattatagtcttaaactagagtattattaaaccaatgatgctgaaaatcagtgatgcatttgttatagagatataactcatcagtttacagatatgtttaagattggtcagtatcatactatagatggttacagggcgc

SEQ ID NO: 522569 - DNA, 110 bp, Homo sapiens
gattatagggatactgggcaggaaacatattatcttaagctacagtatagtaaaaactttaggctcgtgggccatgtagtctctgcctcaactgctccactccgttcgcc

SEQ ID NO: 522570 - DNA, 784 bp, Homo sapiens
agtcgtgtgctaacctccctcacgcgtaggtgcgtgacgggaccctagcaggttcagcgtggagcggcggcgcgaggcacatggcagagaccgcggcggagtggcgccgcttcaagaccaactatgctgtggagcgcaaaagttgagccttatctagaagggcggaaaagcacagctgcgaccagactggccagcaactcttctgcgtctgtggcaccagagtcaacattctggaagtggcctcgggggccgtgctgcggagtctgtagcaggaggaccaggagggacatcagtgcctttgacctcatgccctgacaacgaggtgctggtgacagccagtcgggcattgctgctggctcagtggtgcctggcaagtagggcagcgttacccgactgtggaaggcgatacacactggtcccctggtggccaccatggccttcgacccatctccactctggtagccaaaggtggctgtgatggggccgtgcgcgtctgggacaatcgttgcgggagtacgggagcacaccatttccgaggctcgccccggtgtcgtgcacctgaggtgccttccagccgggagccttacatgccttggtgttcttctaccttcggccacggtatgccgccatccgcgtgtgggacactgcacggaccggtcatgcctggttgtgctggacttgcccattacagcgcctgtcgctcattgggccttcaggtgtctgccgtgctaaccttgttcaggtccggccgtgcccggagttttttccctggcccttagagtgg

SEQ ID NO: 522571 - DNA, 286 bp, Homo sapiens
cgtcgcatcattcatggatgaagcggacgccttccttgcggaagcgagccactggaggagataagcaaggacctcagagccagacgtgaacgccttctgtaccacatgggccaacacagcaacaaattcatgctggtcctggccagcaatctgactgagcagttcgactgtgaccatcaacagccgcatcgacgtgatggtccacttcgaccggccgcagcaggaggagcgggagcgcctgggtgagactgcatttggacaactgtggtacttaaggccggccaca

SEQ ID NO: 522572 - DNA, 100 bp, Homo sapiens
ctagtgtccatggtttaaaatgttgctttgtaggattttccatcctgttattaagaagaatggctttcttcagaattataatcgttattaaagctgtgat

SEQ ID NO: 522573 - DNA, 145 bp, Homo sapiens
atcacacacacaatactatgggaataccactgtcatcggtgtcttggatatctatggctttgaaatctttgacaacaacagtttcgaacaacttctgtatcaattactgcaagtgtgaaactgcagtcagctcgcccttgagttt

SEQ ID NO: 522574 - DNA, 341 bp, Homo sapiens
  misc_feature (24)..(24): n is a, c, g, or t
  misc_feature (54)..(54): n is a, c, g, or t
  misc_feature (67)..(67): n is a, c, g, or t
  misc_feature (112)..(112): n is a, c, g, or t
  misc_feature (192)..(192): n is a, c, g, or t
  misc_feature (206)..(207): n is a, c, g, or t
  misc_feature (223)..(224): n is a, c, g, or t
gagcagcggttctcaaagtgtganccctgaatcagcatcacctgagaaggtgtnagaactgtaaatncttggccccaccccaggcctactgaatcagagactctagaggagncccagcaatctgtgttttcacaagccttccagttgattctgatgcaggaagagtttaagaactactgatttaggaacttntcttttcatccctnnaaattactccctagtnntcttacccccaggtgctcccacttaccccccacccccaagtgccatccattctctgggctggcagtgacaatcttaggtagattttagtcacataatcttgagtttcttcttctatg

SEQ ID NO: 522575 - DNA, 616 bp, Homo sapiens
ggtgaaccattcgccttttctcagcccagaacccaagtatctacactgggctctcaaggaaaaccacgcatggaatcagctgattcaggatgctcagaagcgtggtgccacttattaagacctgtgacaaaacactatagacatgatgcagtgaagattctgaaactcaagcctgtgctgcagagaagtctcactcaccctcctaccatagccccagaggggtccagaccccagggtggttagcccagcagcaagctagacagtggatttgccaagacatctgtcgctgcttctctataccacacaccctctgactccaaggaaattactcttactgttacttcaaaggaccctgaaagacctcctgttcatgaccaacttccggacaccaagacaggcgagagagagagaggggacagaggggccaggggaggaataccctgggggatccaaaacctcgagcccccagcatccggagaaacaactcctacgggcgagccgggcttccctgtcgtacaacaggacctgagccatatacagcagcccgctgctgtaagtggcagctctgacgcagccacaaaacctcccgtgcggggcgaacctccagctggcaggt

SEQ ID NO: 522576 - DNA, 82 bp, Homo sapiens
  misc_feature (45)..(45): n is a, c, g, or t
tatttttatttatattattatatgtattttttgagatggtgtctnactcccgtcatgcaggctggagagcagtggcacgatc

SEQ ID NO: 522577 - DNA, 1453 bp, Homo sapiens
  misc_feature (478)..(478): n is a, c, g, or t
  misc_feature (1381)..(1381): n is a, c, g, or t
agcgggttcttctctcccgggcggcttactttgcggcagcgccgagaactcccaaccccttatactttgcggaatcaccaatggctgcgcgtgggatcccgtgttactagcgtagtcctagaacaatctggtagagtgccttcaatggtctctcagtacgctgctcagatacaagacgggtgctcagggtcctgacctgctcttccgttatcctaagcgccagtttccattctatgtgtccaaaactcaatccgcaaccctcctggagaattgtactcgcgatcaaagaatttttcctgggctcgggcacaggttccccaggcaattttgcaggttgtgaatgcatgggcattgttctgctgactgcgtttggacgagggcaagctgcccattgggcgctaacgtacttgttggaaggtcccactgcaggcgaaagcctgtgcgtggcggtgcaaaaggataaatcctgcccggaggnagcggggccagggcctaagtctgccccagcgatttggcgctcggccccagctgggggcttggcaagacctttatttcggcctgggtgtttaccccggccaattcacttaatggctgtgacgccacccacaaggtgcccaaagattgacacccctaggggggttagcttatacccctccaaaaggcttttgtgggaccccattttccaactttggtcgatcgtcaaaccaaagaacggagaaacagcaaatgggggtccccaactttttggaaagaacacctttgggcgaatacatggcggaacagagcggcagaacaggttggaaatgggcggcacagcgaacaagttataccctaggggcggcagcgcctcagggcgttcggggaaatttggcgtcttttacactcttttcgacaagagggaacccgaagtgtggaacccctattatactgccctcggcgcttgagggagcgctgggaaaacccgtgaccgtttgaacaccacaatttttggccgcgcttgtgggagcccaaactttacgagacgcacacgagtttgcggcgtaccgttgggccagacacccccgcttgagtagtagggattgaggggcttacccttacattacgacacgcgcccacgcggttttatccgattataggaaaaaagcacccaatatgtcagcatctctctttccgcccgggccgcctatggagggcccccatttatattatcggccgctaagaatttacgacgcccatacaagcccggtgtcactgtggagggaggtttattaccccccatacccaaacgcacttttgtgcgcaatcgtttgcaagcagagccaacatgtgatcgccccaccgaaaggtattctaacccaggtgggggccctttgtgattccncgttttaggcggcgatccaggaaaaagtggtggtaaagacacacttgtggctgggcttgcaacgcgaacaag

SEQ ID NO: 522578 - DNA, 677 bp, Homo sapiens
taagctatactaaaaacctaaaaatatctgtgaatggagcaagttcaggggtcttatggaggtggcccggcccctccccgctcccttccactctgcacgaggccgccacaccggcgctggctccctgcccggccggccctccctggcaatccctgggctctcttgcacccctaactgccccctgcctgctccggcactggctccctgcccggcccggcctccctggcaatccctgggctctcttgcacccctaactgccccctgctgctccggcactggcccaggcccagctcctggcctaggtccctcccagccccatgtgccctgccgcatacctccacacatccctgtccccccaaccgggaacctgcctctccagagggcgacgccctggggcccatgacaagccccttcgccaggctggcgagaacagcagaatgagatacgaattcagtggctgcccccacacgaagatgggcaccacaacgggactaattgcgaggccaccgaggggacccctacaccagcagcacacaacctacatcagagtatccatctactgaatgacaagggcgacagcaagcaaactagtacgctgaaagccacaggccaggcccacaaccccatgatcaaatggaaacgcagatcctcggcaacacccagtacgcgcgacacaa

SEQ ID NO: 522579 - DNA, 609 bp, Homo sapiens
  misc_feature (1)..(1): n is a, c, g, or t
  misc_feature (84)..(84): n is a, c, g, or t
  misc_feature (86)..(86): n is a, c, g, or t
  misc_feature (125)..(125): n is a, c, g, or t
  misc_feature (142)..(142): n is a, c, g, or t
  misc_feature (173)..(173): n is a, c, g, or t
  misc_feature (191)..(191): n is a, c, g, or t
  misc_feature (195)..(195): n is a, c, g, or t
  misc_feature (213)..(213): n is a, c, g, or t
  misc_feature (224)..(224): n is a, c, g, or t
  misc_feature (226)..(229): n is a, c, g, or t
  misc_feature (241)..(241): n is a, c, g, or t
  misc_feature (253)..(253): n is a, c, g, or t
  misc_feature (255)..(255): n is a, c, g, or t
  misc_feature (268)..(268): n is a, c, g, or t
  misc_feature (270)..(270): n is a, c, g, or t
  misc_feature (287)..(287): n is a, c, g, or t
  misc_feature (293)..(297): n is a, c, g, or t
  misc_feature (348)..(348): n is a, c, g, or t
  misc_feature (421)..(421): n is a, c, g, or t
  misc_feature (497)..(497): n is a, c, g, or t
ngggcgtcgctttgccaagaggagaaatcatttcttaaatcagtatgagttatagcataaagatggatgagaaaaaagcgatangncatacatggcgtcactgaatattccatcaatcaaatganttgtgccactgtgaganaaactactatgacaccttttacatcaaagtngtctcacgcctgtttatncganctttatatatctttttancagtataaaangnnnnctttagtaagtnacactgagaaancngtctggcctttgngnggggggcctgggtggcngggggnnnnnctcaatgtatccggcctcttctctctgctccacagcctccccagtgccccncctccagacacacagggcaggggccaggggccaggtgtgtgtccgcaggaaaggggggatggaattggttggngccgccacagaacggccactctatgtgggggcctaagtcctccgtacacactcctgttctataatgaacccttggngcagttccttaaaaaaataaaataaaaacaaaaataatgtgcatcaactctgactcacaggttattcttagggggccagcatgactgccacagagtttgatatttgttcagc

SEQ ID NO: 522580 - DNA, 210 bp, Homo sapiens
  misc_feature (150)..(150): n is a, c, g, or t
  misc_feature (161)..(161): n is a, c, g, or t
taggagacagagtctcactgttgtagctcaggctggactagcagtggtagcgaccttggattactagaacctctgcctcccgagcacaagcagattctcgtgcctcatgcctcccaatgtagctgggattacatggcacctggttaccanagcccagctanattttttgtatcttctagtcggagcacggggtttcacccatgtttggtc

SEQ ID NO: 522581 - DNA, 831 bp, Homo sapiens
  misc_feature (754)..(754): n is a, c, g, or t
accaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatcaaaaatcaattcaaggatggattaaagatttaaacgttagacctaaaaccataaaaaccctagaagaaaacctagcattaccattcaggacatagcgtggccaggacttatgtncaaacccaaagcatgcaccaaaagccagattgcaaatggatctaataactaagagctttgccagcaaagaacttcat

SEQ ID NO: 522582 - DNA, 836 bp, Homo sapiens
ggccgctgtgctgcagtcatgtctctagtgatccctgaaaagtgccaacatattgggcgagtactcaacaccaacatcgatgggcggcggaaaatagccttgccatcactgccattaagggtgtgggccgaagatatgctcatgtggtgtcgaggaaagcagagattgacctcagcaagagggctgggagaactcactgagagatgaggtggaacgtgtgatcagcattatgcatgaatccacgccagtacaagatcccagacatggttcttgaacagaacagaaggatgtagagaggatggaaaatacagccaggtccgtagccaatggtctggagcgacaagctccgtgaagacctggagcgactgaagaagattcggaggtccatagagggctgtgtcacttcgtggggccttcgtgtacgagggcagcattaacaaagaccagtggtcgtcgtggccgacagcgctgggtgtgtccataggaagagatagagtctgtaggccttgtctgttagataaatagttaatatacgcaaaagagcggaatggggagcggggggtgggaattcaggtggcgtgcgagaggaagatgtgattgacttgggcgagtgggggaacaggagtgtcttggagcgagatgatgtgacacagggggaaagactgtgggggtctcccttttggggagtcgattagattggaggaagcaggttacgtgctagaacggggaaaaaggctggtggataatatggtggggaattggggagagtaaaagatggtccttagtaaggtggcgaaatggtggtggaccatggtctgggtgaatagggatgtccg

SEQ ID NO: 522583 - DNA, 246 bp, Homo sapiens
accgcatactcggcatacgacctaaatagattttttctaaagaagatgtatgggagttctcggtcgtggctcagtggttaacaaacccgactagtatccatgcggacgcaggttcaatccctggcattgctcagtgggttaaggatccggtgttgccgtgagctgtggtgtaggttgcagactcggcctggatcgtgcttttctgtggctctggtgtaggccagcggctatagcttcaatgcgacc

SEQ ID NO: 522584 - DNA, 209 bp, Homo sapiens
ccaattggagctcggcaccccgccgtcgaccataaccccagtttcgccactgcgacgacgatgcggcgccttgacgccaaccgccagttcttcctcgacatcggcagtggcctcttccggaccgccacccaatgcgatgagcttttcgacaacggactgggcgctggcgttgtgctctcctaccgctgcatacaaggcgttgatgtcgg

SEQ ID NO: 522585 - DNA, 155 bp, Homo sapiens
gacactagagatccctgactcattatcatctgattctgtactgacatgctctgtgatgataggcacagaatggatcgtaacctcccatggggtccatggcatactataaggcatatacatggaactgtatatgtcatatatgagtatgattaggg

SEQ ID NO: 522586 - DNA, 286 bp, Homo sapiens
gaacggccccgatagctgcctgcgtgggaaggagtgcagaatcaaacgcttccagcaggtggagcgtcgctggggctacagcgggagcagtgaccgaatcaggttctcagtccacaagcgcatcttcgtggtgggatttagaggcagtatggatccatccacgggcccaccgactaccaagtgaacatccagattattcacaccgatagcaacaccgtacttgggccagaacgacacgggcttcagctatcgacggctcagccagcaacttccgcgtccgtagcgg

SEQ ID NO: 522587 - DNA, 579 bp, Homo sapiens
taaattttatgtgtgttttaccccaataaaaactgaaaaaagggatatatgttcccttaaataaaaatttcatatgttgaactcagaacccccagtacttaagaacatgcccttttttgaaaatgggattgttgttaatgtaattagttaagatgaggtcatgctgtaatagggtgggccccttaatccaatatgatttgtgtctttataaaaaagggaaatttgtgcacaaagataacccaggggatatcccatatgaagatgaaggcagatttttccaagcccagggatgccaaagattgccagcaaccccccagaagttaggagagaagtgtggattagatttttcctcacagccctcagaaggatccaaccctgccaagaacttgatttcagacttttagtctccagaactgtgagacagtgcattttgttttgtaagtcacccatatggtttgtggcactttgttatggcagccctaggagatgaagccaatatgcaccatggtatgtccattatagaacactgtgggccataaatgtgttctttggcctgaaaaaataaaatttggtggtcca

SEQ ID NO: 522588 - DNA, 321 bp, Homo sapiens
aggacacttgatggagcagcagaacaagatcatcacagccagcgtggacaatgccaacatcctgttacagattgaccatgcccgtctggctgctgatgactaccgcaccaggtttgagacatgagcaggccctgcacctgagtgtggaggccgagatcaatggcctgcgcagtggtgctggatgacctgaccctggccagagcctgacctggagatgcagattgagaacctcaaggatgtgagcttggccaacctgaagaagaagccacgatggaggagatgacctgccctgcaaggccaggtgggtgttgagatcaaggt

SEQ ID NO: 522589 - DNA, 416 bp, Homo sapiens
cctgctaagtcgactctagagttatccccttcattacgcaaatctgaaatggaatgtctccaacatggcagtgcctccctttccgtcctccctacgaccacaccaataaccagctcccaatcacaatttccttgctcccatttttatctgtacggttgggggtgggaccttcaggctgctatctttgccatctagctgttctaacttggaaatacgctcatcttgattgcagatcgttgtctcttattgatatgatctcttttaaaatctcatcccacttggtctctcatttcgcacactggccgtgtctgtggttttctatgggtatgctgatcacgtcgcacttcttgtttgcagtgagcttgctatccggaatgttcttcttgaccaccttgagatccctgtttttccctaat

SEQ ID NO: 522590 - DNA, 463 bp, Homo sapiens
  misc_feature (63)..(63): n is a, c, g, or t
  misc_feature (65)..(65): n is a, c, g, or t
  misc_feature (175)..(175): n is a, c, g, or t
  misc_feature (300)..(301): n is a, c, g, or t
  misc_feature (322)..(322): n is a, c, g, or t
  misc_feature (378)..(378): n is a, c, g, or t
tatgctctccaatgccgggcttgatggcctcgggaagcacagggaggcataggtcaggtcccntnttcatggccctctgcacatctgcacgtgccaccgccctgtggcgttggccttggtaaaaggaggccacactcgcagatgagctgtcacgggccttggtgttgattgcaantggggttgaatctcacgttgccaccagcagcttgaaaatggggtgcacagcaggcagctggcggtaaccattttgcaatgccaaaaacctcagacaccagatgtgttcgcagaaggtgggtgaanntggtctggtggacgtggaagntcactggaacgcacccagattttggccaaaagccagtcgtattttgcatccgaagngaggaaaatagggttctcatcacccggggatttggttgagctggatggcaatggggacaatcttgttttggccaaggttcttata

SEQ ID NO: 522591 - DNA, 351 bp, Homo sapiens
tcggggctccgtcagggggggaacgacaaacaaggtttccccatgaagcaggtgtctggacccagggccgtgtccgccggctactggagtaaggggcattccggttacagaccaaggagaacgggagaaagaaagagaaaatcagttcggggtggcatggtggatgcaaatctgagcgttctcaactgggttatggtaaaaaaaggagagaaggatattccgggagggactgatactacagtgcctcgcggccggggccccaaaagagctagcagaatcggcaaacttttcaatctctctaaagaagatgatgtccgccagtatgtggtaagaaaggggtacggagctcga

SEQ ID NO: 522592 - DNA, 213 bp, Homo sapiens
ccctatttctccattcgctatcatatacttaggtaccttgagaccccatggacaaaaaaatatctaacgtccagaactaccaataacaggaagaagagaaatttttttttttttctctcgaaaatgaaatgtatcccattcatagtggattctagaagcactgttctccacgttatgctggcgtgctagttaggcttgtcttttgggatataa

SEQ ID NO: 522593 - DNA, 118 bp, Homo sapiens
  misc_feature (94)..(94): n is a, c, g, or t
accggtgaaatagcccgtacgaaatcgtcatcgacaggcgcacgcccaggcggtgcagctccgcgatcgtgcgcagctgtgcccgccgtggcgntcagcaccacgccttccgtgatct

SEQ ID NO: 522594 - DNA, 244 bp, Homo sapiens
  misc_feature (95)..(95): n is a, c, g, or t
ttttttttttcccccccccccggggtttccccccccccggggggggggggggggggggggggggggggggccccccacaaattttttttgcctcnaaaagaggggggggggggggggggtttttcccccccccgggggggccccccccagggggggggggggggccccccccttgggggggggtttttttttttttttaaaaaaaccccccccccttttggggtttttttttgggggccccgga

SEQ ID NO: 522595 - DNA, 116 bp, Homo sapiens
gcggccgcctactactactactgctcgaattcaagcttctaacgatgtacggggacatgaatatgtgggctaagaaatagttcctcttgataaataaacaattaacaaataaaaaa

SEQ ID NO: 522596 - DNA, 496 bp, Homo sapiens
gaatcccttgtcaggagagccttagaacacgagcgtacaccacgattaccacaagacatgacgaacattaaagcaagtatactctggccagaaaccagcagtaccaaggccaagacactgcagcgcatattttccgcaaaacttggagtcgtaagcaacagaagttctcgccagaaagggtcgcttgtagataaccaattgactcagagcacaccttgtgttctagagaactgcaagggtagggctcgttcaatgaagaagtggactcaacggcatggtctaacaatcatatcactataggagtccttgtcatggcacaagagcaggtatcagatagtcccttaacatttgcaacactttataagaggaaaaacgcaggatcatcccatccgcttaacgaaaaccccctgtaatgtataccttcttatctacgagtaggcacgtgcagtaggtatagtacgaaatgatgtaatccttgcagccattgcctgcccct

SEQ ID NO: 522597 - DNA, 1092 bp, Homo sapiens
gcgtaggagtgacaaaagcgggggtctcgctcccttgtcttctgtctttctcatttcgctattagtgggtttgtgtgcctagtgtcacctgtcttcgtttgtattatttcctctttcatgtgtctttcctttgggttcagctgtcatctcgggcctgtcttggttttacatgtcaaatgcaacggtgccatcgatctaccttcatctgacgcgacctgacccctggcctgacgatgtagattttactgggccaagggggctatccgtccccggaccatgagcttgatgaaaaccccagcctggcttcgttgatctcgctcttctgcgctgtgtgtcctggcaaaagcgcatgcctgcgccagagcataatgggagtatgtagtggatcaccgtagcacgctatcaggtgctttctgccctatctatgtgttcggcggaccttggttgttctcttcagccccgtggaagattatctataggctctgctggacctggggaagcgggagggttagttcatgagggcagcaccatcaagcacagtcagcccctccctccctattttcccaccctcccacctcgtcacagggccatgcgccagcccgtaacccccgtcccttaacccccagtcctcactgtcctgtctttcttaggcactgagggatcttgagtagttctgggatgcgacaggaaagggacaaagtagggtgtgtgcattctcccgtgacccctagtcgcggaccgccgatcccaggtgcgtcgtgtctctgtctctcctagcccctctctcacacatcacattacccatggtggctccttaagaaaggcccaggaagcgccaggcatggagataacagcctcttgcccgtcggccatgcgtcggccctggggtaccatgtggccacaactgctgtggccccactgtccccaagacactttaccccttgtctccctggttgcctctcttgccccttgtcctgaagcccagcgacacagtaagggggtgggacgtcgtctatggtgagaaagggagacgaggtcagaggagggcatgggttggcagggtgggcgtttgttaacctcaggtggcttttt

SEQ ID NO: 522598 - DNA, 1147 bp, Homo sapiens
  misc_feature (496)..(496): n is a, c, g, or t
  misc_feature (511)..(511): n is a, c, g, or t
  misc_feature (687)..(687): n is a, c, g, or t
  misc_feature (1147)..(1147): n is a, c, g, or t
ggcctgcgcggtgagtgtagtctagatccgacgctcgtgagtcatgccgtcctagagggcccgctgtcacgctctgtgcaggtcttcgggtacgcaacgaagactagctgacagctgtaggcgtccactgcgaagactgctgtgcgaatgtgtcgtccatcaacggctgaacggcgtcggccctctggagatgagttagatgcccgcgtctagcgctgacagctacatagctgggtggcattggcctacggtgcgttgcttgctctggcaatacgggatgcagatgtagtctggtggtagacattcgctgatgtcacggttgtgaactggcgtgtgttggtcgacgtaggcgctcagactttgtatgcatatcgcgagtccaagtacacatcattcgaaagcccatggttgcgcctgattaaccatgacaatacttgttgtgatagatgggctttccaatgagagcgacgagtcaagagcaacgatctcttcagtncgcagagtaggtgancgcgagagccggctggtctggctagacttgaacacgcttcggtacgtcgtgacgaggttcctaaagaaaggtttgggaagcggcacgctggttgacccgttgtcgtgcggctacccatagagatttcttatgcgcgatttacaaggcccgagttctgttgggcattcaacatagcnttcagactttggtaagtacatttaatagcgacggtatattgaaagagagtggactctattaaagatgctttttcacagaatatattataatttaagaatatatatatagcactattgcgacgagggcgcggtactacctaaattatggcgccggggagtagagcgcgtgcagacgaaaacggcgaggctggtgaacactgagaacactcgtggcgggccattttggggccccaaaaaagggcttgaaggtttgccccccgttggggagcgcccaaaggtggggtttcacttttggggccaccaacaaaccgcgcgggtggaccacaacatctttcgccccggggtttcctccccccaaaatttctggggtggaagcgacccaggtaactacaaggagtttcccacgaagaaaaaagaccccgaggggggttatagaccccttgcgcttttcgtagagagn

SEQ ID NO: 522599 - DNA, 111 bp, Homo sapiens
ggccagggaaagcgcgtgtgcggcggaggcccggatggccccggggcccagcgtgaagaggctccgggccagcgccggagcggggtgggggtacgcggatccacagagcgt

SEQ ID NO: 522600 - DNA, 1257 bp, Homo sapiens
  misc_feature (328)..(328): n is a, c, g, or t
  misc_feature (1228)..(1228): n is a, c, g, or t
ggtaagcaccaagcggaacatatagcactcaacgagagtgatctgcatccactcccatccttcgcatatatagtcaacttacacagccatcgcatgaagaagtattatggagaccactgggaccatgggctgactgtgacttagtccgaccacagcgagcaagggcgacgaagcaactgacaggtgaccttggaaagtcagtgatggcatctaccagcatgtggatgtgcgggaggcagggcaaagggaacaagtgctcttcagtccgtgggagcctactcatgctggaatcaaagcaagatgaggaacttctgcaacgcattgtggnagtgagcattgttgctcgcttatggtccaggccatggctatcctttgcccgggacgctgtctgaagtcacaagtagttatcaggagctgcatgcgggtggggaccgcaagaaattagaggagctgctcatcaaaagctaagaaggagaagcccaccttcatcccttatttcatctgtgcctgcaaggaagctgcccggcgaagttcctactgggataccagccccggggtaaacccaggatagaatatgtaacggtgactccagagggattccggtaccggggccagatcttcccaaccgtgaatggactgtttagatggtttaaggatcactagcaggatcctgtaccaggcatcacccctagcagcagcagcaggaccggagcacctagctctatcaatgctaccccagtcaacattcaacttgcagaatctgacacgggctgtgaatgccctggcctcagaagcatgactttcacggatgttcagggacaattgctgccggtgacaaggccagggacagaacgctaaatgccaccccaagccaatggtggctccacagccagataagggttatggaggcaatggaagacgggacagaatggtttacacacggtattcccccaacggcccaggagcaggagcaccgggggccaccccactataatagcgccgcgaagtaacctatacaagacaccgaagaggaagcgacaagagcgcccgcagtaggaccaaggactagacgggagcgaacactaacagtgaacggcgtgcacacagacacatatcccggaacgaaggacgaaacagaccatacaacgcatgtgaaaatggagacgcgaaacgtacaaagcgaaaacgagaagcgcgtccagtacgaacagaacacacgagcgggagngagcacgcacatatacatcggacaggtgt

SEQ ID NO: 522601 - DNA, 828 bp, Homo sapiens
attagggaaacgaggtccctatgtgcccaggctggtctcaaactcctggtctcaagcagttctcccgcttggcctcccaaaatgctgggattacaggtatgagtcaccatgcctagcctccaatgtatggcctgtcttttaatagagtttgtagagtacaagattttaatttttctgcagtttatcagtttttccttttatggattgtgctttgggtgtcaaaagtaagaactctgccgagcactagcttccgaaatttttctcatacttttaatttttttaaaaaaattctctagttttacatttaagtctgtgatccatttgagatttttttttttttttttggacttatgaacttccactggtacggggactattggttggaaaaagggtctcgggcggctttataagggttaaccttggtcttcggtattctagaatatcccactataaggtgtctagataggggattccctttatctttctggtaatatccggggtcggagggctaaaggtttctaattattcgggaaacttctcggccatttttttcttcaaatagtctctctccagattctatctataattccttgggtaatctaagacagttaaggtaaggttacctcctctggtctggtatctaactcatatatccaggatagtaaatctgaatactggtcaggtcaattccaggtccccactcttttcacaataggccagtcttttttacccatccactgaattactcagcaatcaggcggagcggaggacttcagaattcggctattgatacggaggctgggcctatcccgttaatcaagattggcg

SEQ ID NO: 522602 - DNA, 322 bp, Homo sapiens
ttctcaaatagagaagggctttaaaaaattagaaatctctgccgggcgcagtggctcacgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgcccctgcactccagcccgggccccagagcgagactctgtctc

SEQ ID NO: 522603 - DNA, 974 bp, Homo sapiens
  misc_feature (355)..(355): n is a, c, g, or t
  misc_feature (419)..(419): n is a, c, g, or t
gggatttttgtttaaacagagtctcgctctgtcgcccaggctgaagtgcagtggtgccatcttggctcactgcaacctccacctcctgggttcaagagattctcctgcttcaacctcccaagcagctgggactacaggcattgagactgtgtctcaaaaaacatgataaacaaacaaacattgaccaaaatatgtccccaaataccttcctaggcaaagtggctttttcagtaaaaacaatgactgaccacctaattcttaaggctgctctggtccactccttgtgaatatccacctctttcttgaattcagcatttccgaagctgacctcaccaacagcccagcctccaaaccngctcctcttccattgtctccctttgaattacagctccattctctcttgcatgctgtctgagganttcccctttcctttcccatctttttcccacctgtcagacagatttccttctgctgatcagcaccgcaactttctcagccctcattccttcccactcagcctgactgtaaaagtgtgtgtgtgtgaattatgtgttgagctaataattgggtattacagtgttattttatatattattttgagatggaatctcgcctctgtcgccccaggctgagtgcagtggtgtgagggtttgtcacagggaacttccgccttccggggttcaagcaggttctccggccgtaagccctccgcaggttgctggattgtcgatgtgaccccatgggccgctattggttgggttttggtgacaccgcgggttcccattggggcggggggttctgaacctgcgcagcgatgccgctagagccaccagggggggtctcgtgtgccgccgtgctcccttttatgcgtgtgtttccccccaatatttttgcaagcagtgttccccagtgtgtgtttgtgtcaacgttcgcccatcatttttttctccgcgcgttctgacttcccacttttc

SEQ ID NO: 522604 - DNA, 941 bp, Homo sapiens
gagtgattttggggttcaaaaaaaaggtgattgttaactgctcaggagcgtagaatggacaacactccaagactctgaaggtccttacaacactagcattccccttcatgccttaggggatctctacatgatgtcctgctcagatgatggaaagccagcccccttcctcttgcaaactggcttcttgcacagtcacctggccttagactacaaccatggctctcaaatttcagggaaagtttgatcaagcagttcttttttttgcacaaaggccacatggacagggcaatcctttttcaagaagacccacagcacttctcctgcctaggctctgagaaaccacaaatacgtgtccttccactaggctttaacgagagaagagcccactctcattttcatacaccaccttattctttctcaacacctacaaaaacactggtcgccttggaagctcttccaagatcctgtcacaaaccttttagttgttataatgtaccgaaacttgacgcccgaaaggagacctataagttatctgcacccctaaaatagtctcctgccatactggtgaaaagtgttgctcacttgccctgataaccgtacaccgaattggacaaggagaagtaatacgcgtaccatggtctaacctttcacccccgagacggtcaattttctgtgttacgggacatattaagcctaccctacaggttctcttctaccttctctccacccttgcaggattatacccgcctaatcttcgcattcatgtagtccgtcctccgcccattcccgcgatgctacttaacatgcatcgctttataggcagctcccctcgcatcgcttacttgcaagcaaatatgataatcgtccgctctttctcaccacatcactacaaaccccgcttccatactcaccatgcctcgcatctcttacctatcttttct

SEQ ID NO: 522605 - DNA, 424 bp, Homo sapiens
tcactcgggacctctataggatcgccaagctttagggtatcatttttgatggtggccattgttaagcctccagaaactatacctttaaaatggttaacagatagccaatttggatagaacaatggccgctaagtaaagtaaaactggaggctttaggggacttagttactgaacaattagaaaaaggacacatagctccaacatttcccccttggaattctccagtcttcgtaattaagaaaacatcaggtaaacggagaatgttaactgacttaagagccattaattcagttatataacctatggggacattacagccaggactgccttctcctgtggattccaaaaaattggcctttaattgtcatagatttaaaagactgtttctttactatccctttagctgagcaagactgtgaacggt

SEQ ID NO: 522606 - DNA, 1635 bp, Homo sapiens
  misc_feature (1624)..(1624): n is a, c, g, or t
ggctacctgtgcgactccagccgccctgcaccggaatctggggagacccgccccccgccccaccggatctgctggccctccgacccagtcgcaggtgcaggtgcggcgttctctgcaccgctttcgaccccaggctgcatccgctcggcgtgactggcatgtgcggcgaggtagactgccccgcagggaccagctaccatctggatcggggagtcagtcgttactatcactccatgaggagctgggacagcccatccatttcgccgtgggaacgtgtcagtgcaatcaacacgaccgattcctccggtagctatccgagggcgcagagcatgggcacgaggggcacggagtcaagcagggcaccaggacacggaatcacatgagtcgacacaaatccaacgaacagggaggtcgccagacgggcatgcccgttcagagcgtttcaaaccgagatgtggggttgagcggcgtgggcttgatccacatgcgttgctcacacgatggcgatgcatcctatcgacagcgtcgccatcgaaagcttctctatatgcccttagataaccgccaggttggcagaataccacaggagaaagagacaagagcttgctcgccaattctcgttcgcgagccaggcccattgcagtagagtcccaaataaccttggagatagcctccattttaggccacagttggaacaagctaagagggcttggggtcgaaaggggaagggaacgaagttgaagtccccccgagtacctcccatcttcttgtcgattcccacgttcgacaacaaatggggacccatcccggctccaatggcctttccaagtccaacacatccctttatcaagatgggcaggttcgcgataacaaggggagcgatgccacatccatttcagagggcaaggcttggtggttaacccaattggcgcccgtaccgaacctaagcaagacaacctcttctttgcccttccaggctgtggccaaaagtgccctgtgcttgatgaaatcgttgtgggctggccacctatgggcacatggcttccattgggtgcccaggggggccaagagtggacaggttggaacctagccggaacaataccctctttgaccccgtgggggaggtaacgtttacaatcacacgacaccctggttgtttgggggacaatcacatcaattgttcccaagccgggggtggtaacaccatggaaagccattggcagcgccagccgtagaaggagttggcgcccgagctacatagccaggggccacacagtacaaagagtcgacatcgcaaacggggtgcacaacgcatcacacgggaaagatgtgttggaaccacaaaaggcgtgagagcgaccgatcacaaagacggaaggcgagaacggaggaaatcacccaatgatcccacagaagagaaagacgattgaaccgacgacaattttgactcggcggaacgaggacggggaacgaagaccgagagtgagcccacgaagaccggtacgaaatcaagtcatgtgtcgcaacggaacgatgacaaaccagcaagctgaggatcgacaaccagcacacacagcaacaggaggagacgacaacaagagagggctgacaagacagccgcacngcgaggagcgg

SEQ ID NO: 522607 - DNA, 207 bp, Homo sapiens
  misc_feature (50)..(50): n is a, c, g, or t
  misc_feature (59)..(59): n is a, c, g, or t
  misc_feature (76)..(76): n is a, c, g, or t
  misc_feature (80)..(80): n is a, c, g, or t
  misc_feature (109)..(109): n is a, c, g, or t
atgaatctggtggggacctgtgatatgtcggcagcaggcggattcagacngtactcggnactttcatatccacctngttncaaatcggtccaggacagagtgacacagngcacagcatgttggagtccaccaggtagctgttgatctgcttcaggaatacctggaactttgcatcggtgttgatatatttattgaatctcttgaatg

SEQ ID NO: 522608 - DNA, 545 bp, Homo sapiens
cagctgactgtcatgataccttgcggagtagctgggaaaaagtctccccttccacacaatcattacgagcagatctagcgcgatcgcggtcctgcctcaccaggcgcgcgctactgagactataaggcgcggcgtgattgcggccgagtacgtggtccgtgggcagtggctggtcgtcgatgggtactggggactctgagtagacaatcacgacattcggtgcagagtctgcgggctgcgtgtgatgccatagtcgcagggcaagtctgcacccgtggacgtagccgagctagtccctgtggggacgtgtgtgttgccaagtactcaaggaattttcgaacacagcgagtagagtgcgatagcacagcgactaacggaacaacccgaggtgacgccacacgggaggtccgcggtgactttgcaggtgatcgatggggctattgcccaatcctcatgtggaatggtctggtgtgaaaggaatcctccgcgtcgagggtggcaattgccttgacctgtaacatgagagacactgggtgaagacaatg

SEQ ID NO: 522609 - DNA, 699 bp, Homo sapiens
gggacccagaatcatggctggacatttaatgggggcttggttctaggacggacttcaaggacaaccaattggtccatacatcgcaatcgcattgtctgacagttgaccccttatcaacgatcacatcttcgctggccggttcaagctcagccgctgataccgcaagcagtggcagacgttgtcacctaccagcttggtttccacagtattgaactgaacgagcctccactagtccacacagccgccagtctctttaaggagatgtgttaccggtacagagaagatctgatgcaggaatcatcattgcaggctggaccctcaagaaggaggcagggtgtactctgttcccatggggggtatgatggtaagacagtcctttgccatcggaggctccgggagctcgtacatctatggctatgttgatgctacgtatcgggaaggcatgaccaaggacgaatgtctgcagttcactgccaactgtctcgctttggccatggaacgcgacggctccagtggaggggtgatccgcttggcagccattcaggagtcaggggtagagcggcaggtgcttttgggagaccaaatccccaagttcaccattgccacgttgccacctccctgaggcctggtgttctagggagtagtaaaggatggtccataccgacgcagaagctaataaacagtttgttaaagagaaaa

SEQ ID NO: 522610 - DNA, 255 bp, Homo sapiens
ttggagcgctttgaggagggcctgtgcataatggctggcgacctggagttctcagtgactcacgaggaggattggacgaggtgggtgcagacccggtcccagggcctctttggacctgggtccagttgttgcggcccgaagttgactggccccctggtcaggcactttgccggtaattggcgggctctcgcctgggccaggacgcccgcaggcaagccccttgggtggcccctttttccccggtggcccctctga

SEQ ID NO: 522611 - DNA, 442 bp, Homo sapiens
gtgatgacattggaataagaacatgagaaacaatatagaattgaagatctaaaaaaaattttcttttgagatggagcgtgctctgtcacccagactggagtgcagtggtgcaacctcagctcactgcaacctctgcctcttgggttcaagcctcatgagtagctgggattacaggtgcacaccaccacacctggctaatttttgcatttttagtagagacagggtcttgccatgttggctcgaactcctgacctcaagtgatcctcctgcctcggcctcccaaagtgctggaattataagcatgagcccctgtgcctgccctaaattacattttctttgcttttgtttttttttttttttttttttgggaaaaggagtctggctctttggccagggggggagggggagggcacaacccgggctcagggaaacttgggcctcc

SEQ ID NO: 522612 - DNA, 396 bp, Homo sapiens
atcggcgtaggtgaatgccagctcacagattgtatttctagactgcttaatcattgcctcgatcactgctcaagctctgcctttgtatccaaaggttacctgtgcaaaaacttctttttctatgctcgaaattcaatcagggaggcacagatgagtccactgaataacagagccttaaacactcacatagagcaacaactttgctggagtgtgtgtgcagtgaaccacatcaaggaatcagcatagtgtgcatggcagttcatcattgcaggttcaagcacattctacaaatatttcgaccatctccatatactcactcctttcccccctgagtggagagactcagctaccaagagaggaagctcaaaaaaaaagaagttcaaacaaacaagcaac

SEQ ID NO: 522613 - DNA, 284 bp, Homo sapiens
ggctcggaccgtagtctgaactcctgggctcagcactcggcctgcctcatagtgctgggattagaggtgtgggccaccacagtcggccccaaaattcttttcaaaataacatatcttaataatttaggagtaagtgccaaaagaatagaaaatatgttttcttttttgggaggtataacgcgtagagtgaaccatgcagcacagattatcaccttcttgtaactgccaacgttgttccgtgtgtcatttcttgcttgttggtaacttggtggcggattaaagaa

SEQ ID NO: 522614 - DNA, 208 bp, Homo sapiens
ggtcgatctctagacggatccccattggtcccgagagaaattaggatgttcagacagctgcctattggctggagggagaggcttacgcgccgaagccctattactttgctaaggtggcccttcagaacgtctgctgggctcagcaaggctcttacgtcgtgcttgagatgtgatgcctttcgaaagcgatactccgcccatgcccagt

SEQ ID NO: 522615 - DNA, 274 bp, Homo sapiens
ttgactcctcaggatgttctcaataatgggtacactaacatatcatcatatctataataccctccggaagtacatttctttattccttttatacatctactagatgtgtaattttaaactcccgtcctggaaagagaagggcggccatcacagcagctttagaagtgggtatgaatcactgcatctgctcctctcattgtgtatgcattcatgaaaagaggagtacactggtctttttttaagacttcttcgatgggctcacctgcatttgaat

SEQ ID NO: 522616 - DNA, 797 bp, Homo sapiens
  misc_feature (610)..(610): n is a, c, g, or t
tggaaagggagtctcgttctgtcacccaggttaaagcccaggggggtggttctcattggaacctccgcctttgggtttcaagcgattctcccacctcagcctcaacaagttagctggggaccacgggtgacattgccgaccaacagccgggtgtaattttggtatgtttagaatacagacggggttcaccatggttgggccaggctagtctcaaactccgtgacctcaggtgatccgccatacctcgtgcctcccaaaggtgcggggattacaagtgtgagccactctggccaggcctagtggtcccgtgttattataccagtcatctggtcttacagccagctgacatggtattacttacctgaagctcaggggtgcttatgctctggaagtccaagaaccggggttcaaatcccggtgttcacagttataacccgtggtgacatggggcatgttacttaagttctccgagcccgtttcctcattgataaaaggagggatgtgtaataaaacccacctgggagccggttgcatgtgtccggagtctgtaatcccagccagtcaggaggcccagggtaaagagggtccccttaaggccaagaagtttggnaagaccagcctgggcaaacaatagcaagacccctgtcctctaccaaagaaagatacacatgatcagaccgaaaaaccgcgggactcatgggggccgcaaaacagaaatgaagcgccgtgaaatgtccgcaccgttttttgaaagggatatcgggcccaaaggggataatggaaccgaataaactaaa

SEQ ID NO: 522617 - DNA, 402 bp, Homo sapiens
ggattttttaagaaaatgcagccaacccagacatgggggaaatcgccagtttcgataaggccaagttgaagaaacgggagacgcaggagaagaaccccctgccgaccaaagagaccattgagcaggagaagcggagtgaaatttcttaagatcctggaggatttcctacccccgtccttttcgagaccccagtcgtgatgtggaggaaaagccccctgcaaaatggacacgagccccaagttgccttttgaacttgggcactccgcgccgatgcccccggcctgtgggtttttgaagggacccccccccaatcggactgccaaattttccggtttgccccgggattttatagaaaattttttgtttgaataatgaaaataaaacccccctcgtggcatggca

SEQ ID NO: 522618 - DNA, 193 bp, Homo sapiens
aatatcgctgctctgtgtatctcgtttctgactgggctggtcaccctccttaggcaactggtggtccccgctcccggtagctcaccatattgatgccgaacttagtgcggacacccgatctggcatagcgcactacagcccagaactcctgggctcaagtgctcctcccacctcagcctcccgagtagctggg

SEQ ID NO: 522619 - DNA, 135 bp, Homo sapiens
ttacatattatacgagcatataacatctcacttcgaggaatacgagtatatcgcacacacctcatatcctccctactatgcccagacggaataatacaatcgcggtccattatagcgctcataaccctcaacacc

SEQ ID NO: 522620 - DNA, 608 bp, Homo sapiens
  misc_feature (86)..(86): n is a, c, g, or t
  misc_feature (378)..(378): n is a, c, g, or t
  misc_feature (392)..(392): n is a, c, g, or t
  misc_feature (403)..(403): n is a, c, g, or t
  misc_feature (427)..(427): n is a, c, g, or t
  misc_feature (433)..(433): n is a, c, g, or t
  misc_feature (472)..(472): n is a, c, g, or t
  misc_feature (496)..(496): n is a, c, g, or t
  misc_feature (504)..(504): n is a, c, g, or t
  misc_feature (513)..(513): n is a, c, g, or t
  misc_feature (574)..(576): n is a, c, g, or t
  misc_feature (606)..(606): n is a, c, g, or t
cttcgtacacagtgccttgcccataataggtactcaataagcaattgttcctcatagagtcttttgccatgatttatggtgttttntgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattggtaaattggttatcaatcaanactattgtagcagnctacaaagtanattcaccaggcatgacaaaatggntcaaanaaattagtcatcacgcacttaagaaaatgaaacgcaacnttttgaaatttttctgttaaaatntgtcaaantatattttnatgaaagaatttatcaaaaagggcgaaaataaaatgtacactttcattggttcatgacttnnntttttttaaataaaaaagtgaggtttcaanca

SEQ ID NO: 522621 - DNA, 508 bp, Homo sapiens
  misc_feature (258)..(258): n is a, c, g, or t
  misc_feature (302)..(302): n is a, c, g, or t
  misc_feature (326)..(326): n is a, c, g, or t
  misc_feature (358)..(358): n is a, c, g, or t
  misc_feature (389)..(389): n is a, c, g, or t
  misc_feature (426)..(426): n is a, c, g, or t
tttttttttaatttaatttataggagaacagaagagggaacagaagaaaaaaacggaaaaacaagcagaaacaaagaaaaaaaagaaaagcgaagaaagacgacaaaactacgaagaagaacgccaaagaaagaaagaaaggacaaggaaaaaagggagaaagaacgaagaagaaagaaacaaaaagcaaaaagggaaaagaagaagaaacaaaaagaggggaaggacgagcaagaaacactaaactcaaagagaatncagtcattggttaatctgtcttctcttcacaacattggtactgnagaaattcccaccctcaggttatnaaaatgtctgaacacccaacacatagcactgnagatatgagctcgacaagagtttctcagccncagagattcgcagcctagggcaggaggacactgtacnccaggcagaatgacatgggaattgcgctcaagattggcttgaagaagcaaggactgtgggaggtgggctttgcagtaacaag

SEQ ID NO: 522622 - DNA, 495 bp, Homo sapiens
aacatgtcgaggctgggctagggtggctcagctttaatcccagcacttgggaggtaggcggattacctgaggtcaggagttcaagaccaatctgaccaacatggagaaaccccgtctctattaaaaatacacaaaattagccaggtgtggtggtggacacctgtaattccagctgctcggaaggctgaggtaggagaatctcttggacccgggaggcggaggttgcagtgagctgagatcaagccattgcactccagcctgggcaacaagaacgaaactccatctcaaaaaaaaaaaaaaaaaaaaaaggtttggacgggaaccttggaatttgtaaatttagggggaaaaaacttaggggaaaaggtttttggaattgggcggggcaaaatttttttggggaatatggcccattatgtgacatggagcgggcaaaaaaggcaaaatggggttaagtgggatggcattcaacttaaatttttgtatagcaaagaa

SEQ ID NO: 522623 - DNA, 1139 bp, Homo sapiens
  misc_feature (190)..(190): n is a, c, g, or t
  misc_feature (252)..(252): n is a, c, g, or t
  misc_feature (360)..(360): n is a, c, g, or t
  misc_feature (366)..(366): n is a, c, g, or t
  misc_feature (497)..(497): n is a, c, g, or t
  misc_feature (699)..(699): n is a, c, g, or t
  misc_feature (708)..(708): n is a, c, g, or t
gctttgtagaacagagcacgctagaaaagcaagaaccaagaaagcaatactgtacactaaacatgtcattatagtatctttccataccctggcactggtgtgtctcgtcgcaacacggtggtgcactgggacaacggagcgtgtagactagttaagaagacaacacacaaacaaacaacaatgccgccgnacaacattcaacgtagcttatggcaagcattcgcaaaagaacatcgctattagcggtccacnggaagcctgatacttgtcaagcatgcagatacacaggacaacagacgaagtacgaaaacactcacgcgcatgagcattattccaggcacacacatcaactgaagcccntcacgnaagatagatcagggagcgcatatgaaacgagacacgtacacgcatatgtacaagtacatgccaattgcaagcgtatgcatacacatattcgcgtacaattattgatccacggaaagctttttcattttatntgcaccgatttgcccattgatccgtttgcaataacaaactttcaaacaggaaccaacatggggaattcttgaggcctgcagtggatactgagttgtggtaagtgattggaaaagggaaagatatcaagcacccgtattgaattggacagtctggaagtggagcgtaacttacttagtaaaaaaactcgtaatactgtacagnctaagcgtnttgttaggaaaaagcagcgatgtgcctggggctaagttgaagagtatgagtatgtcagtaactaccagccccagaagacgtaaatagttggttaggtaaacattgttgtatctatgtacgaaggaaagttagctcattttacatccgttgggccttttgtaaaccgtccctgttagagtgtctgtacctgtatctaaggaaggggcgcaaaagacccagaagaaagtagtcgtttggcatgaggcaaggaaacgcgtggcggacacagagaacaagagccccagtgcaacacacgtgtaattcctagagagtgtcaaaaagttgcacacaaagcttggaagcccaaaaaccttctttgtggtggtattattagccaatcttctacaaatactaatttattcacgccttgtggattggtaaaggtacctaat

SEQ ID NO: 522624 - DNA, 380 bp, Homo sapiens
gctctagaggatctccttctttatgggatttggcatcatctgccatggatatggctcttcccaagacaaaatctagtgagaagggaaattctaaaaaaaaaaaaaaaaaaaaaagccattggcagtaaaggtttttatggaaatggttttttgacagcgggaaatgtaaagttggcttagaacctggaattttttcttgggcccacacagaatggggaaattcgacgggtgcttgggcgggcaatctaacgaacctggtggtactgtggtaagtggcctttaaagtggaaaaaaaaaagtgttgcgctgcaaatggacaataggcagacatcacatcgttcccataatgggccaataaaagaagggaaaacaagggggga

SEQ ID NO: 522625 - DNA, 303 bp, Homo sapiens
caggtggatcagttgaggttagaagtttgcaaccagcctggcaacacggtgaaactgcgtctctactaaaaatacaaaaatcagccaggcatggtggcacatgcctgtaatcctgtaatcccagctactcaggaggctgaggcaggagaatcacttgaacccggggggcagaggttgcagtgagccaagagtacgccactgcacttcagcctggacaacagagtgagactctgtctaaaaaaaaaaaggatctcaaaatagtagccaaatcttcaccccagagggtctggctgggggcaccga

SEQ ID NO: 522626 - DNA, 151 bp, Homo sapiens
  misc_feature (63)..(63): n is a, c, g, or t
tggtggatcactgggtcaggagttgagactggctgacagacatgtgtggcgcatctctactanaaatacaaaattggcgggcgtggtggtgcatgctgtagtcccagctacccaggaggctgacacacaagaattgcttgaacctgggagg

SEQ ID NO: 522627 - DNA, 264 bp, Homo sapiens
atccaaagaattcggcacgaggggctgctggggaggatggggggatgttatataaatatagatataatttccctttcggagctaagatggtgttatttaagggtggtgatgggtgagcgctcttgcccaggctgggccagacttccgcccaagcatgaaacaggacttgaccatctttctcaaacccctgtgggggaggacatttgtcaacctactttggggagggacacagccttcagcacagaccttttcctgcggggcaga

SEQ ID NO: 522628 - DNA, 417 bp, Homo sapiens
gcgtcagcggctgagtgcacgccttggatagctcggtagagcaacgtggatccataacttgcaccattatcgcttgtgtccgtgcgttagtctcctactctgcgtgagccgtcattacgcgcccggtccggagaccccggtgtagccgtcgactttgaaggatgacctctaggaataatgtgttgctcgacgttatcagcgctgagagattctggagttcgggaagacattgatcatgaactacgatgctgataatatactctacaatcaagtcgcctgtcttggatctcacttactgaccaacgacgtgatggtgcatgacatgctagacacaatgcatatatgggacactagcaagacaggcggttccagtcgcacgagtgtgcgcttttacagaggtgcagacagtgcgttctg

SEQ ID NO: 522629 - DNA, 872 bp, Homo sapiens
  misc_feature (667)..(667): n is a, c, g, or t
gctcttctccccgccctcccccagctcctagctgcctcccaggcctcaggtgtggctgtctggtggagaccataccccgcaagcccttgcctcggcacctccttgtctcacccatttcctgcagtgtgtctgacgccaggcctcccggctccgttgggcgacttgctcctaggcggatgtctctggctcaccatccgtgtgtccgatcaccatatcctcctcgcgagtgtttccacctatatcattgtgatgttatagagaatggaaacaggacagtattcccggaaaggaatcgcgtctctcagttcattcgcgtaaggtgtcgtttccacctcactcgtcgcacagctcgtccgatcgtatcgccaggttatgacaaacatggtggcgtttcgccccaactcaagtgaaagcggattgagagcaggccttggggacgggccggtgtctcggcattgctagggcctgcgctggggctctggtctgtggcggctagcactggcttgactcggactttcctcggctgtttccctacccacttccctcactcctccctagtacctctcctccgattctttttgtctcttctttttgcctctagccagtccttcatgacccctattcttcctctggcaggtgggattgtagagtttatacactaatcttntgagggctgcgatgtggtggtcggacgagcggcgagtcgggtgttcagagaatgtgagcgttaagtcgggtgatgacctgggcaaattgtggatgctgcagttgaggactggagagagggggccgtggagttggacaattgaggggctttatgcaggtagtggcccagtgacaggtgatacatggagtcactatgttgagaaact

SEQ ID NO: 522630 - DNA, 312 bp, Homo sapiens
tgtgggtgattagaggatcggtgttgagagctggagtctggtcggagaggcaggaaggaagaggggggttgggttcgggcaggaaggcacaggtgttcccagcgccggggctccccgaagcgggaggggggtccacactgcctggactgatgactgtgttgagctagtggttataggttataagtctggagggaagggcagtgccggtggtgctgagtgggtgggctcttgaagtggggagaggggacacatcacggatgcttggtgaaaaacccggggttgttcccgagggcagtgaaacaaagcgaaaag

SEQ ID NO: 522631 - DNA, 1190 bp, Homo sapiens
atggcacatgcagcgcaggtaggtcgtactaagacgctactttccctcgtcatcatagaagagcttatcaccgttatcatgatctaggtgccctcaataagctattgtgtcctatatctggcattccttagtccgtagtaatggcccttatttcacttaacgactcaacgaacgagacaactgaactaatagctaaccatcgtcagtacgctccaggatacatacgataagccgtacgtgaacgtaatactctagccgcgcactagtcgatcctaggtcctccatctgccactccacatccctagcgcatgccttttagcattaacatgactgaggtctggacgatcgccgtgcccttgaaccatcaaattacaactagggcacactaatagggtactaggaacctgactgaagttacaccctggttgacgtgcggggcacctaaagtcttactagcttcactaacgataactctccccacaattaattgcctatatgaaccaatggctagaccttggcaggatctacctgtggacgtattgaccgaactccggaggttagatatcgtcacgcggaatggtcgcagagactccggcaactctccagttattaaacttagatataaccagatctaccacaagggaagtcgtcatttgaggaactgtccaaactgaagtcatgatcgcgctcaatcgaataaagtgcctttaaatagagaactagggatgacgacattctccccgggaacacgctcttaaaaccaaaacccacctcttcaaccctgcttatcagtcgaaaccgcgggcgttcatacctaaccggatccaactgccatcttgacacacattcatggtcggaaggcaacaacccaacaggtctctcaagttgccacccattcggtacactaggacattcacaatttccccgcttaaccaaaaaagttccttttggaaagagctaagcgggggcccggcttaacttcttaacccccgcttaaataatgccagaccgaccacgtacataaaacaccacctgtcgttaaggaggtccaacgccaagcacgcatcacgactctcgagacacgacacccacacaagcaaagagcagactcgctcgcaaggccgacctgtgccgccgcgcacgtgcacacagcaccttagctccatcacaccctcacagacatttcggca

SEQ ID NO: 522632 - DNA, 194 bp, Homo sapiens
gccatcagcttgccattgctttacaaacaagctactgcacagttctgagtaaatgactcttttcatatctgagagtttttagaggccccttaaatgattttaatgtggctttaatatacagataggggaagaatcattcagttggactgtttaaataagaatatttgattagaaatgaggcatgatcatggctt

SEQ ID NO: 522633 - DNA, 93 bp, Homo sapiens
gcggctcggaggaggccaaggtgcaacttccttcggtcgtcccgaatccgggttcatccgccaacaagccagtcatccaacaatccagcctga

SEQ ID NO: 522634 - DNA, 145 bp, Homo sapiens
agaccaactgacaatatggtgaaaccttgtctctactcaaaaacacaaaaatgcgccgggcatggtggtggtgtgtacctgtagtcccagctactcaggaggcagaggtgcgagaattgctcacacccaggcggcataagttgca

SEQ ID NO: 522635 - DNA, 165 bp, Homo sapiens
acttacctggcgtatactccactttgatccatgcccaataggggatgtccaaaatttaataatactatcggtgtacaagagaataaatggggagtgaaatagaataaaagatgagggaggggagtgctatatatttacacgtcgagtattctatatcaccatcat

SEQ ID NO: 522636 - DNA, 631 bp, Homo sapiens
  misc_feature (2)..(2): n is a, c, g, or t
  misc_feature (247)..(247): n is a, c, g, or t
  misc_feature (260)..(260): n is a, c, g, or t
  misc_feature (265)..(265): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (292)..(292): n is a, c, g, or t
  misc_feature (327)..(327): n is a, c, g, or t
  misc_feature (331)..(331): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (357)..(357): n is a, c, g, or t
  misc_feature (360)..(360): n is a, c, g, or t
  misc_feature (364)..(364): n is a, c, g, or t
  misc_feature (367)..(368): n is a, c, g, or t
  misc_feature (374)..(374): n is a, c, g, or t
  misc_feature (376)..(376): n is a, c, g, or t
  misc_feature (388)..(388): n is a, c, g, or t
  misc_feature (419)..(419): n is a, c, g, or t
  misc_feature (422)..(422): n is a, c, g, or t
  misc_feature (432)..(432): n is a, c, g, or t
  misc_feature (441)..(441): n is a, c, g, or t
  misc_feature (455)..(455): n is a, c, g, or t
  misc_feature (457)..(457): n is a, c, g, or t
  misc_feature (459)..(459): n is a, c, g, or t
  misc_feature (488)..(488): n is a, c, g, or t
  misc_feature (493)..(493): n is a, c, g, or t
  misc_feature (502)..(502): n is a, c, g, or t
  misc_feature (538)..(538): n is a, c, g, or t
  misc_feature (563)..(563): n is a, c, g, or t
  misc_feature (631)..(631): n is a, c, g, or t
gncctgggcagtacactcctctctcctctctatagcactcattccttctgaggtgtcatttcaccagccacctgagtaagtgctccagctatccccagaccagctagagacatcccaagcatggtcatgttagcatcaatgtccaggcatactcagggctcagaatcgtgggttagtaccactttttcccactaccccctttatattccacaagggactcacagccagacaggttaactctcccctnccctacccccacnaaacnctggaaaatnanaganagcctttttanagctcctctttctcggcccccttcttctggaaggnagtnaggatgtttaagntnttntggagctnctncttnttnncgtcantnatcttgttcttntcaataagaatggagataagatgtaaaatangangaagggaagnaaataaaantggtataagaaatnananaagaaattaaggtattgaaaggaaaaatnattangagtataantaaaaaattgagaggttatattgaaaatgaataaanagggaatggagggaataaaaaaaanaagaaatgatgaaataaaaggaaagggagtagtataaaggaaggaaaaaaggaataaatagagtagan

SEQ ID NO: 522637 - DNA, 467 bp, Homo sapiens
  misc_feature (2)..(2): n is a, c, g, or t
  misc_feature (247)..(247): n is a, c, g, or t
  misc_feature (260)..(260): n is a, c, g, or t
  misc_feature (265)..(265): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (292)..(292): n is a, c, g, or t
  misc_feature (327)..(327): n is a, c, g, or t
  misc_feature (331)..(331): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (357)..(357): n is a, c, g, or t
  misc_feature (360)..(360): n is a, c, g, or t
  misc_feature (364)..(364): n is a, c, g, or t
  misc_feature (367)..(368): n is a, c, g, or t
  misc_feature (374)..(374): n is a, c, g, or t
  misc_feature (376)..(376): n is a, c, g, or t
  misc_feature (388)..(388): n is a, c, g, or t
  misc_feature (456)..(456): n is a, c, g, or t
gncctgggcagtacactcctctctcctctctatagcactcattccttctgaggtgtcatttcaccagccacctgagtaagtgctccagctatccccagaccagctagagacatcccaagcatggtcatgttagcatcaatgtccaggcatactcagggctcagaatcgtgggttagtaccactttttcccactaccccctttatattccacaagggactcacagccagacaggttaactctcccctnccctacccccacnaaacnctggaaaatnanaganagcctttttanagctcctctttctcggcccccttcttctggaaggnagtnaggatgtttaagntnttntggagctnctncttnttnncgtcantnatcttgttcttntcaatcagcctggcgatccgtgtcatctctgatgcggggaagtcctcccctttgtgtctaagaacttncccatgaactt

SEQ ID NO: 522638 - DNA, 431 bp, Homo sapiens
agtgacactcgttcgtgacatgtggaaaatcacatggcttatttcttagaggttttgtttattcttctttactgctttttctttatatttgtctgactgtgttatttcagagagccggtgtttgagccctgagattctttccttagctggtcaattctgctgttaatgctagcaattgtattctgaaattctcaaagtgagttttaaatctatcagatgagtttggttctttcttgtaatggtcatttgttcatcagctcacgtattgttttatcctaatccttagattccttggattaggtttcaactttctcatgaatgtcaataatcttcattcctatccatattctgaattcaatatctgtcatttcagacatttcagcttgggtaagaaccacactgggttaagtaagcagggggatctctagaat

SEQ ID NO: 522639 - DNA, 301 bp, Homo sapiens
  misc_feature (199)..(199): n is a, c, g, or t
  misc_feature (259)..(259): n is a, c, g, or t
  misc_feature (266)..(266): n is a, c, g, or t
gagatagtctcaatgtaaagatcttaagtgttttatttatttttaattcctgtgggtacacagtaggtgtatatatttatggggtatgtgagatgtcttattataggcatgcaatgtgaaataagcacatcatgaagaatagggtattcatcttctcaagcatttatccactgagttgcaaacaatcctattacatttngtcttattttaaaatgtatagtcaccctgttgtgctatcaaatagtatgtcttattaatnctacttnttgtacctattaactatccccacttccctctattt

SEQ ID NO: 522640 - DNA, 242 bp, Homo sapiens
taccttgaagatctgaagtccaagagctctgaatactactggctagaaaacaaatgcgtatgtctgaactacctattgatactgtgagttcacatgttactagacaactggatgaatgagtcttttggcatcttaaaacagtatacacagaattctctctgcaagtctgatcatgggtgcagaagatacaggttgctacaggattatacttttataacacagcagatttcacaatgacgaac

SEQ ID NO: 522641 - DNA, 319 bp, Homo sapiens
caaatagctgggattacaggcacccaccaccgcgccctgcttatttttgtacttttagtagagatgggttttcaccatgttgactaggctggtctcgaattccaggccacaggtgatccacctgccttggcctcccaaagtgctgggattacaggcatgagccaccacacctggccccctgtatcttttatataatgaaatctgttaattcatattgatacctttagttccagctcaacaccatgaggtcattgtagtgtgcccaaccctcctcccccataatttgtatttatcctatcaatagaatgagcctagttcg

SEQ ID NO: 522642 - DNA, 554 bp, Homo sapiens
gactctagcaggatctgaacagcggctcggtgtccagtcagatgaaatgatttatcagatgtactttcaggaaatggaaggtcagtagtgcacagctggtgagggtagttcacatcttttcactggacttttgggagttggaaccttggcctttaactggtggtggtcaactaagtgatggaaccagaatagaaagggatgatgcaagtacgtttactgtgagttccttcggggttactcctgcagtaggtggactatcatctgggacagttggggaagcctcgacaggcctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaaaccagtggctgcccctggattcttcattcatccatctgatgttattccaccc

SEQ ID NO: 522643 - DNA, 90 bp, Homo sapiens
agttccagctgatccggcagacactcctcatcttcttccaagacctgcgcatccgaagagagtgcttctggaagcatatgcaagaaactg

SEQ ID NO: 522644 - DNA, 378 bp, Homo sapiens
  misc_feature (371)..(371): n is a, c, g, or t
gctttttgcatggctgcttcattttcacctttgaggctgcctgccttttatcttggattaaatgtattctcttatctaaattctcagtatttatcagagcaccttgtttgtttgagtctagcactttagatattatttggtaatttactaatttattatgtatctcccccagtaaattttaagctgagaacagggactgtaactgttttactcacattatatttgtattgctttgcacagagactagatattaaatatttattaaagataggaaataaggaagtgatgctactttgtattcaaaggctttatatattcctaggacctttggcttatcctgtttaaaaacaggacctagccatattaacctnatattag

SEQ ID NO: 522645 - DNA, 210 bp, Homo sapiens
gtttgtgtgatatcgttggcacgtaagagccagtcaacagaccctgcgccacactggtcaggtcacctagggtagctttaaaagtgcaggtttggctgggcgcggtggctcacgcctgtagtcccagcactctgggaggccgaggcggcggatcacgaggtcaggagttcgagaccagcctggccaacatgatgaaacccggtctccacc

SEQ ID NO: 522646 - DNA, 353 bp, Homo sapiens
gggagagtctggctctgtcgcccaggccagagtgcagtggtgcaatctcggctcactgcaacctctgcctcccggattcaagctattctcctgcctcagcctcccaagtagctgggactacaggtgtccaccaccaagcctggctaattttttgtatttttagtagagatggggtttcaccatgttagccaggatggtcttgatttcctgacctcgtgatctgcctgcctcagcctcccaaagtgctgggattacaggcgtgagccaccgcgcccggctgcactttttaataaacaacgattctgcagcaagtctcggccgaactgtggggccttcccttctgtcgtcttctc

SEQ ID NO: 522647 - DNA, 313 bp, Homo sapiens
ctagaggatcggctgctgtctgctctgtggaatatctgtccacctacagcctggggccctgcttctgcttctgggacctggcttggggttttctagctgcccaggctgagctcttcacactccccccacctccccactgttgaacactgccacttctggcctctcccctgccagaatcttgactatcccaaccctgcaccataaccgtcttcctggctggcttgggggatgggagctgtctgcccagggtacagagcgaggttggaaaggttgagagtcatgatgctcagagccagaggtcacactgctggtt

SEQ ID NO: 522648 - DNA, 385 bp, Homo sapiens
tggcgagtctctaaaaactaaaaatagaaatattataccatctgatctagcaatcccactgctgatccaaaagaaaggaaatcagtaagttgaagaggtatctgcactcccatgtttgttgctgcactgttcacaggtagccaagatatggaatcaacttaagtgttcttcagcagatgaatggataaagaaaatgtatatatacagcaatggaatattatttagccatagaaagaataaaattctgtcatttgcagcaacatggatgcagaacattatgtttagtgaaataatccaggcacagaaagacaaatatcacaggtactccctcctatgtgggagttaataaaaggtcatcttatgaaggccgtccggggtaaggctg

SEQ ID NO: 522649 - DNA, 114 bp, Homo sapiens
ggtctcatccgcttcctccaccacagtcatttcttcttcccgatagcggcgcccttttttggtcatcatccgcttcctccaccacagtcatttcttcttcccgatagcggccgc

SEQ ID NO: 522650 - DNA, 1507 bp, Homo sapiens
ctctgggtgattttacgcatgtacttaagtgttaaaatcacagtaaatggtcattagtctctatcagagattgagattaataaacggtattcagagtgttaatgatttaacacttacaaaaggtaaaattgcaaaactgcaatgggtaatgaatctaatagtaagtctaaataggagaattattgtaatatacttcctgtaattgatgaaaaaatatagagaatggtttttgaaccagtgacatgtattattgacagcccccagttttggagtacacactctagggcctttcttctaatatatgtacagattaagccatttttcttgccctatgctcaggccctttaactcctcaggtgaagttaatttaaatgggtaattgatcttcaactatccaatgacgttgtgcttttcctgtctgcctgtcctcatcccaaatttaacaagtgcttatatcgagtttagatcacgagtgtattgcagtattttgactccgtcttaatgccataatttttgtcccaatcttgttcagcgttacgaagcagttcatatagatgatctcatattcggtggcctgactgaccttaggtgtatactcagaagcaatgggggcatcacaatagtggctgctcatttataatacatgatccggatgacattgattcccctacagtgtgccaagggtaccactatctcacggagagagaaacaacaggtggtttctaaccctgcttgatctaacacgtggatctaaaacagagcctatccagctgagcacacattagccagactacttgtttcctttcttagatcctataacgatatacatgacatttcatctccacaaccccaccacaagccacacacccacctcctataacaggcgaagacagcgccagcggccatacggccacggggaggcaagaccggcagggaggcgagcgagggagagaagcacacagaaatgacggggcgacgaagcaagcgcgagaggggcaagggacggcagggcgacgccgggagcagggcgcgagagagaggaccagggggagcagcgcggcgcactagcggcgtcggcgagtcgggtgaccaccgaacgagaccggagcaccagagaaggcgagcagcaggcgacacgacagcgacgcaccgggagggggcaggcacaccgacagcccgcccgaaggggcggaggagccggccgggggccggcagaccgagcggccgcgcgcagcgaggcgcgccggcgcgacgggcgcccggaccggcacacgccagacgggcccgaccccggcccacgacgcaggaccgccgaccaggacggcggagaagggagcggaggccgccagcgagccagggccgcgccggcggcccgaccgcacgagagcagaacgcggcagacacggaggcgaggccggcgagcgcgcacgcgcgccaacgccgccagacgcagccgacgaggccgggcgcgggagcggcacgtcgcgcggcacgacagaaccagccc

SEQ ID NO: 522651 - DNA, 431 bp, Homo sapiens
ggggctgatcgaccaaaatagagtttagagaaatgtaccttgcacatgaaatgttgctgtgatcaccccattaatgttgaaaatcctgctgcttgccctggttctttccgtacttccctagggacacagagccagcaccaaaggatcattatccaagcgacgccgtatgctgcaccatgacagaacactatcccatgcttatgtataaatggctaatgactgctgatgcgcacatttaacccaattgctagccgtgcgacactgactggtttaaacttgaacaactgccagtctggctaaatactgacgtacctatcatattccttttgtcgcacattctcattagggcaatttttatcacatcaaatacactcatttcaatagtcagtttcaacagcatattactcttgatcaacaatgacatctcgttt

SEQ ID NO: 522652 - DNA, 305 bp, Homo sapiens
  misc_feature (251)..(251): n is a, c, g, or t
  misc_feature (295)..(295): n is a, c, g, or t
ggtgattggaacctgtctgattttacaggagtggcccttgtggcgagggatggaattccaaacccgtttcctttctgatgggttttggggttcccgtggggccaggagtcccaatgctcccttgaaatgagtggatatccaagctagcagggcagagaaggggatgtggcaaaacgaatccacacctgctgtagttgaatttgctcagggcagctgagacgcgtggtcctgagtctccagtcacacccttnttgcacaagcagtttgggttttgcttttgaggggggtcatttgnttcttttccc

SEQ ID NO: 522653 - DNA, 80 bp, Homo sapiens
  misc_feature (9)..(9): n is a, c, g, or t
catcatctngccatccatctatccatctacccacccacttaaccacccttctatctatccatccatccatctactcttct

SEQ ID NO: 522654 - DNA, 813 bp, Homo sapiens
tcgggagaatcgcaccatgcacctttcatgcgatctttctctcacggactacttgctcaaacacatggtcacgcacaccgcggcgtgcgcgccttccagtgcaccgtctgcggcaagcgcttcacgcagaagagctcgctcaacgggccacatgcgcaactcactcggcccgagacgtgcgaccaaatgccaccgccatccaggcaaaagggtctttcttcagcacacagcaggcgcctagcatggaagcgcccaaccgtgcccagggcgcacaccctgcgtcccatgatcggccgctcggggcacttggaccatcgcccacggttggatccggggcctacccgcacagtacggcaacgcccgcatgcgaggacctagctcggttccacgaccacctagaacgccactgctgccactccttgaggcgccaggtcctctcatcgtaccctttcaaccctattactccataccagggcataagtccgccttaccgtcctctcctccatgtacttgaaccctccaggtggtaccgggctggggtctggtgctggttacgaccacttctgagaagatggactatcttcactagcgtaaaaccgggacgctcatggcagcatatggaccctggcccaagatttgactccggttctcaccccgccctctcatgcggtgctggtgggaggatgggggccgcttgcctgccccagggtcaggctgggcaaggtccctagctctctacctcaagctgttactcccgtcatggggctgcctaaggagactcaagtggacccataatatacgggggctggcctt

SEQ ID NO: 522655 - DNA, 331 bp, Homo sapiens
  misc_feature (306)..(306): n is a, c, g, or t
ggaacagagctacttcgtacgtctgggcgtccctgtcggatgaggctgcggcagcacgcctatgagcactcgcctgggtcaagccttcgagtccaccaatgcagatgggcacatggaggcgtctgcatggcagcttgttcggcatggcgccctatacgacgctgcaatggcatagacatcgtcgagagcaacggccagttggactccagtagagctggctgagcaaagagccgagcgcacgaaggcctgcaacacagcactcgttgcgcgttcaagtcctcgggacaccccacgtaacacgccganaggcgtcccccaacgtgtgtccccc

SEQ ID NO: 522656 - DNA, 132 bp, Homo sapiens
gggaatatgacctgtcagctgctcctgcagctcagagatcacgccttccagctcccgtttctcgcgctgtcctgcgccgcggaatctccagctgcagctagaagtccgccgattctccgcctccaggtcctt

SEQ ID NO: 522657 - DNA, 223 bp, Homo sapiens
tcttgagagatatcaggcgatgaagagacgtagtagcatgcgataagctgcgagaagatgagcaaacacacattgatccgcagatttccgaatggaggaaaaccggccgaaaggtcatcgtatactgaatacaatagggatacagaagcgaacgcagtgaactgaaacatctaagtagctgcaggaacagaactcaaacgagaggggctcctctagaagtcga

SEQ ID NO: 522658 - DNA, 219 bp, Homo sapiens
ttggcggcatcgggtttgggaatatttgcgggacagggagtagccctatgtaggtccctgccgacagcgcgaccgcatgctatggctatccatcatcccggaatggggacagggactggaatgaaggactcaagcgctgccatttgatagagcttctatggctgggacaggaagactaagttgatgatccccgccggaaaggctggggaccgagctcga

SEQ ID NO: 522659 - DNA, 593 bp, Homo sapiens
gaagaaaaaaaaaacagtgggaacagagttgtcacctacctaacagggctctctcagagccctgttaggtaggtaacactctgagaagagcggggaggcccaaaaggggctggacagaaggtacaagtgacaaatcctgttcgttgggctcacagggttctcgagcagtgggtgccgcagcggggaagttccttgctaggagggccagggccgtgtgcccaaggcgttcgagttctctcagtgccagaaggaggcaaatgcccaggctgtcagcattttccagaatgagagcagaaggggagaagccttaaacccagggtcaagacatccagcaattggagtccgacagcccagcaccatctgggacacctgagaagcacctctgcccggccccacaccgtgttggaacgtgaggagcacctctgcctggccgcaccccgtcctggcaaggtgacggagcgcctctgcccggccgctgtgcaaacttccaagtgtgaagtgacagccttgtgtgtcgatgtttctgccttccccaagttggcactttcgacattaaagtttacttttgagttaaacaacaaaatcgagaaaaa

SEQ ID NO: 522660 - DNA, 855 bp, Homo sapiens
gggcaataagtcgcaaggtggacactacagtagagggcgaccacgcgagggagcgggacgcccgaagatacaggggtataaaacacaagcggggctattaagccgcatgggcctccaagggcccccggcacaacgggaagaaaagccccgccccatccgggaacaaaaagcggtttcccccccgccgcttggactggtaaccccgcgcccaagctacacctctggcagcgtaagggcagtccaaccaccccgaagcgggtgtagaacactgcccccccttctggccccccaacttcacgaccttccacttcctctcgaaacacaacgccccaccaaaccattcttcaggacacagcaactctagaaccacccatcgtagcagtaaacaagcacttttatcccctaacaggttaaaaaagagcactctccccctgactctctggcacgcgtcatcattttgtttcctatgtcaaatacccacacgcgcacacactattgggagtgggcacctgcaaagacacattttctccgttcagacaaaccccaggatacgtctatccatgggtgggtaacgctcgggtggactcttcccacagagcacaagcccagtgggggccaaaatagctttcaggaagggccacagacacaggcggctacaaccctcccaggcggtggggcccctaaaagagccccgtctctacggtgaatgcactaatgttactcagtgcggcctctgccgtgcttaggttatctgctctctctgttgtgtctttgtgaagccacacgcccctggctctgcagttgcccaaaagagaggaatggtaaaaaaccaggaatattgcccccacaaaaaca

SEQ ID NO: 522661 - DNA, 629 bp, Homo sapiens
tactggttcaggggtgctgagaaacatcataacatcacttttgccactactcaatgactatcctgttactaaggttgggccaaaattaaagggggggtcataggcccccacctctttttttattttcagacagggtctccctccgctgtccaggctggagtgcaggggcgcaatcatagctcactgcagccttgacctcccaggctcaagcaatcctcctgcttcagcctcccaagtagctgggacatgggcatgcatcatcacagctggctaattaaaaacatttttttgttgagacggagtctcgctctgttgtccaggctggagtggagtggtgcgctctcggttcactgcaacctctgcctcctgggttcaagcaattctcctgcctcagcctcccgagtacctgggattacaggtgcccaacaccacacctggctaattttttgtattttagtaagagacaggatttcaccatgctgcccaggctggtctcaaactcctcagctcaggcaacccgtctgcctttggctcccaaagtgctaggattacaggcatgagtgaccatgcccagtctaaaaactttttttaagggatgggtcttgctaggatgccaggtggtcttgagt

SEQ ID NO: 522662 - DNA, 137 bp, Homo sapiens
ggtttttaaaggggggggggggggggcccccccccccgggggggggggtttttccccttttttcccggggggggggctttttgggggggggggcccggggggggcctttttttttttaaaaaaccccccttttttta

SEQ ID NO: 522663 - DNA, 1482 bp, Homo sapiens
tcttaaatttacaaataaccaaaaaattttatattttcctacctggcaacacatttcttcaaagggtatagctgctgaacaactacagtgctctaagaattcacagaaatattcaatacgtcactttctagggtttataacagttattttagactttacaccacaagaagttatcaccgaacaacacacaaacacaaacaaaaacaaaaaaaaaacaaaaacaaaaaaaaaaaagggggcgggcgcccccacaaaacgagctcccccccgggcgggcccccacacccacaggacgcacgaaccccccggatgacttacgacgaccaaagacggagggcgccccataccacggggcgcgcggcccctctcactatacaacccacgagcgaacagcgagcgacacgccaagttaacgacaacacagccaaaacaaccgtcgcggacacacaccggtagtccagaggccgcgcaacccactgacgaaacaacaaaccaacaacataaacctgcatgcccgaagaccacaaacagacccaccacaccacccaccaccaacaaaaaacgacactaacacacacacctaacagagaccaaccaacacacacaaaaacaaacaaaagcacgcgacacccatcaccggggtggtacaccaaaacacacgcagcaggagaacaacagagccgacgacgcacttacatggcaacaacgcagtccctagtcacagccggcgcgacacactcccatccaccatccacacaacaaacacatgtaacaaacaccaccaaggacagataaaccacccaacaagcaaacacaacccccacaacgagagctggacagaccacaagatcacgccagggcgacgcttgccgcgcgacgtgcggcgaccgtccgacaccaacgcaagcaacaagggcaccgcatagtccaccacgccacaccaccaagacgccgaaagagacggaaacacgagccgggcccagacggcggcgcggccgcgacagaacgggcgtgttacgatcgcgagtgagactgggtccgagcacgcgctcgtgactgagagtccgtcaacgagcggcgagcgtagagtatgtggccgtgctgatgccttcacaagaacaggttaagaactccatgcgtcgaaaacggaaaaacggcaagtcgcgtagacaaatacgaacgcacacaacggagagctaatgattggacagtgcagccatattgttaaatactaagatgaaagtctatacactttcaatccagccagtgagatagctagtcgaccagctgagagtgcgatgaaccatccgattcgaggtgtgttctatgtcaattcgtgcatagtcttgtgtattgtcgtaatctagttgcagtagaatagctaataataacaacatcacaagacaataaggtcaaggattaggagaagcacgcctactagacatagactcgcatccgactaccataacataccgaatcatt

SEQ ID NO: 522664 - DNA, 115 bp, Homo sapiens
ctcgggtcggcaaaggatgtcactggaggggatacaagacggaatatttggtagacaataaagttcacgcaagaagaccctttggtcgaacccccttggccgacctttggccgaa

SEQ ID NO: 522665 - DNA, 924 bp, Homo sapiens
ccacctctcgaaatttttcctgccccccctgccacaacattcttggggaccattgagaaggactacctttttaaacgttccaaatctgatacctttgaaaagggcacactcttctcgctccgggtaataaacaaaattttctttgaacacgcctgggtcaaccctccctaaccccttgtttacacggtggttttaaataccccccgctcccacaggaaaccttgttatcccattccatcggtgagtatctctcgcgcaaaaagcctctcttctctccctttattgtaagcgccccccacctctgggtgagaaacaacgtgcgtgccactcaccacctcagtccgcgagccccccccggtggtgaaacacagactgaggcatcggttgatgtgattaccgtcggcaaaaagtggggtatctattaagaacctccagagggaggcccaacttatttatggagggaaagacacaaaccaccctagtatggccacccaccttctctttgcccgcctccgcccagcgcgaaacctgctggtcccccacatggtgtattattatgttcatttcgggctgttcctctaatggagcgtgtgagatagattcttgttaaagattagtcgctcacacgctagattcataaaatatggggacggaccaccatgcactgtttcttatagaaatgatatgatgtctatataattgtttgtcccacaatttcgttatatgtattaacaaattaactgtgacaaacaacaaacagataatcgatctccattaagtcgttctctcctccgccccccccagcattgttttcccaccgcaatcacattgaacatcaatcatcagtatggacaagttcgaagataaaatggcgcccccctttatagaaaaccaaaattaacatttaaaacccccaacaaaaca

SEQ ID NO: 522666 - DNA, 197 bp, Homo sapiens
cctcctggaggagacgccgactgtcagctgccggtgaatctcaatgaggatggcagtcctaatctggacttcaaggcctgaagagcagtaccagcttgacatcaaggatgagttcagatgttccccctgtaggagctggtactgtggagcgtgaggcaggaagacactaggtgttgcttctcctggtgtaatggctg

SEQ ID NO: 522667 - DNA, 134 bp, Homo sapiens
cccggcgggggcgggcccccccccccccccggggggccctttgggtgggggtttttcccggcgccctttgggcccctcccggggttttggggtgcccccccccccttgggggggggaacccccgggggctttta

SEQ ID NO: 522668 - DNA, 401 bp, Homo sapiens
aattttaacggtggctggtcggtgaggcagtgacgctgctgcagtcctcgatgaaaatatggattcacaaaccacaggcggtcattatcctaccgacggaccgatttcacaggacacagtttgcgtcacgggctgtgggcctgaggctggagactaggaggaatcacggtgggcccggtctcttgaggggctctgaatggattcccatcattatcttgtggaggattcagcgaggagtaccagaaacccagacccaggttggcagatggtctcaaggtccgtgaagctgctggcctcaaggatggcctgaggtagccgcagtgtgaagggcagtaaagtctctactgacacagtagaaacgcaaatcaatctgaagatgtcctcaaacaccaggtcattca

SEQ ID NO: 522669 - DNA, 470 bp, Homo sapiens
  misc_feature (27)..(27): n is a, c, g, or t
  misc_feature (417)..(417): n is a, c, g, or t
  misc_feature (461)..(461): n is a, c, g, or t
gtctccagcagcagcggcctcgctgcnccagcctgttgtcgcgcaccttcctcctgcaacagaatgggatacgacacgggtcttacacagcctctcggaaacatatctatattgataaaaatacgaagattatttgccagggtttcacaggcaaacagggtacctttcacagtcagcaggctttggagtacggcaccaaactcgtgggaggaaccactccagggaagggtggccagaagcacctgggcttgccgtctttaatactgtgaaggaagccaaagagaaaacaggagcaacggcttctgtcatctatgtccctcctccttttgctgctgctgccattaatgaagcaatcgacgcggagattcccttggttgtgtgcattacggaaggtattccgcagcaggatatggtgcnggtcaagcacagactgacacgccagggaacgacgaagctaatcnggccaactg

SEQ ID NO: 522670 - DNA, 1514 bp, Homo sapiens
  misc_feature (313)..(313): n is a, c, g, or t
  misc_feature (912)..(912): n is a, c, g, or t
gcacacatggtgcgggttacagaaatggaacagtgtctaacctgaagcgtcctaacgagtggagaggtgcctgactactatcctggcgtgcgtcgaagacatggttcacgtcgagtacaagctccctggcgactactgatggataagagcagtcgctgctgtgtgcctcctcgcactcctgagggcgggcttacttcgcaggcgccgctacactacgagatggcacatgtcctcattagaagtgggtggactggtggtcctgtgtcaggatgcgtggaggaatacacgtcgtttctgggtctatgggctgcanccatggcatttgacaccactgcgcggtaggggaacccaagtcgggtcgagtccctgtgggaaggtatattagacgtcgcaacctcatgagtcacgggtataggttaccagagtcggcctattggcatccaatgcccgctcgatcgatacgtatgctaattggtactaggtggcgacccattgttgctgctcgcttgtcttctccttcgcggcagcggtgcgcgaaagactcccgcgatcgaatcgatgctggtccaacctaggttagggggacccgaaggctggtccccgcgccggcatgcggtcgggaggcacaaagccgcattgaggctttggggggacggtggtggaattggggctggttatcctaagggggcgtctcttatccttcatattgtggccccttggccagttcggcccagccgctgaacaccgaatatggccaagaagctccttcaccgaaaggtaagaatggttttcggttggaacggcgtcggtgtggccgaacgaagtctttgggcccccccagcgaatttcgcccttcgagaaagaatttgtacaatacctagacaaagggtgcattttttcttcgtttcgatnttattccaccgcggaggtttgggggagcctggccttcagaggagaggacggcgaaatcgaccctatggaagcggggaacacaaaaataccagccacccattataaacgggggtaaaccccattgggttggctcgaagcgcggccatctgtttagcgcactagtttgccaatgtgccccaatgaaacggccacaggggagtttggttgggccagattatgagcagcccccacctaatgtgatgaacgcgcgcaagggggttttccgtattacttgggtctgaaggaaaacccccctttggtttggaagccgtggacggaaaagcatttgggcttaagcattaaacgtgggcttaagcggggaccgggggaaaaacatcggggacttcgaaacgttcgttggggcctgccggggttgtgagacagcaagttcaaccaagattaattacgtggagacgagacagtttcccttatttgggccgccacatctttatgccatttttatttacgcccacgggacacgcaacaacaacacccattatagagagcacacattcatacagcgcgcgtaacacgcatattactaatatcatccagagcggggc

SEQ ID NO: 522671 - DNA, 335 bp, Homo sapiens
gccctccacagcagcacaggccagtgacatcaacacggcttcagggggcagcagagacccgacaccatggcatgactgtcagtggtaacacaagccaccgacatcaatacctccccctgctgcagcaggaccacagacggacccaagcacggccctgggcagcagcagtcaaatatacgtggcaaacattttttatcagccgagggatcaacgagggaccatgtcttttgtttttgttgccgttattaatctttttttgttagtctgtttcttttgattggggaactgagattattaatatatagttattaaaaagcatgtattatttcctgtca

SEQ ID NO: 522672 - DNA, 453 bp, Homo sapiens
acagttccagagcctgacccaccagtctccaccccagcaaaacgtccagcctaagaaacaggagctgcgtgctgcctccgtggtccagccccagcccctcgtggtggtgaaggaggagaacatcatcaccacatcgcagcgagccttcgccctcgctgcggcgagcccccaagcaccggagagctcagccccgtcactgccacgcgaatgaactgtggatgtcgggagcgtgatcggcccaagcaacgcacgcacaggggcctgacagacaacagaacggagcgagatcagtgcgccaaagactgaatcagacatggctctggcagctatgcaagcatcgacaccctctcacagcagtcatcagcgaagtcgagcagtcgcggcgtcggaaagagacgtgagaggccctgagtcagcgaccgctgaaggagagagcgtggagacgctgagagc

SEQ ID NO: 522673 - DNA, 282 bp, Homo sapiens
tgaaatacccagagtcaggcccggaagaaattgataatcctcattgtgctagtagttgtgttgctgggcatttagcattgattattggactttccgtctgttgctgagttaagagtcggctatgaggctggtgcgctggaactcaactgtttcactccggacttggtgtggcaccctttcttcggcttgagatggggctgaatggctcctggagcggttacccgtcttggttcttgacccctggctgccagtacattccctgggatgtgctcttaccggtta

SEQ ID NO: 522674 - DNA, 124 bp, Homo sapiens
tttgactcatccagctaacgctgcaacttctcttgtaccttctgtagccctacttctacttctctttctctagcagctgtgtcaacaggcttaggaggtaccgagctcgattgcgtcctcgtgg

SEQ ID NO: 522675 - DNA, 620 bp, Homo sapiens
accaatcttacaaatactagggttggattttgcctggccttatgatgtacatcttttgtaaagaggtcggtagggctcttcgctatacaccacttggataagggcatgttgtgcaagcgatctaagatcggtactccagtgttttctcagtcatcacgttgttacactctggccagtgaagtgtaatccgactcgcaatgggccaactggggactcgggcaccccctcgagcttttgtacttctctttcctttacaacaggagtgtccaatttagcttatatttgcacccaggctgctcggcgttgcatgccacaggactacaggtcagcgactggccatctgcttactttcagcccggccagatgtcagttggataagcgcagcagctcttgatgactatcaccaggtacgtcgcagtgctctctgcactcattctctgagtagtacttgttcccgttgccgtggcagcctctgtagtggaaatgtacgctcttccccttgacagcatcatatgcccatagctggatgaaggcttggcacgggcccggaactatggggagattgcaggccgccacagttcggcaggtctgcgacactccttttgtgtgacgaagttgtc

SEQ ID NO: 522676 - DNA, 350 bp, Homo sapiens
  misc_feature (207)..(207): n is a, c, g, or t
aaggaaccagagacaacggacaaaccggggagggccacggcgccaaccaaagaagccacgtctggaacggcgccgataagcagcgaaacgactcccaaccacaggaactccaaccgggccagtcacagaggcagcatctgcacccttatacccatcaaccacatcaaactcgacagtttcaccatctccaacacggcgcagaaatanccgtgcgccatcaaaaagagggcagtctgatggacaaagacatcttcataggaggcagttcgattaataaaaccagagccatatcagacgttgaaccatttgacagagccaaggactttggggcgagaacttttttcaccgcg

SEQ ID NO: 522677 - DNA, 892 bp, Homo sapiens
ccagacttgaagaaccgtagtgtgagcgggtcttcgattatagatattgagctgcccgggagtgagcagggagacttgccagagctcaaggagttcgtggacctttctaccagctagctgtgaccatgagaggcgctggtgagggcccagggagggctgtcgtacttgctgacagtgttttcctagagcatataattacaatctttgaaagtcgcacactagatttcagaggttttgtacgatgctatagggctatcagggtggtgggaacatgtaggataaaggcataccaggtctgccccactgggtctggcagccctcccgggatgggcctacatccaacttccagtccctggccaggggtgagaggcaggaccagcagctggacttgatccctctgtgtctttttgcttctggcgtggtagataatgtcaacctgacagtactgatgcccagaccctgtacactcctcctttactgttgtgtgatcagttagtgctttattctgtatttgtctcccatgtcttgctcttctcctggagaattctgtcttctctttggccatctcaaattgagaacctaaacgtattcctgcagaactgcctggtgggcgtccagaagtagtagctctcgttccagcaggaccaagggagccatgctccagtgagtgactccagcaagtggaggcaacgtcatccttgatggtctgggagcctgggctcagaagggggcttcctgactctgggtccagtgaaagctgaattggtctcacttggtgggtcacactcttaactttctggtaggcatcttggccacggggggttacagtggcccgggaattatggcacagggaatgggcttaagggctggacttgattggaagcctaaaaac

SEQ ID NO: 522678 - DNA, 122 bp, Homo sapiens
tttgagtcagcccagcacttcatgtagtttatgcattacgggaatggctgctgctgcctcagagcattgtattgtgtataaagtaaggtgttaaatattcctacttcattggtaccttactt

SEQ ID NO: 522679 - DNA, 443 bp, Homo sapiens
  misc_feature (2)..(2): n is a, c, g, or t
  misc_feature (58)..(58): n is a, c, g, or t
  misc_feature (98)..(98): n is a, c, g, or t
  misc_feature (111)..(111): n is a, c, g, or t
  misc_feature (116)..(116): n is a, c, g, or t
  misc_feature (138)..(138): n is a, c, g, or t
  misc_feature (150)..(150): n is a, c, g, or t
  misc_feature (156)..(156): n is a, c, g, or t
cncgaagtgataacatggtaaacgtgatcttatcagactgactgaatgccgatttccntgggtgatctagttctacgtattacagggtgtaatatcgngagtgtaaataanggaangtacactgattaactgacgttnctcgttgttctnactgtnctgtattatagtatgtgggtataatatctacagtatacacacatatgtacttgtattccactattgtaactgaagaagactatgtattccttttttaattccgtactggtatttgtgttatttaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatcccc

SEQ ID NO: 522680 - DNA, 153 bp, Homo sapiens
gaatgtataatattttaattcacactttggtgtactcggttaactcgagggaagtgttgagtcccggtgttttcaaaagatgaaattttttttttttccccttgaacagagtcttgctctgtcacctaggctggagtgcagtggtgcatactt

SEQ ID NO: 522681 - DNA, 652 bp, Homo sapiens
  misc_feature (89)..(89): n is a, c, g, or t
ccactagttacttatagaaaaaaattccttttttttcaccgaaaatttagtttttctacacccccaagggagcccaacccgagggcggncttggggggccagacatttaaaacccaccccgtgggtgaaccaagccgcccggcctttttgccacctcttctggattcctaaaacttataactttaccggcttttaaaaaaccgacgaatgccttatgttttttacaaacccaaacagtttttttttaatagggcttctaccccaaagaaaataaacgtgaggctctcggtcttaacagcgaaactttgaaattatttcttgtataaaccacagcgagatatcaccaacccttgggaagcaattaaaactaatatttcaataacgcaatgaagtgccagctccatttacagatggggctcgtgttttagccattttcagaaccaggggttatggcctttttctttgaattctttcaggagaacactctttaaaaaaaaactcctccccctttcgggggaatgtgtaaaagaaacaacaaaggttccccaaaaattttttgtccaacagttttccttccagacacccggttgacaacctttaattatgtcccacaccctttgtaatttgtgggataacaccaatcttcaaggtg

SEQ ID NO: 522682 - DNA, 104 bp, Homo sapiens
cgactgcggccgggatggaggaccccagaggtgtcggcgatgggggtgtacatgggcgctgagcggggtcatgtaggtaaaggtggagtagagccggtgccctg

SEQ ID NO: 522683 - DNA, 320 bp, Homo sapiens
cctcacattttatgagtggcatgatgcctttcgtgtcgcgcgcctcagcgcctctccaccgctcgcccttctccgttggtccacatggagatctggttcctcccgcctagtcgtccgctctccatcaggtcctgcttctgcttgcccaccggtcgcgcacgctgtctctttgtcgccgtccgtgctgaagtcctctgcatgcagcgatgtggtctgtgcgccgtgcccaggccgttcacgaccggtctcagctgcgagcccttcaggctcgttggctaagactgcccgtaggtagcgactctcctcctgcagtgcctgta

SEQ ID NO: 522684 - DNA, 289 bp, Homo sapiens
  misc_feature (101)..(101): n is a, c, g, or t
  misc_feature (129)..(129): n is a, c, g, or t
  misc_feature (160)..(160): n is a, c, g, or t
  misc_feature (192)..(192): n is a, c, g, or t
  misc_feature (229)..(229): n is a, c, g, or t
  misc_feature (235)..(235): n is a, c, g, or t
cttcccacttcagccctccccaagtagctggtacctacaggtgtgtgcccacgacacccggctaagtttttgaaatttattttttgtagagacaggatttncctatgttgcccaggctggtttcaaacncctggccgtaagcgatttttccggcctcccnaaacgttgcgattataagtgtgagccactgcncctggccccacattttctttatccatttgtacattgntggacncttaagatgattccatatctttgctattgtgaatagtgcttcaataaatatgtg

SEQ ID NO: 522685 - DNA, 325 bp, Homo sapiens
  misc_feature (98)..(98): n is a, c, g, or t
  misc_feature (255)..(255): n is a, c, g, or t
atgaaatcagatagcagcagtcactaaattggaaacaaaaggttgcaacgtgacaaaaaaaattgtgtagtatttaccagcaccattcagtaatacanccttaaccatacctccttgacaagttatgaagtagttcaaggaggtatggttaaggctgtattacttcataacttgtcaagaaaagcagtttgcagcaagggcatgtggtgtgcacctagtattaaaattgctttgtcttaaaattgaacatgaggntattaaaaatacattgtgaaggaggactgcttatctcagagtgaagatactgcgggctgaaaagcactag

SEQ ID NO: 522686 - DNA, 955 bp, Homo sapiens
gcttaaaggggccggcgctctacctggcgaagccacccagccctggtagtggagaggcttgggactagaggatgagattcggcctcatactccgcgctgtcgtgtgagccgcacaaccccaaagaccaggctatgtcccaagggcacccgcctcgggcggccgcggtggcggcggcggcgagacttctcctagaggcgtctcggcgcaaccgccaacgccccgagccaggggccgaggccaggaccagccccgagaccagaggctttaccattaccgcagacgctcgcctggagacctgatgatctagcgccctgcagaagtcctgacggaggcgtacccccgggagaccccggaaagacccgagaagccagcacgcgaccgtcattccagtcagacaaacatgggcctgcaggggcaacgcagccagagtgcgcccctgccaaacaacgtccggactttggactttagcacaggaaggcgtccacggactcagctgtggtaagggctcagagatttagcctgtcaccacggcgaagagaaacctccgatctaggtttcctcagatataccatgaggtcacctggaggacagctagtgcaggagccccaggattgtcatgtcaggttaccaatagagacaggcacaagttacaccaagatgattaagagtccagatcccccggtgagaccatttgggccataggagcgcaggaagacagtgcatcgtaatacataccgaaggaaagaagagaggctaaaacgttagcaaccctttgccctttgctaaagtttaaggagactcatcaatatagacagggacccgctcggcaaattaggcgttggcaagtggcatgaaaatgggtacggaaaggagaagggatacatagctggacgtaaggtgataaaggataccccgtgctacaaaatgtctggtacgtgccttgacacaggactg

SEQ ID NO: 522687 - DNA, 435 bp, Homo sapiens
cttctgtgtgtacgtcagagagacccctagcaccagaacggtcaatgctatttcttgagcaagacagtaggcaagaaaataaaagcgtctcttgcctccgtaaccccgtagtcaaattgttaaaagaaggttctggaagtgagttcatcttgacgatatgtaatagctaatatataatatggatagtagagcaactcatgcaaacatatcgtaaactaatgaggacgtagcaggtcccagagttgagggagtggggacctccgaggtcatactacatccatagtgagccatggttgtaagtgctgtggaaaggaaactcagctcttacagtactgggctcaagagacaaagcccggtcctaggtgtttctcccatgagccattgggctttgagcacaggcagagtcccaaaaaagcaaaccaaatgcgcccaaca

SEQ ID NO: 522688 - DNA, 609 bp, Homo sapiens
aactataaaaagaagggggaattggtcaccaagcccgggttccggcgcctttctctctgcccccctggaccctgaaccgtatatcctatggccctgactgaaaggatttttacgtagtggaacccctggcatttgaaggtacccctaaccaaaaggctttggttattggtggaaaggcttgtatgtggggaaaatatgtggacaacacaaacctggtccccaggttttggcccaaaacaggggctgttcccaaaaggctgtggagcaacaagttgacatttgccctgacatttgcctatgaacgtttgtcccacttccgctgtgagttgttgaggggaggtgtccaggcccaccccctcaatgtaggtttttgtgagcaggagtttgaacaaacctgagccccaggccccaaggagggtgctggctgtaggtgaatggtagtggagccaggcttcccctgcatcctggccaggggagggagccccttgcctttgggccccttgcctgggggcccctgggtttggaaaaaaaggggccggggggggggttcgcattcaaaaaaaagtaatggggcatttttttaaaaaaaacatggattccctgggttta

SEQ ID NO: 522689 - DNA, 404 bp, Homo sapiens
  misc_feature (1)..(1): n is a, c, g, or t
  misc_feature (228)..(228): n is a, c, g, or t
  misc_feature (234)..(234): n is a, c, g, or t
  misc_feature (236)..(236): n is a, c, g, or t
  misc_feature (243)..(244): n is a, c, g, or t
  misc_feature (259)..(259): n is a, c, g, or t
  misc_feature (263)..(263): n is a, c, g, or t
  misc_feature (268)..(268): n is a, c, g, or t
  misc_feature (276)..(276): n is a, c, g, or t
  misc_feature (307)..(307): n is a, c, g, or t
  misc_feature (312)..(312): n is a, c, g, or t
naagttctggagaatgcttctgtctgattttatatgaagatattcccgtttccaacgaaaccttcaaagctatccaaatatccacttgcagattctacaaaaagagtgtttccaaaatgctgtatccaaacaaaggttcaactcttttagttgagaacacacatcgcaaataagtttctgagaatgctttggtctagtttttattggaagatatttcctttttcacanaggctnanagcgctnnaaatgtccactccanatantacanaaagagtnttcaaacctgctctatgaagggaatgttcanctctntgagtggaatgcaaacatcacagagaagtttctgagaatgcttctgtcttgattttatatgaagatattcccgtttccaacgaaaccttcaa

SEQ ID NO: 522690 - DNA, 208 bp, Homo sapiens
cacaggaatcaacaaaggaaagggacaggccaggtgtggtggctcacgcctgtaatcccagcactttgggaggccgaggtgggcggattgtgtgagtccaggagttcaagaccagtctgggcaacatgcgaaattccatctgtatggaaaactaaccgggaatgatggcgcgcaccggtggtcccagctacttgggaggctgaggtgg

SEQ ID NO: 522691 - DNA, 116 bp, Homo sapiens
cattcacatgggcctctcttcctttgctgtgccattgcatgggtgcactggcattgcggtgtgcacatccaggcaggaggcaggagagcacgtgtcagcaagtttcaacagcatag

SEQ ID NO: 522692 - DNA, 525 bp, Homo sapiens
  misc_feature (18)..(18): n is a, c, g, or t
  misc_feature (37)..(37): n is a, c, g, or t
  misc_feature (69)..(69): n is a, c, g, or t
cctgctgacaaccctatnccctcctccccctgaatgnccttccccagtggctggaagggccccccctgnggtatcctggttagaacagtcccctgtacacaattccctcccctaaaaacatcccttttttaaaaaaagaattggttccagcccataaagaaagaacaagatccatgccctttgcagggacatgggatgggagctggaggcccattatcccttcataaactattgcaggaacagaaaacccaaacactcccatattcctcacttgtaagtgggagctagatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattgc

SEQ ID NO: 522693 - DNA, 1570 bp, Homo sapiens
  misc_feature (2)..(2): n is a, c, g, or t
  misc_feature (95)..(95): n is a, c, g, or t
  misc_feature (104)..(104): n is a, c, g, or t
  misc_feature (358)..(360): n is a, c, g, or t
  misc_feature (362)..(362): n is a, c, g, or t
  misc_feature (369)..(371): n is a, c, g, or t
  misc_feature (373)..(373): n is a, c, g, or t
  misc_feature (378)..(378): n is a, c, g, or t
  misc_feature (387)..(387): n is a, c, g, or t
  misc_feature (394)..(394): n is a, c, g, or t
  misc_feature (398)..(398): n is a, c, g, or t
  misc_feature (402)..(402): n is a, c, g, or t
  misc_feature (406)..(407): n is a, c, g, or t
  misc_feature (415)..(416): n is a, c, g, or t
  misc_feature (425)..(425): n is a, c, g, or t
  misc_feature (439)..(439): n is a, c, g, or t
  misc_feature (442)..(443): n is a, c, g, or t
  misc_feature (449)..(449): n is a, c, g, or t
  misc_feature (451)..(451): n is a, c, g, or t
  misc_feature (456)..(456): n is a, c, g, or t
  misc_feature (458)..(458): n is a, c, g, or t
  misc_feature (460)..(461): n is a, c, g, or t
  misc_feature (464)..(464): n is a, c, g, or t
  misc_feature (471)..(471): n is a, c, g, or t
  misc_feature (473)..(473): n is a, c, g, or t
  misc_feature (493)..(493): n is a, c, g, or t
  misc_feature (497)..(497): n is a, c, g, or t
  misc_feature (506)..(506): n is a, c, g, or t
  misc_feature (510)..(510): n is a, c, g, or t
  misc_feature (529)..(529): n is a, c, g, or t
  misc_feature (567)..(567): n is a, c, g, or t
  misc_feature (569)..(569): n is a, c, g, or t
  misc_feature (578)..(578): n is a, c, g, or t
  misc_feature (592)..(592): n is a, c, g, or t
  misc_feature (595)..(595): n is a, c, g, or t
  misc_feature (599)..(599): n is a, c, g, or t
  misc_feature (607)..(607): n is a, c, g, or t
  misc_feature (630)..(630): n is a, c, g, or t
  misc_feature (656)..(656): n is a, c, g, or t
  misc_feature (658)..(658): n is a, c, g, or t
  misc_feature (662)..(662): n is a, c, g, or t
  misc_feature (746)..(746): n is a, c, g, or t
  misc_feature (867)..(867): n is a, c, g, or t
  misc_feature (880)..(880): n is a, c, g, or t
  misc_feature (885)..(885): n is a, c, g, or t
  misc_feature (1057)..(1057): n is a, c, g, or t
  misc_feature (1080)..(1080): n is a, c, g, or t
  misc_feature (1102)..(1102): n is a, c, g, or t
  misc_feature (1196)..(1196): n is a, c, g, or t
  misc_feature (1206)..(1206): n is a, c, g, or t
  misc_feature (1214)..(1214): n is a, c, g, or t
  misc_feature (1223)..(1223): n is a, c, g, or t
  misc_feature (1238)..(1238): n is a, c, g, or t
  misc_feature (1250)..(1250): n is a, c, g, or t
  misc_feature (1543)..(1543): n is a, c, g, or t
  misc_feature (1545)..(1545): n is a, c, g, or t
  misc_feature (1549)..(1549): n is a, c, g, or t
anatttttaatgggacagacggaagtgaaaatgtgacaggattggacctttcagatttcccagcattagcagaccgagacaggagggaaggacantgtaacccnactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccnnnanaaaaaannnanccagntgttacctnatggtcnggtnactnacanncctcaagnnatggtcacngaccaatttggaangannggcctntnaacantnannagngcagcananacagacccaggaatggtacntctngcattaggnagtnacttaacaacattaggccncaatctgaactctcctgaaaatctctaccccaaatttncntcaccctgngcatcttcaccttntcnaccncaacacanacacttccatgttccatctgagnacttaacgaacattcacattaggganangctngctgcaataaaacttggccgatatggtgaagaccttctcttctatctctatcacatgaatggaggagacgtattacaacttttngctgcagtggagctttttaaccgtgattggagataccacaaagaagaacgagtatggattaccagggcaccaggcatggagccaacaatgaaaaccaatacctatgagaggggaacatatnacttctttcactntcttnactggaggaaagtagctaaggagttccatctggaatatgacaaattagaagaacggcctcacctgccatccaccttcaactacaaccctgctcagcaagccttctaaaaaaaaaaaaaaaaaaaaaaaaaaaatttcccttttcttggggttatggcttgtctcagcacaantactcaacataactgcagaactngatgtggctcaggcaccctggntttaattccttgaggatctggcaatgggtttacgcaaaaggtcaccattttgaggctcctgccttactaatttattgtgcgtgcccaacaactnaaattttgtnaattggtntttcctctnagtttggagcagggntctgaatttttnccatttatttccctttttttgccagcagacagacttgagtctgtaaagacaagcaaatacacctgacagaagttttcaccatagttctaaaattgttacaaaagaaaacccccaaaagactcaggaaatttagcccccaatttttggctttgtccttttgtgagcccttttggcgtattaaaataaacaactgtttggtcgctttttttattgtgaagacccttctcgttttcattcgggaaagatgagcaagaggtctgcttccttcatttactcccccttctgtttttgananggcngttcgccaagcttaatggcag

SEQ ID NO: 522694 - DNA, 397 bp, Homo sapiens
  misc_feature (27)..(27): n is a, c, g, or t
  misc_feature (42)..(42): n is a, c, g, or t
  misc_feature (76)..(76): n is a, c, g, or t
  misc_feature (108)..(108): n is a, c, g, or t
  misc_feature (177)..(177): n is a, c, g, or t
  misc_feature (282)..(282): n is a, c, g, or t
  misc_feature (372)..(372): n is a, c, g, or t
ttttagtagagacagggtttcacagtnttagccaggatcgcngaatctcctgacctcataatccgcccgcctcggnctcccaaagcgctgggattacaggcgtgaacncgcgcccggccccatatttgtattttaaaatgacccctttggtaaccgtgtggctatttccccgctagnacttaagcaggtaagatgcatttcaataatccagggtgtgaagtgatagggagcctaaactaaggagagtgggcagtagggagacgaagagggaaagatagattncaagagggcagaattttattcagatctattgagccaaaagaatgttaggggagggtaaaaaggagggggaacaattccaaagttcccaangttttttgagtcttagttcaggtta

SEQ ID NO: 522695 - DNA, 734 bp, Homo sapiens
  misc_feature (221)..(221): n is a, c, g, or t
  misc_feature (244)..(244): n is a, c, g, or t
  misc_feature (266)..(266): n is a, c, g, or t
  misc_feature (360)..(360): n is a, c, g, or t
  misc_feature (370)..(370): n is a, c, g, or t
  misc_feature (378)..(378): n is a, c, g, or t
  misc_feature (387)..(387): n is a, c, g, or t
  misc_feature (402)..(402): n is a, c, g, or t
  misc_feature (414)..(414): n is a, c, g, or t
  misc_feature (707)..(707): n is a, c, g, or t
  misc_feature (709)..(709): n is a, c, g, or t
  misc_feature (713)..(713): n is a, c, g, or t
ctatgtcttacgtttgacacatgtaaaatgaaaaggaagatatctaaattcttgaatttgtttttataggagttccatctggaatatgacaaattagaagaacggcctcacctgccatccaccttcaactacaaccctgctcagcaagccttctaaaaaaaaaaaaaaaaaaaaaaaaaaaatttcccttttcttggggttatggcttgtctcagcacaantactcaacataactgcagaactngatgtggctcaggcaccctggntttaattccttgaggatctggcaatgggtttacgcaaaaggtcaccattttgaggctcctgccttactaatttattgtgcgtgcccaacaactnaaattttgtnaattggtntttcctctnagtttggagcagggntctgaatttttnccatttatttccctttttttgccagcagacagacttgagtctgtaaagacaagcaaatacacctgacagaagttttcaccatagttctaaaattgttacaaaagaaaacccccaaaagactcaggaaatttagcccccaatttttggctttgtccttttgtgagcccttttggcgtattaaaataaacaactgtttggtcgctttttttattgtgaagacccttctcgttttcattcgggaaagatgagcaagaggtctgcttccttcatttactcccccttctgtttttgananggcngttcgccaagcttaatggcag

SEQ ID NO: 522696 - DNA, 217 bp, Homo sapiens
aaatgtgtgagatcccgttagaaccatcacaagaccaaatggttcgtgccttgggccacccaatcattgttacaagatccaaaacatttaagatgtcatcccaaggtaatcttgatccttctgatatcatgtatactgttcagcattcccctcccccacattgagatgagtcctctcgtgccctttcgtgctgtttatcctgcaggcgttgcctctt

SEQ ID NO: 522697 - DNA, 830 bp, Homo sapiens
aacaggtatgatgaggtgcggacgtggtttatttcgtcacgggggctcgggttcgtagacgctgtcggtgctagtgtatgctccccgggctgcgcctgctcccccgcaggcccggggctctgtcctgctggtgcccgctgctgctcgccccgagccagtgagaacgagctcgaggagtgatgcctgggcccgtcccgcgctggccccgtggtgagtgcactgccctgctgctgccctgccggcggccatgggaaaggagctggtgctgcctgctgcttgtcccccgcctggcgcgctgcactgacttgatgacctgccactgggcaggccccctggcctgctggggtcccctgagtgacgctggctggcacctgagagtgtggctgctgggcccggggccacgcaggctggatgcccagtgtccagtgaagcgtctgaggaccctggccgccctgtgcctgcctgccatggtgatgtcccatgggcacctacactgttcctcacgtgcttcgccgtgcttctggctcatctggggtctcatcgtcctgctcttgctagcttcttgcagcttccttgctgccgcctgcctcaaacggcgccaggaggagcgactgcgcgagcataaccttgcgcgccctagaacttggagcccctcgaactcgaggggcagtctaggccgggagcccccccgggcctgactgccgccgagcaccaacacactgtaacccgcttggaggggcggctcatgcgcacgcgcaaccaacccgaccacagcctcctgaccgcggctaagactttggtcgccaggcctgagaccgggcagggatcgg

SEQ ID NO: 522698 - DNA, 512 bp, Homo sapiens
  misc_feature (170)..(170): n is a, c, g, or t
agtgactctagcaggatccccaacttcgacgacgcattcaggattgacaacaataaggatgtattattgaaatgtaaaaataaatttaaaacttcaggccgggggtagtggctcaagcctgtaatcccagcactatgggaggctgaggcgggcagatcacctgaggctgngagttcgagaccagcctggctaacatggtgaaacctcgtttccactaaaaaatacaaaattagctggacatggaggtgcatgcctataatcccagctactcaggaggctgaggcaggagaatcgcttgaacccatggagacggaaagttgcagttgagccaaggatcatgccattggcacttccagccctgggcaaatggagtaagactccggcgtccaaaaacaaacaaataaacaaagaaaagccttcattttactcatttgatttcaacttatcacccttcccagtaagtacagaatagtaaaacggcaggccaattaataggctgtcaccttctctgg

SEQ ID NO: 522699 - DNA, 211 bp, Homo sapiens
gcatgtatccctgatggcatatgcgtgaataacgtaacatatgacttatggctatcagtgtatcttctttgctgaggtgcttattcaggttttatagtcaattttaaattgtgatagtagaaatgtcttatttcagatataaaagagttctgtataatattttggatgatattattttaccagatatgtcttaggtaaaatattttatcca

SEQ ID NO: 522700 - DNA, 148 bp, Homo sapiens
ggcggcggaggccttggcagctcgggacttagtgcaagagtcagcatgactcttcagaggctcttcaggctctcctctgtcattcggtcagccgtctcagtccagttgcggaggacattggtgttacaacagtgcattaataaggact

SEQ ID NO: 522701 - DNA, 119 bp, Homo sapiens
gagcagatgctggaggatgaaaccctgggaaggctcctgagttgtctacccattgacccagaggttctttgacagctttcaaggataggctttattctgcaagcaatcaaataataaat

SEQ ID NO: 522702 - DNA, 157 bp, Homo sapiens
gataataacaataaaatgtgatgcagataatagacagattttcaagttatggaaaccagattgagacaattagaattaaagatatctactaaatgcattgaagatgagtatatattgattatataggataacttttaatctttcaatattaaactat

SEQ ID NO: 522703 - DNA, 267 bp, Homo sapiens
gagaggtggggagcagagaatctcttaccaacacaacatcttggtcagattgaacctcaatctcttgcactcaaagcttgttaagacagttaagcgtgcataagttaacgcccaatttacatactctgcttagaatttgggggaaaatttagaaacatataattgacaggacttattggaaatgctgttataatgaatgaaacatttgcatataagcattcatatttacgtcttatacatttgataaagtaaggcatggttgtggtt

SEQ ID NO: 522704 - DNA, 1415 bp, Homo sapiens
attaccgctgcgacctctctgtcttccagttgtatagccccgcgggcagcggggggcgcaacctcaccacgactgggcatcattcgagacgcagacaccaacaaggtggtgtgctcgtcaccacatcatgcacccgacctaccgacaaggaggatcgctggggtatggtggacgaccgcgtgtgcaagaagtgcccgccacagcgcctggcgcgtcctcgaggcacggagtgccgcaacgtacccgcacacactagctcatacaacgggctgtgcagcagtacttccacgctgcgccggtcctatgcgacgccacactgcatgcagacgacccatggcccatggaacctcaacggctccactcccaccttgcagctagccgcctagacatcacaccgcacgacgggctgtgcgacgatccacgcgaaatccgcctccgcggaccaccgagccatcactcccgccgacgaagaccttaccacgcgctggactgccgcacgtccggcagaacacccgccgaacgccacccacccgaccacctgcccccctactcctctggcgaagcggcccggaagccgcgccccaacagacacgactactggcgacagccctaaaaaaaacatgcacgagggacgcatgccgagcctgtgacccccggccaagacacgctataccaaactgacaacatcggagaggccgaccaatacaggagaagaggaacaatctccatgcgacacactcacgcctacaatgggccacttcaacgaaccacgccatgcccaagcaaccaccgccccacctagaccaagacgcccgcccatgcacacctgggccccctgccccaccgcgaccccacctaaaccgcatggagatagacaacgaaagcggcaatcccaacgggcaacaccctgcgacctgcgagaacgaacacccccccggagtagaaaccgtaaccacccactacccacgatcagacacactgctaccacgcacaccccagccacgccgccacatgcctcgcctgagcaaacccaccagagaacatgacaaacccacgaaaaatggagcccgcatcaacaccacatgcaaacccagcccgagcctcaccgcgccccaacacacaccgtcccacgaccccccacctccgaggcacacaacatcgagaccgcacacctgcccccccccacagcccgccacaacatgcccgatgcaggacaccgacacgcatcacccactaccggcacgaacccacacccacggcaagaacagcactctagacgcacccccacccatacggcaaccccacgcggcccacagcaccgccgccaacaccgcaccgcaacacagacaacacccctcgcagaacacacacgcacagctaatcccgcaccacaaagagcggcacaccgagtacaa

SEQ ID NO: 522705 - DNA, 128 bp, Homo sapiens
acgctcggcccgctactgcggccaggctttttatttaatgtaaatagttttgcttccaatgaggcagtttctggtactcctatgcaatattactaagcttttttctattgtaaaacagaaaaatcaac

SEQ ID NO: 522706 - DNA, 834 bp, Homo sapiens
agcgggctcgggctcgcgaggccggggggacacggggggcgcggcaggagccgcgcgggaacccgaggctagcgcgcgcgcagcgcgactctccttgggctgctgagggctggagcgatatgccgtggaggcgccatgtaggggcctacgctagtcgctgtaggtcgggccgacgctggcccgatgcccagaggtctatggagctattgcgcgaccggagcccaagtatgtgtagtgattgtctgctagtgcaccgggatagcctcggtgccctgcgctgggcttggaagggcccttggtgagcgtacgcggggggcgtcggtgcgcgggcggtatggcatgggcgtgctgctttgtgcggtgtggtctcgggcagtcgtgtacaactagttcgagtggctcacttggcgaagaggatcggaactaagatgcaatccgtcgagcctagtggagatggcaacccccgaataccgcctgcgtgcctggccatcgaaagctgcgacatgcccgacattggcgacaacgcagcgaacggacgtacaaggctgatcgtgcgctggtatggtccgcagacggagcctagatggtggtgggctccccatagacctgcaagcataccagtcgcaataaatcaacatcccgcataaagcctctgacagcgagggtggatgcgacgggagggagctatgccggaattaaggcgggggggttaatatctagtacgcgggctggcataggtttcggaggaagtctgagcgactttaatgatggttaatgatacggagactgggctaaaagcgcctcgcgaaaatgctgttaagatgtgcggctatt

SEQ ID NO: 522707 - DNA, 414 bp, Homo sapiens
ttttttttagggcagttttagattcatagaaaaattgagagacaggcacagagacattccctgggtccatctggtcaacaccctccaccagaatggggcatctgtagcatggacaatcattgtcctcactcagtctacaccctacacagcattcatgctttgagctgcatgttctgggttcacagatgcatgtcttctacaatgtatacagaccagcttcactgacctcggataccccgtgctccaccttgtccatattttctcaaagtgtttcaaagcccccagattcaatagcttccaggagttctgatttgacactcatggggtcaaagtgcaggcaaatggtggaacctctggaaggtcatcagacacacaacctggtggttgcagcagaaatcaccaggcaagtaggta

SEQ ID NO: 522708 - DNA, 294 bp, Homo sapiens
cgcccgcccgccgctggagcggctggagaagcccccacctcccggcggcctttgttagcccggcgggaacacaccaccctgctcagctggcttcctgccggctccctccgggactcatctcggctccgtccccatggaggtcatcggcctagggaacttctcgaggcttttctccctctgctgctgacgggaggccgaaggagggcacagcctccactcttgggaccctcctctgtgaaagatcacacctcaacagggcaggaataaaacttccacgcagctttcaatgccaaa

SEQ ID NO: 522709 - DNA, 1395 bp, Homo sapiens
aagctcagaacccagatgcaaaaactacagaactaattagaagaattgcccagcgttggcagggaactatcctgattcaaagcaaaaaaatatcatcaagatgcttatcagggcggcagtggcaggtcatatacaagcaagcagataagcagatttcaaagaacagctaactccaagtcagattatgtccttttggcaacaaagacacatccatgggacacaacatttcaaaaaagtgcaacagctcatggaaccacacaacacaacaacgacgagttcacaccacgtgcttgcgaaaaaacccaacacgaagaccctcgtttccagctctcatcacacggttctacatcgtcacgcttgcaacagacattccccacagcacaggctcacaagggtgaatatccaccggaaaaggacaaaacagcatgccaacgcacctgtcaacaggcaaaacacttgcgcaaaacacatccttgctctgagactcctgccaacaaggggacatataatcattatttacgaggcgatgcttaaagagtaaggcacgaaaaactcgggtagtatcgcatcaaattgcaacagtgcaaggtataggggggaaaagaaaacaaaaaagtgcatttggcaaggtctggcccacggcaaacaggaatcagtatcatcagagagtacggaaaaaccaacagtcaccaacgcacacaccaaacacgcaacaaaaatatgtggggatggcccctgcacgggcaacgggcctccacacacggttacgcaacacgacacttgcaagacaatggtgcatcccacccaacaggagcaatacgggcccccagggaccaaccccaaagaacaaaggaaccatccacaatcaccccatgacaacgaccaacaccggcaaagaacagctcagagcacacgggacataacacggctgaggaacacaaccgaagaaaacatcatgacaggaaagcagcagaacaacaccaagacgtaaggcggaaacatcccggcccaagcgataacacactcgggcacgcaggggaaaaaaccccaaaaacaaaacgggttccagggcacaacccaccaccaccaggcgatcacacaacctactggaaggaacaaacgagaacaaccaagcaacagcggtaagcaagtaaaaccatacagacacacaggaacaacacaacagacaaaacacgaaaaacaccacgaacgcaccaccatcgacaagcaaaacccgtaaacaggaaaaaaaagagcgaacgaaaacaaaacgaacaataggagaaacggaaacaaccgagcaacaagaacaaaccgagtaacaaacagagagacaacggacaaccacacaaaaagcaccgagaacacgaagagacaaggaaagccacgcaacca

SEQ ID NO: 522710 - DNA, 128 bp, Homo sapiens
ccgtcgcctgcaccgttgtcttttgttggggacgacttgactctgtagggcctctgccttgactgccgcacgtctttctatggccccgactctacggacaccgacttaccctgacgacgtctgaccac

SEQ ID NO: 522711 - DNA, 139 bp, Homo sapiens
ggtgatctacgtttaggctccacagtgctgggattacgaagcgtgagctcatgcaggcttccagacctattcggctccaggactttatctatctatcccttctcatggactctatctatcccttctcatgtcatacatg

SEQ ID NO: 522712 - DNA, 1064 bp, Homo sapiens
  misc_feature (344)..(344): n is a, c, g, or t
gcggagacacgcggcggagtgctgtgttgggcagggccgactaccgtgatctagagggggcacggtcctacgtgccagacggacggactcagcagaacagcagctctgcaattggcgggagacggggtcaacctgacaagtgactgttctcagttcgtcccgtgggctaccatcggacatatcaacatgcaggaacgcagtgtgggaacctggatctatgcatgtctactgcacacacaggaaagatagtcaggggctgtacagaccccagctgggtgttccatctcggcatgggacagccgaagtcacattgaaggctgggactggtcagtaggcatactgantgctgtacaggcggtgtatggggggttcatgcccaggcgagatagatgctacatccctgtaacttccaagggccaactgaaaggattacggcagacagatgagacgaacatagtggaatcagggggaatatcatgcacagaacccacgtggtgggtcgctccagcgccccaacggactcagggatgacgcgaggatagatgttcatgatgggacacaatggacctcgggcagtaggatatctcctcgacgagtgactcaccgaaatacgacatggaccaatcgagggccctggggatgaggggaagcctggattgcgatggggccatcaggcgttctccttccagggggacatgtgtgattttcttgctccagacaagcaggggacgcgaaccattcgtaattggtgtatcttttgcgagaggaaggaactacatgtattcacattaggaagggggaagagaacggtttggaagatggggttatgtcccacaacggagaagaagtgggcgagttggaaccacagtcgaataggaggccggagggacatatattgaagagagtttgtcttggggagtgggggccaacggggaaagggacaggggggaacatagggttggggacacatattaggttcataagtggaaaggagtgaactagagatgcttttggtgggaccgaatcaaattggaacccggggaccatgaagctggaaggaagac

SEQ ID NO: 522713 - DNA, 241 bp, Homo sapiens
gctgtcatgactgtgggcacatcacttcatctcactgaatgtcattcttcatttgtggatgtttgcatggtcaatgccgagcacatttcctcacatatgccatttcaggatacagggagaagctagtagtctccaagagagaaagaaagccttcaccagatacagagacctgccagagccatgatcttggactttccaccttccagaccgtgagaaataaaagcctattgcttaagccaaa

SEQ ID NO: 522714 - DNA, 150 bp, Homo sapiens
  misc_feature (119)..(119): n is a, c, g, or t
gtaggaccccagcgccccctttttttagcatcttcctaggcggtccttacacactttttttccagcttttgtgattctttcatatggagggggagggttgtggctcatgctccgatggnctattgtggagtagagaaacccactggatct

SEQ ID NO: 522715 - DNA, 539 bp, Homo sapiens
  misc_feature (22)..(22): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (103)..(103): n is a, c, g, or t
  misc_feature (115)..(115): n is a, c, g, or t
  misc_feature (123)..(123): n is a, c, g, or t
  misc_feature (147)..(147): n is a, c, g, or t
  misc_feature (172)..(175): n is a, c, g, or t
  misc_feature (195)..(196): n is a, c, g, or t
  misc_feature (198)..(199): n is a, c, g, or t
  misc_feature (220)..(220): n is a, c, g, or t
  misc_feature (232)..(232): n is a, c, g, or t
  misc_feature (235)..(235): n is a, c, g, or t
  misc_feature (243)..(243): n is a, c, g, or t
  misc_feature (262)..(262): n is a, c, g, or t
  misc_feature (272)..(272): n is a, c, g, or t
  misc_feature (275)..(275): n is a, c, g, or t
  misc_feature (305)..(305): n is a, c, g, or t
  misc_feature (393)..(393): n is a, c, g, or t
  misc_feature (410)..(410): n is a, c, g, or t
  misc_feature (429)..(429): n is a, c, g, or t
  misc_feature (435)..(435): n is a, c, g, or t
  misc_feature (443)..(443): n is a, c, g, or t
  misc_feature (454)..(454): n is a, c, g, or t
  misc_feature (462)..(462): n is a, c, g, or t
  misc_feature (521)..(521): n is a, c, g, or t
tggatgctccactgtgcttgcnaagatgaagtgcgtattggtggccactgagggcgcagaggtcctnttntantggacagataaggagtttgaagagagtatncggctgaagttngggcagtnagagaatgaggaagaagagctccntgcactggaggaccagctaagcaannnnctagccccggtcataatatnnannatgaagatgatggagaagctntaggaaaaatanacntgcttctncacggaaaatggcaacttnatgtatgtanttnacatggatgcgggccccagacctggcgcangtgctccagctgtgggagcacttccagagcctgctgtggacctacagccgcctgcgggagagaagcagtgcttcgccgtggaggtgantactgggcgcgggagtnctcaagacttgaagctgtnagccanagtgccanctccctgcgcncggccganctgcttgccctcatcctcctggttcaggacctctaccccagcgagagcacagcagaggncgacattcaggagaaaga

SEQ ID NO: 522716 - DNA, 343 bp, Homo sapiens
actgggataacggtcgggtagattaacaccccgtgagtataacaccttcatgtaggttactattggcccatagacctagataacaaatcagctaagcagcaggaagtccaatacaaaggtgagaaaaatactggatcaaaggtgttgaagacagtagccaagactaataaatacccttacagcttgagctttctggggcagataaaaagattcccagaattttacttttcagaatagatcttaataggggatgaaaaattatagtagtgttacagcattactaactgcccaaggatgatagagtattaccagtactagctatgtggatgaggatgggtgtggt

SEQ ID NO: 522717 - DNA, 632 bp, Homo sapiens
acatataagtatttagagcagatttgcaattagattcttgtatctgaaaacactcaaaaagtctaggcagaagataatgcaaccaacagtcaacttctagaagttgactgttggttgcattatcttctagaaccttggaggaaaagccatttcaagacagtgctttaaaacactaacaaatttgcttctgaaatatggtagctttccatgtgcaaaaaatgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccc

SEQ ID NO: 522718 - DNA, 144 bp, Homo sapiens
agatacgaatcgagctggtaccctaatccccttccccgtggcatccggcggggccagctgtccgattaaatctggtagtcaatcaccgcatccagctgcgacgagaaaaccttgtccttgatttcggtcagcgacagcgtcggg

SEQ ID NO: 522719 - DNA, 352 bp, Homo sapiens
tgaacatgcgtgtccaggagttgtgggccacgtgaactattactgaaccactgcactccagcctaggtgacagaacaagacctcatctctaaagacaatttaaaaagtcacaaatgttaaaaattaggccgggtgcagtggctcatgcctctaatcccatcactttggcaagacaaggcaggcggatcacctgagctcaggagttcgagaccagcctggccaacaaggcaaaacccatctccactgaaataaatactaaaattcgctggatgcggtggcgcacacctgcaatcccagccactccggaggccgaggcactggaattgcctgaacctggggacacgaatgttca

SEQ ID NO: 522720 - DNA, 115 bp, Homo sapiens
  misc_feature (43)..(43): n is a, c, g, or t
  misc_feature (63)..(63): n is a, c, g, or t
  misc_feature (91)..(91): n is a, c, g, or t
gttaagtggcttaaagagcactcagcctctaaacacacgttgncttagtgttattagcttggntactaaatgtgccatgcccagttttcgngtgcacctgagagcacatgggatg

SEQ ID NO: 522721 - DNA, 163 bp, Homo sapiens
ctccctgatttgcagctgctgagagactggtcatcctcacaccccacaggctggagggtggaacgtgcggctgcgtggacctccacgatgacatgcaaactctgaccggagagcacgtgggtgcgggactcttgcacgtcgcgggctcgagccccagtgaagt

SEQ ID NO: 522722 - DNA, 461 bp, Homo sapiens
agggcacgtagcccttcgagagcaccgtggcgtagcggctgtccgcgaggttctggtaatcgaagaagccgtcgctgatgctggcattgacgttgatgtcgcgggccgcccgcaacgtcagcgcccccggttcggtgccgaagcgataggcgaactggatcgtgctcgtggccgggttgaagtattggtagctgatcgtggtgggaaacaatccgttcaggaaggtcaggctgtaagtggacaggttgcccatggtgccggccgcgagattccacgcgctcgccacggtgatgtcgccgccattgacgccgaggtcgggattgatcagttcgaccccggggcgcaggtggaaattggtaatggtcgagagctggctcgcctgtgcgctggtcagcatctgcaacgtgttgagcgactgctgcgtgaagccggccagcgtagactggtagaatcccttgtga

SEQ ID NO: 522723 - DNA, 963 bp, Homo sapiens
taaacttcgaaaaacacccggtcccaaaattacaaaaaaaaaaaaaaaaaaaaaaaaaaccctcacccaggggtttcacccccttctacaaccaccacacacaacacgacacagaccccctcgatgggcgccgccaccccccagcagacgaaccgccccccaccaagcaggcgacacacaaaagagacacacctcggggcgccacatcaccgagcacgcgcgacgatcgaccgagcgagctgcgatcgaccaacacgggagcccacacctcccgccaaatgaagggacgccaccacgtggaggactcccaacagccccctcttcgacggaagaaaggcgtggtctatgaaaaaacgctccgcggggcagacctcactagtgcactataccacgggagccacccccaccgcggaggagccaccacaccagggggagcgccccacaacccaacaaagacaaacaccctcgcgggccgacagcgggactctcaaacaaatcgaaacccccacccacgtgagcacacaacgcctcgtctgcagcgcagccccacaacctgcgaagaggcaacaacacaagcgggtcagcgcgacacaaaacccacgacaagaactacaccagggagggaaggggcccccaacaccaagaagggagaccgccagagcacgcgcggacaacaggacgacctagcagggacacaactacgtagcccctcccgccaaaagagagccccaagagtagcgtggcgccacccaaaggccgtctcacaaacagcaggacaacacacaaatgcgcaccccagccgacactatcaaaacgcgggcactcaacacaatcgccagagaaaagattcgtgacagaacaatcggcgcgggttatcacaaccccccaaccgtacaacggaacaggggcaccccccaagagtatccaccgactagtactcccccacccggcgccacccccgcg

SEQ ID NO: 522724 - DNA, 107 bp, Homo sapiens
gcccccccccccccctggggccttggggaaaaattaattttttcaaacccccgcccggggccttttaaaaaaaagcaacccttttttaataaagccttgggggccca

SEQ ID NO: 522725 - DNA, 654 bp, Homo sapiens
  misc_feature (167)..(167): n is a, c, g, or t
  misc_feature (191)..(191): n is a, c, g, or t
ctggatttaaaagcaaaaagtagttacggtttcatggggtggcccctctctctctcaccctctgggtttcgggaggtcgagtggggtattctctttgtttggcagtggttgctgtcctcttgagcgatctgaagatctctgtatcccctgatcacccgatcagaggncgccatgtcatatcttcgccgtgntgttggcacttctagcacctctcctgttacatgtactgcacggctctcgtgttgcgtgcatgtgtgcgctgtatatacatgtatagagagatatattgtggcggccgggcggagcgggacggggtggagtgaagctcagggctgagccaggacagccatggagctgtatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcacctcttatcaagcttagagtg

SEQ ID NO: 522726 - DNA, 1026 bp, Homo sapiens
gccggagaacgaaaagaaggagaatagaggagctgctggctgagaaaatggctgttgatggtgggtgtgtgggacactggagactggtgaaggtcgctgtgaaccatgtgagagaagttcctcggagcgatctggacgccgttcagccgacacccgtgactttcggaaccgagacactgaagtctcgttccaggttctatgtatagatacatgtatagcgttctagtcattggagctggcggcttaggatgtgagctcctgaataaatctgggcatgtctggcttttagacacggattcatgttatagatatggacactagtagtatgttctccaagtcgtacataggcaggtgtttgtagtgtaggcctaaagataatctggagagacctacggctgcagagtcgcgtgcagagactttcatagaaatcgacggcagtttcgcttagattgtcagagtggtagttatccatcgagttctcagaccaagacttgcgagaggatttataagcgaccactttcgtatcgcacaactttcatcacttagttggtactgtggtactgggactctatcatcgaccagtaagcatggactcaagtggcatgcggagtatctcttcattcgagttatgaacgatgggtgttctctaggactccagagtgctccgagttggtcgcctgtgtgacctaggagtggggggggcacccgaaacagggctctttgaaagggcaaaagtggccccggggtggaattgcttgttcctggaacacttgtcgtgcctaaggtaatcggtgagtgccatcgactggggatgcggttattctgactaggccatggggggtcttaactttcttgcccagtgggtggcttcccaatttgggcaattcctatgtgggccaagggttagcccagaaggcccctggtatttgggcggctctgttcacgtggatgcttgtgccgggggtccctgggcccccgggccttgtggggagacgcggggcgtgtccttcaccctggggtctccat

SEQ ID NO: 522727 - DNA, 282 bp, Homo sapiens
tccaggagcttcctggctctgggggaccacggtgggacttagcagtgaccgtactggccgccttgggttgctctcttagacgccatgggacctccgtccctcattcatcttgcacgcacatcccatttcttgacaagccttgtgagacgtcggtttggtagacttggacatctctctgggttctgaagagccttgacgctggcctggaccattcctgtccctttgttaccatacttgtctctggcgtgctggtgtccgttccctgccccaccatgcatgctc

SEQ ID NO: 522728 - DNA, 851 bp, Homo sapiens
ttcatcatcattttgttggctatgtacacctctgcactttgaaccctgcgcacacgtggcgtccgctcgtacttgtatgttcgcatcacaaaatttatggggtgccgtgctcctgatggttggcgcaacaacactacggttgtggtatctgttgcgtcgctgcgcaccttcgttggctatgtgcaccggctgcgggtgcggggcagctcgacaacatcgcgtcgctctaagggtctaggcaacacatgtttgtctctctcggcagacacagtagtgggtggctcgtcttcatcagagttcatgcgttgcgtacacagattatagcacctctttaaagcgctcctaactctttcaacaagatagggtctttaaaggcacatttatgtgctcgctccgcgcatgcatctatagatgtatcattacgctcacgctcgtcgtaagaggatacagaactctctcctcacagattacacacacacgttcatattcttgtgtagtggacactcactcacaactcagctccctcactctcgcgccgcccttgtatatttgtacattcacacggaatcgcagtccatccgcttcgctctatagcatctggtatgtttgtttatcgcacgcagtcacgctcagctcactgctcttctgttcgactatgtagtccaccaccacccttctatgctcatgacgtcaccctattcataactcccgcactcctcgtctaattatctataacctacctattgtctctattacccctctctccacacattctcatgtctccacgccactccaccgccccatctgtttccactcgatgacccactctttccgacaccgacaataaacaa

SEQ ID NO: 522729 - DNA, 137 bp, Homo sapiens
cttcctggttgggccctgccctgagctgccaccggggaagccagcctcaggggactgcagcggacccccaaacacccctcccccaggatgtcggaggagatcatcacgccggtgtactgcactggggtgtcagccca

SEQ ID NO: 522730 - DNA, 207 bp, Homo sapiens
actctgtgatcatagctactgcccgtcctcttgtggctagcacatgatctgagcaatatacccggactgttcgccatagatcaagtactaccggaagactcccaaaaggcagagagtcagaatacatttgaagcgactgacttagaattcaaaaaatgctttccttctgatgaaacctgtgagacaccagtagatgaaaccagcgaa

SEQ ID NO: 522731 - DNA, 252 bp, Homo sapiens
acagtaacgtatacgttataaagaagataaacacttacaggtactgggaagggtgaggtattggcagctgtccatggacgttgggtttctcatgatgtactgggtccctgaagatactccgctctacgagagggacctttctgctgtgtacctctgcgaaaaaaggaggatagttgaaacatcataaagaaccccaaatgtaggatcttccactgaactgtaaagttactggttattcacaataaaccagcg

SEQ ID NO: 522732 - DNA, 172 bp, Homo sapiens
gcacacacaataatacagggattacaattcaagatgagatttgggtggggacacagagcctaaccatatcacatggtatagcagcatatgaaagattctaagtttttcactatttatcacgatttattcaacacttttccccaatcttaatagctcatataacatgcaaatc

SEQ ID NO: 522733 - DNA, 394 bp, Homo sapiens
ccacaagcctcataccttggtcaacaatctacaaccttccacagctagcccagtgcgaactgaaaacacactcttacctgacgacaggataacctcaggcctcgtggaggcatctacacccatccacagcagcactggctcgctacacacaacactgaccccgtgccagctccacaagcgcgtggcttcaggcagaaatctactacttgccagagctggccaagttcaagtgacacacacatcttcagctcccgggagcacagcagtcccttgattgaagtatccaaaaactagcacagacgccccagctccatgtcgacaacacacttttctgaccagtccacaaccttgggccgtagtgaggaatcaaaacagtccacagcaagccaagtgc

SEQ ID NO: 522734 - DNA, 1076 bp, Homo sapiens
agcggagacggagcgcgcccggccgagcgggccatggccgcgggggccgccgccgacaggtggtggcgcgcggtgacggagagcgcggcgcctccctccggggccggagtggcaacgcggctcggcgggcgggctagtgccggcgtccacgggctggaactggtgctggctgtgctcggctcggtgcctgcgttctgaagcccgagagggagtccacaactggagatcgccgccgtctgccgtctccggcatgtgcacaaagcaggggtcagtcagaagccctctcgcagttcacaagatggataactaccgaaaaacactgcccatgtgatcagtggaatcccatgtgcgccaattactgaaagtacacaggccttttcacagaggctccactgtaccacgaaacttttaacggacatgcgtcaccaagcacgttcggcctaggtagccgaactggttcaccacaactttttgttgcgccaacgcacacgaagcaatttgggcaacaacaacttgtttaccctggacgtcccaatttaagccaagcctggggcctgtgcccatgggtgacaccggaaaccttgggctacggcgttccccctttctacagttgtgtacatacaaattggacccacaacattgggggttcgtgataacccacagccgggctgtcgaaccgcacactggtcaggggtttggtaacggaaaaggggcccgccttggtgacagttctctgaacaagccgggtgcaaacgagaaaagcggacttcttaaccggcaaaatcagtgtttagtaagaacatatatgtaaacaagattggtgtttaaaatggaaagttttgcgcggaccccctttggagcgttaaaaccgcgcccactgttgttgtaacagagtggccgcaaccttgggggccctttaaaataacgttcgctggggagaaacgctgcctacagagtctgggcctttcccaatataacgcccacagccctttgggtgtcgcaaggctcgaaagcaagagactttttccccacaccgggtggttttataaccgcaaggcaacaaaagaggtcacact

SEQ ID NO: 522735 - DNA, 134 bp, Homo sapiens
tgagttagaggatcccttatttaaacctctaagtggtgtaattggtttcggtagtaatagaaaactaaaacaagattatcacccacttcaatgataatggctaaattatgagatatctggtttagttttctatg

SEQ ID NO: 522736 - DNA, 102 bp, Homo sapiens
tatgtgctagtggcagagacaggatacagcgtgacagtcaacaattccacgcaatctcctggagacagatgctatcctttggcagtgggccatatgggaagc

SEQ ID NO: 522737 - DNA, 266 bp, Homo sapiens
aatacagaacatggacaagattggtaataagagcagactatgcaagttttaccacacaactatgtgcatctacgagaaacagaagacgcgcacttttgctgtccagtcaacagttacttcatatgtcatacacaaacaaaagtgatgaaatcccaaatgaagatggctggagccagtgtctaccacagcaacaacactgcaggcagttcacaagaagatggatccacaaaagacattacaaacaatgcagaattaccagaaggacc

SEQ ID NO: 522738 - DNA, 236 bp, Homo sapiens
catactgtcttcagatgggggcggaggcacgagataccaactgataagcgtacttcatagctaaggaagtgtctaccacctgagcgaaccatatctgacaggatctcgaaagttatccactttcggtggtttcagaagcacaagtgagcaaaagaggacgcccatgccgggaagcactggaaaagtctcatatttccccgacattttgagacctttggcgccaaattttcatacct

SEQ ID NO: 522739 - DNA, 102 bp, Homo sapiens
  misc_feature (54)..(54): n is a, c, g, or t
ccagctccagtcggacaggcgcggagactcttctggaaggatccgccgcgatgnccgcccagggagagccgcaggtccagttcaagctcgtcctggtgggcg

SEQ ID NO: 522740 - DNA, 331 bp, Homo sapiens
gacctagaggatcccgtgcgagtgcatggctttgcatataacagtaatgactcagaagccaggaagcatatcatctagcggtgaagataagcattaataagtaatcatatagcaatattttgaacaggataaaattcctcttacagtcaacactcaaatgtgctggataaaatatgacattttgggcgggcgcagtggctcatgcctgtaatcccagcactttgtggagtgcgaggcaggcggatcatgaggtcaggatatcgagaacatccctgggctaacacggtgaacacctgtctctactaaaaacacaaaaaattatgccaggcat

SEQ ID NO: 522741 - DNA, 969 bp, Homo sapiens
taccagtcaaactacaattcgtgtgtcgcgatggtcgcataatcgcatgaccaggattccgcttgacaaatcgctctagaggcagacctgactgactatcctatccgcataccttcgagaagaatcgttggctgcctcatcttgggaactaacagtattgcggtggactcggaagcattatgtgcaaccagaaaggaaacttgaggaaactgtaaaatgacgaatctacctttgggcgtacagtagatcccatcacgaaaggacagcagattttccgagatcgagtgcattaatcgccgtatgtatccctcgatggctgatgggtgcaacttgactccacctgtattttctgacccattgattgctcagagacagtgatggactactagagctggtgaaagaaagagacatgtagatgagcgctcttccgatggtaggttgtgtatagaggcatggctaattggcgcttgatagtttatgtggcctggctgtaacttcttcccttgtggatgcccttacccttcgtgacttgagggttcaacccggttccatgatgtccacttgaacttgctccggggccgcttgatgctctgctggttgctggttccaatttagggcttttgagcacgtgtggggacccgctttgctctgacccggcgtggctttcaccccctttgtgcctgcacttgttcgtaatgcgttgctttgttggcaaaccttgggttgagtcccggccggtcctgggggacgcgaccttttccccgtaaccccgggtgctcccgaccgtgtcacgacacatcgcttttgtagcgcccgggatgactgccgccctgggttcactgccgtatatttgccgtcacatgttcgcgccctctcttttgaagatttgtcactcacgtctctgggtgttccgcggtcttctacgcgtctggtctggctctggcgcataggggccgggcgcccctcggg

SEQ ID NO: 522742 - DNA, 226 bp, Homo sapiens
gggggggggggcccaggttttccccccgggggaaaattgtttttttccccagggggaccccccccgtgtgttttaggatttttttttttgggggggggcccccccccggggggggggccccttttcccgggggggttttttttgggggcctttttttcccccccccccgggccggccccccccccctcggggggggggggggtttttggggggttttcccttttta

SEQ ID NO: 522743 - DNA, 746 bp, Homo sapiens
ctcttgtcgcccaggctggagtgcagtggtgtgatcttggctcactgcaacctctgcctcctgggttgaagtgattcagcctcccaagtagctgggaatacaggtgccagccaccatgcccagcccagctaatttttttggtatttttagtagacacagagtttcaccatgttggccaggctggtcttgaacttctgacctcaggtgatccgcctgcctcagcctcccaaagtgctaggattacaggtgtgagccaccacacctgaccacatttatttcttacagttttagaggctgggaagtccaaggttgaggggcatatctgatgagacccttcttggtggtgggaactctctctagagttcttttttttgagacagggtctcactctgtcactcaggctgtactgcagtggagctatcatggctcattgcagcctcaaccttctaggcccaagtgatcctcccacctcagcctcccaagtaactgggaccacagggcgtgtgccaccatgcccggctaattttgtttatttttatagagacagggatctccctatgttgcccaggctggtctcaaactcctaggccaaggcgatcctctgcagagttctgaggtggtgcagggcatcacatggcgagggggctgagtgtgctagctccgggttcctttcctcttcttatagcaccatgagacccactcccacgataaccccggtaatctgttaatcatgggatccataaatg

SEQ ID NO: 522744 - DNA, 140 bp, Homo sapiens
tagatgtgtttggaaatttatggcatgtagatactgatcgggggctctcctgtgcacactagacatgcctagtcctctctttgaaactctccatccaggtaaaaagagaggcacatcgattggcccaaaatcttgcagtc

SEQ ID NO: 522745 - DNA, 1596 bp, Homo sapiens
  misc_feature (410)..(410): n is a, c, g, or t
cgtctcctgagagctcttggtttatcaatgactccatagtatcgtctcaacagagaaactcgtgtaaaatggacttgatccatgtgtttgtgcagattctataaaaacattgggccgcgatggtttcaagttgatcaacttcatcggcaatgttgagtccattagaactctctgcaacaggaacgaacatgggcacattatcctgtgtactcctgtgtctcagtagcgcgtactttagtactatggaggtatgttaactgtgcgtgcagaatattaccatgacgaaacttcaatgtaccacttaagagaatccgttccaattgtttcataaaatcctatctagtgtctgagatctacccattgatctggtcagtgtacagtaacagggcacagagtacactccttgtggnaatgggctctggctgtagagcgccaatgtggcacgagaggacaggattcactgtcgctcatgtgaatgcagtcgcaagcggcgtgtatgcaagtgccattttgtatggacatattctacttgacttgcagaggtaacattcagctacataacttgaacttcagcgtgctagcgaagggcgaccactccctttagtacgcatcgttctgcggggtgcgtacttcctttacacataaataagctcccccttggggtcacattaatgcgaagggccaggaggggatctgggcgaacgtctgagaagctacagatttaaaggcatcgtctctttaaaagaccgttgcgggacttatccaaacacgtggacatcgttgtcataaatcgcagtcttgtggacattaggctaaaccttggttttcctccatgcattctccagttattttcttattgcttaactttttaccaggagactacgaaaccttatttccttgcgtcaaggaacgcataataacattccgctcatatatatatgaagccagaaaatcccagctgagggctgcacttggaaacctacgcatttttccctcacatgggcaacccctttgtttttctttggagaaaagatcacgatccaaatgattgggtataaccccttatattcccccattttcactttctccaatttttttaaaggcacgcagtaaatcatatatacgcgcggtctgtggcctctttttcagaagggggagattctcccagtgtagaaaccttatatagtgcgggggcaaaacaagatcaacaaataaaagcgggcgcgcagcgacggttggtagtgacaccgccgtgtgagcccacccgcattagtggtaggcggcgaccaagcagggtgacaccacaacacaagacggttggtgcaacaccaacctcgtgacagacgacagacaaaagaggtcgcctgggccgcacaacacaaaagcggcggtgaacacgcaataggccccctctactacgccacatcccgactcgatagttaaccgcgcgccgaccttagtctgacgaacccacaccctgtgtgagtatagagatctcgccatcagtactaatttacacttcataccataacgacgacgtatcattctagcaaacaactatacttcaaaaccgagcaacctacgtaactgcagtaa

SEQ ID NO: 522746 - DNA, 132 bp, Homo sapiens
gccaaagctgccaaggaggccaatggaagaacggtgaaaattgaatggaaaataaagttaccttggaactgggccaaacctaagggtgaaggtggcttacgggggtcgtggtggaagtagaagcgtcttgga

SEQ ID NO: 522747 - DNA, 228 bp, Homo sapiens
ctggatattatcctaccacctgtctcaagacagggtcctgacccactcgccccagtaagtgcacacgattcagggatctttcaagaaccaaactggtagttgttacggactcatgtcttacaaactgatgaagtacctgtaatacaggtcttcgcaacctggcttctatttacttttcttacagtctaatctttaagctattcctgacgatctaacccgagcattttt

SEQ ID NO: 522748 - DNA, 109 bp, Homo sapiens
aaggggccccctttttccccaaattaaggggttttttaaaaccccttcttggtttttttttgggtttttccggggggagggggccaaaataacctttttccccccccca

SEQ ID NO: 522749 - DNA, 776 bp, Homo sapiens
ttcgagcccgcggaggaggagagcccgattcctatagcaacaccgtattctgattgttcggtcacggcctgaagtttatattcttatcctaccagggttcggaataatctcccatatgtaagttactactccggaaaaaaagaaccattggatacataggtatggtctgagctatgatatcaagtgggctgtcctagggttgtatcgtgtgagcacaccatatatttgacagtaggaatagagcgtagacacagcgagcatatttgcacctccgctaccataatgcatcgctatccccaccgggcgtcaagagtatttagctgactcgccacactccacggaagcaatatgaaatgatctgctgcagggtctgagccctaggattcatctttcttttcaccgtaggtgggctgactgggcatgtattagcaaagctcatcactgagacatcgtactacacgaggacgtactacggtggtagcgtcacttccactatgtcctatcaataggagctgtatttgccatcataggaggcttcattcacgtgatttcccctagttctcaggctacaccctgagaccgaaagctaggccaaagatccatttcactatcatattcatcggggtaaatctaactttgttcccacaagactttctcggctatccggaatggcccgacgttactcggactaccccgatgtgtagacagatgaaagatctatcatctgtgggctcattcattctctagagcgtatatgaataagccatgatgagaac

SEQ ID NO: 522750 - DNA, 353 bp, Homo sapiens
  misc_feature (323)..(323): n is a, c, g, or t
  misc_feature (326)..(326): n is a, c, g, or t
  misc_feature (351)..(351): n is a, c, g, or t
gatcctgactcccaggaacctggctcctggaggcaggtgacagccagggccgccagaggcctcaggcagagggatcctggcgccccactccccacgcgtccacagtcgcccgcttcccgggtgcacacgacgctctggggaggctgggcccgcgcccgggtcactgagaggaagggcggaccccaggctcaggagcacaggggcgaggcccgagaagggcctgagcggttatggggtgggcgcagagtgaagggcagagccttgtgtatctgtgtgtgtgtgtgagcatgtaagcctgtgtgtgtgtgcgtgggtgtgtgggnggntgtttccgagggtgccatggggagngg

SEQ ID NO: 522751 - DNA, 398 bp, Homo sapiens
  misc_feature (210)..(210): n is a, c, g, or t
  misc_feature (212)..(212): n is a, c, g, or t
  misc_feature (215)..(215): n is a, c, g, or t
  misc_feature (376)..(376): n is a, c, g, or t
gtcgacatcgtaggcaggcctacagcttgcgttcgcgttgggttcgccgccggggttctccgggatgccggtatcgccttcgagaaaggttcccgtggcaccgttataggcatgggcatttcatggtagagggcgttgactggggcgctgtcttcatccagtgagtaggaggggttgtagtgtatttccccgcctgtagcgccagccgcntnggnattatgggtgatgtagccctgggctgcgggctctagcgtttcaagggtattgcccgctgccaagtggttgcgaacagccgcgttattgaaaaagtaacgaccgttatcttcagtcaactcagtgatgcgaacgggggcatcgttttgctgagccttggctncggcggtactgagcatcttctt

SEQ ID NO: 522752 - DNA, 139 bp, Homo sapiens
cagagatgctctcaagtcacgtgtcaatggcttttgggattcttttctgcatcgtctaggctgattactttcatattgtggggatggtgcacggcctagaattctttgttaaccagagggagaacaaccataggttttg

SEQ ID NO: 522753 - DNA, 243 bp, Homo sapiens
atcgctcgaaattgtgaggccctggcttcttcgggatcagtgctatggacatcatgtgctcgagccttcaggttgatggtggattatgtgctcccggtgcctgtctcctgcacggggctccacggagcccagctcccatacacgctactatgtgcctactggttgccctgctgttgcgccttgctcccagggtacgcaaccatgcaagagcgccacgcaagctactaggtcccgtggcggctt

SEQ ID NO: 522754 - DNA, 943 bp, Homo sapiens
  misc_feature (22)..(22): n is a, c, g, or t
  misc_feature (161)..(161): n is a, c, g, or t
  misc_feature (163)..(163): n is a, c, g, or t
  misc_feature (176)..(176): n is a, c, g, or t
  misc_feature (217)..(217): n is a, c, g, or t
  misc_feature (219)..(219): n is a, c, g, or t
  misc_feature (238)..(238): n is a, c, g, or t
  misc_feature (243)..(243): n is a, c, g, or t
  misc_feature (245)..(246): n is a, c, g, or t
  misc_feature (250)..(250): n is a, c, g, or t
  misc_feature (257)..(257): n is a, c, g, or t
  misc_feature (262)..(262): n is a, c, g, or t
  misc_feature (325)..(325): n is a, c, g, or t
  misc_feature (346)..(347): n is a, c, g, or t
  misc_feature (354)..(354): n is a, c, g, or t
  misc_feature (357)..(357): n is a, c, g, or t
  misc_feature (361)..(361): n is a, c, g, or t
  misc_feature (364)..(364): n is a, c, g, or t
  misc_feature (368)..(368): n is a, c, g, or t
  misc_feature (371)..(371): n is a, c, g, or t
  misc_feature (395)..(395): n is a, c, g, or t
  misc_feature (411)..(411): n is a, c, g, or t
  misc_feature (430)..(430): n is a, c, g, or t
  misc_feature (454)..(454): n is a, c, g, or t
  misc_feature (457)..(457): n is a, c, g, or t
  misc_feature (473)..(473): n is a, c, g, or t
  misc_feature (499)..(499): n is a, c, g, or t
  misc_feature (558)..(558): n is a, c, g, or t
  misc_feature (594)..(594): n is a, c, g, or t
  misc_feature (599)..(599): n is a, c, g, or t
  misc_feature (617)..(617): n is a, c, g, or t
  misc_feature (619)..(619): n is a, c, g, or t
  misc_feature (629)..(630): n is a, c, g, or t
  misc_feature (681)..(681): n is a, c, g, or t
  misc_feature (937)..(937): n is a, c, g, or t
taggtagtaagaggggtgtggnggtgtatttagaagttggcttgtcagatatactataagttagtgtctgtatttaatattgacaaccaaaaatatatataaatatcttgcatctatacacaacagggcaggagtctccatgtcttcttgagcagtgagtntnaaggatcccaganggcctcttctcatggtaatagtgtggccctcagtgcaaagnanactagaacccggcagcccngaatngnncttnccctctnctccntgcactccagtgctcccaactggtttttggttaagttagatttttttgtgtggttgggttggntgtgttgggttggggcaattnntaatggngcntganccnttgngtngggaggtctaggccagctgaatgngtgggcttagcttttnctgggatagaagctttgtngttcatagttcgtttagtgtgttnttnggtcattggttctgcnctgcagattagctgggtggggagggngagtgtctcgacagggcttagtctccaccctcaggcatgggaccattcagggtgaagcntgggatgtggtgctcaggtgactctggctgttattntagtnataaaatctgttatatananattataaaanntgttgcttgtttgaatagatttgagctacagtcttgcttttgttaaaatgntggtgctgttatgtgcgtgaatattcttctggacatcattgctggctggagaaaggagccccaggcccggctcggctgacatctgtcaggtttggaagtctcatccagctgcctgtgctcctgagagatccttagggctgctgggagcaggccgggctggtgatctggggcgactcacacttgggaatcagcccccaggggatggaacagctcctcgggtgtcttgtcactttggctggctcccccctgccggaanccggaa

SEQ ID NO: 522755 - DNA, 265 bp, Homo sapiens
ggatccggttgcagtgagccgagatcatgccactaactccagtctgggtgacagagcgagactccatctcaaaaaaaaaaaaagaaaaaaaaggaaagggaaacaccttcaacttcacaatgatgaaaacagcacatctcaaaacatgtggcaaatgaggattcaggatgcagctaatagttcctaggttgaaaatgctggtctttaatgcctatattttaaaaagaaggcttggtcaggcatggtggctcacacctgtaatccc

SEQ ID NO: 522756 - DNA, 148 bp, Homo sapiens
gaagtcttgatagtcctgcgcgggacgtattatgacacgaccacttgtcatggaaagactatgcaggacagctaagttatgttcaaataaggctgtaagcgctgccgtgcaaggactcggctgcaaccttagggtatatatagacagt

SEQ ID NO: 522757 - DNA, 414 bp, Homo sapiens
gccccttcctgaccccgccccctctcgctctccccgcagcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcctgagcccgccggctgggcagggcggccg

SEQ ID NO: 522758 - DNA, 402 bp, Homo sapiens
tcatgtttccgtgaatacccgttagctgttaataccatgaaaacttagtggagtcatcctatctccctttcttgtgcggtgtatgtattgttcccacacaaatgttatacccagagatcattatagaaatagttctaacattataccagttaagtcaaaacgggaggcattcactataaactggttctggaatgtcagtatgtctaatggaagaggccagtgagttagctcttctatggtcaacttgatactctggcatgtttcatttttgtaggcagaggtttcacatcaggttccaagtcttattttcttttctttcttaaaaatttgtaattttttcttaattttggacactgggggctcaaccatgttgccctggatggtctcaaactcctggacaac

SEQ ID NO: 522759 - DNA, 1308 bp, Homo sapiens
gaggcacactattctgggcaaacgtttctcaaatctgcttcatgccaatgtgaagttccatcttgcgagcattatactcatgcacaacagcagtcaacgtatcgcaaatgcacggtgttcaattatatgctaactgggttcaacatattttgctcaactggttcaacgattaatattataccaaagtaggcattttgcagggtgaggggatgctctcatcatgagaggggatgggggatgccagatgatctcatgaaggggatggaaggtgccagatgaacatctgagagggatggggagatgccagatcgtcatctgaaggggagtaggagagagtagccgacataaacatcatgaaaggcaggagatggagagagatgacgagagtcatcaatcatgacgaggagagatgagaagagaagaaaatgcatcacaatcacagaagagagagatggaaaatggccaaatgaatcatcaatgaaagggagatagaagaaataacagacaaactaacaacgtaacgagaggagccaaagacatcacagaggaggaacagatcaacaaggcgatacaaagggaagataaagagaaagcaagaaaataacatataaacaggcaacgaaccaaaaataacacagacataacacaaaacaagagaaaagcccatgcatgaccacgacacaacaacacgaacgaaagcacaagcacactagaacaagggacacatcacaaatggagaagaaggacataagacaattggagaccagaaacacattacaaaaacaaataaaaaaccacagagaaaaaaaatccaagaacaaaacgaagaaaaaaaaccaaaaagaatgaccgaggtacaaaaaagcaaagaagaaaaagacttaaaaaaaagagaaagtaagggaccacaacaaattgactataagaaaacatgaatatcaaataaaaaaaaaagtttaaataatgacatatcaataaaatgaaatgaaaatataaggaggatagacaaataataaaaaatatataaaagagagagaaaaaagacacaaaaaaagataaaaaaagaaaaaaatgcaaaaccaaagaaaacaacagaaaaaaccacgcaaaagaaaacaagagaaccaacagacaaaagaaagagtagcagagagaagaaaagaagggaaaaacaaaaaacaggaacaacagagaaaccgaaagaaaaaaggcacaagaacaggaaaaaacagaaagagaagcaagaaaaaaaggaagaaaaaaaagaaaacaaaacaagaaagacaccgaaccaacaaaaaccaagaa

SEQ ID NO: 522760 - DNA, 420 bp, Homo sapiens
  misc_feature (1)..(1): n is a, c, g, or t
naaagaatgtcttcatagtgtaaaatgcctgtacattcacgagtgaactctgatacatttagataacaaagagatccagttgagtcatcctccctcatctagcaaagtcacaattcactctacttatatcaattcactaattagcaacatccttagaagtgctcttagaatcagtcagtctgcatatgactgaaaatgttcaattaacaaacaactattcataagctgtggtatataaactatacagagttgggttccaacagttcgttgtgcttcatagctacctgagaagtaaatccattgtaactggacactaccatcacataagactgtggctgctgctccgttctctcagtgatctcttacaaatgatcatcagattcctaagtctgtacgtcatgtgtaagagtttgtgtttct

SEQ ID NO: 522761 - DNA, 659 bp, Homo sapiens
  misc_feature (531)..(531): n is a, c, g, or t
gaggccggagtggtctggaacccctacttccttcagaattccgaccacaagaccaaaaacaacttacggggttttttcttaccttgccttcttcctttttttttacccgacactttttaattcatccttggctctttaaaacccagtgaaaaataccagggtactggggggcacctctttcttatgataggccattatggctttaagcaaagaatattaccagttttaactgcagcattaccaattaggaaaaaaaaaaaattacgttccctgcggacatgtaactttgccatcagttttgatgtgggaaacactgtgatatataaaatgttgttggacaacagtagttttaagagtaaaatatgaaacgtttaaaaagttccaaaaaaagctagctctgtcctttacttattgagacacttttaacttttcctttgtatttccattgtattagataaataaatgtgaatgtaaaattgtataaattactgtacttgaatccttctgtttccagtgttgcttgctggacantttagtgccttggacttctattgcttctgccattagcatcaacttaccagaccccagatcaataaagggcatgtggaaggaaatcgtaggtccatgtgaccccagcagtccagcagtggttatgccaa

SEQ ID NO: 522762 - DNA, 193 bp, Homo sapiens
gatctgacgactgaggtggaggagtcctcctacgataatcatctcgagggctcatgaccccaatgagggaggtgggccacgatttctacttcttgtgcaccatacgacagttccactcttacacggcagccacatagtgttcttccatcgtagctctcgtgactgcatcagcatgcatctcgtgggatcttca

SEQ ID NO: 522763 - DNA, 210 bp, Homo sapiens
accttgtctcagaaaaaaaaaaaaaagagagagacagccgggatctgtctccctttatgcatgtctagagaaaaggccctgcgaggatatattgagaaggcgggagaaaattattccagaaactgaattcgctggcaccttgatcttggccttctggcctccagaactaggaggaagaaaattttttctgtgttagccgccccgcctaat

SEQ ID NO: 522764 - DNA, 296 bp, Homo sapiens
ccatagcccattaaaataaaaattatacaaaccctgaggaccaaaatgaactgagaatctgttcgcttcattcattgcccccagaatcctaggcctacccgccgcagtactgatcattctatttcccccttctatttgtatccccacctccaaacatctcatcatcaaccgactaatcaccaccctactatgactaatcgaacttacctctaaacatatgatgaccattcactacactaaaggactaaccttatctcttatactagtatccttgatcatttttattgccacaactg

SEQ ID NO: 522765 - DNA, 263 bp, Homo sapiens
gtgtccctgtctcagagtgctatgcccatcttgtctgaccttttcaccgccttcaatttgtcaacagtatcgggcttttcttcaatacttcgcacagttcacggtatctaatgcagtaccaaacggcagcttgtacttctttgccctgtaaaactaccccataactgtgggtcatgcctcacagtcaaatgtgaaatgaatttagtgggttctgaacattaaagaacaacacgaccagttttctgtgtgtactgtcctgtaac

SEQ ID NO: 522766 - DNA, 302 bp, Homo sapiens
tgggaatcctaggggggtccatgaccccttcccccccagacccagacttgggccgttgttttgacatggacacagccaggacaaactgctcaaacctgcttccctgggagggggtgacggaaccagccctgtgtggagaccagcttcaaggagcggaaggctggctttaggccccccagctggggcggggacttttgtttgcctgtgctccatgggggggcggctccccccagcctgcgcccctgtgtttttaaaaggcttccaaaaaaaacggcccccccatcaataaagaactgagcaga

SEQ ID NO: 522767 - DNA, 202 bp, Homo sapiens
cggtctgtcagatccgcgacagaaaaatgacatttccgtgagggttgcgcgccttacgaattcgtaatcggcgtgttggtgaattgacgtggttgggtccgtaaagtgtcttcagcgcttggggcctgtgcgaggctcctttcagggttgacagacccctacaaaaagcgtgcaggcgcggcaaccgctttgaatcatctag

SEQ ID NO: 522768 - DNA, 380 bp, Homo sapiens
  misc_feature (30)..(30): n is a, c, g, or t
  misc_feature (61)..(61): n is a, c, g, or t
  misc_feature (119)..(119): n is a, c, g, or t
cctcagtttcctcaccttgcaaaacagagncctgaaacagcactttcaatccagggcgcanagcacaggcaccacttaagctttaaagccacaagaggcggccgggctccgtggctcanacctgtaatcccagcactttgggaggccgaggtgggatgatcgcttgatcccagtagttcaagaacagcctgggcaacatatggacagcccatctctacaaaaaattaaaattagctgggcatggtgagcacctgcctgtagtcccagctactcaagaggctgaggcgggaggatcacttgagcccaggagttcaaggctgcagtgaactatgattgtggcactgcactgcaccctgggtgacagtgggacctcggctctt

SEQ ID NO: 522769 - DNA, 292 bp, Homo sapiens
tagtagatgtaccagaaacgggctcaatcgggtcacttgctcacggtcactgatatggtttcgctgtgtcccctcccaaatctcatcttgaattgtagctcccataattctcatgtgttgtgggagggacccagtgggagataactgagtcatgggggcggtttctcgcacactgttctcatggcagtgaataagtctcatgagatctgatggggtttttttatatttgttatttttgtttcgtttagtgtcgttttgagacagagtttcactcttgttgcccaggctggag

SEQ ID NO: 522770 - DNA, 477 bp, Homo sapiens
gtcacctctagcaggatccccattgtgtcactccagcggagagcaaatagagaccaggcaagtgtgtcacccagcacccgggtagaaagtactgttgttttctggaggcagtgaaccacgagatatcctctgaatgctgtagttctgccaacgattgatactccacaggtttatgtaccttcctgcgggccgcttgtcaggtgatgacctgtttagctggatataggatcgcctttggctagcctccaacccagctggcaatcttagggctcacgacagggccctgtattttagtgacagctcatctcagccgactcagccattctaccattccttcaaaatcgatctagtatcctccttgcacacctcccgagttcagaggcagatcgtggtctccgtacacgacttaccctagaagagctttgtgccccttctggacagcaaatacgtcctctgtgtgtgggatatttggcagtc

SEQ ID NO: 522771 - DNA, 923 bp, Homo sapiens
ggaatgggcgcttgttgataaagtgcgcggggaaaattgcttagaaatgtggggtgccacaagctgtgggttgagtggtggccgatacttgttcggccgggatagctttgaaataaaacttttggtggccggttcatatggaggaaaaccttgtttgtgaagtcggcgagccagggtgttgggggtgtggtgcgagcaatggcaatgacctgttgcgtttaccaccgtgcgaccgctgtaatgttttcatgaaactgtgtacacacgttgcggggttttcatcacattaagagtacgcgaagaaaatattgtgtttaggctgtctcttgttgatggcacggggggttcaaggaacccggttcttgtaagtagggaaagtgcgttaagatgggccctgcggtttctcatccggacgaggttgttgaagaaagtaattaacacaggtgtgaaacgcgttaagtactttactatctacgggtgggtatatagagattccgccccacaaaagttgtgttgtgatgaactgctcatgagggaaccccgcagctggtgtgaaggtcactggttgttgaggtatgagtggaggtgattctgtggaagttcaagtcgcacaagaagagacaaagcgcgagggtacatgcggagagcgcagcaagaatggttcggcgatccagtccccaggcgccagacaaaggggcagaatgtacaccagaaaaaaaaaaacaagagtgaggataaactgggggaggttttagaagaaccataatgggagacagagtaaatatccggggagcaaggttacgaatacgacccgcccagaatagggtgaaaagtaaaatcgcccccgctggctttgccccagaaaggggcccaccagtaccatttcaaaaagttaaaccacacaaaaaaagaaccccaagaca

SEQ ID NO: 522772 - DNA, 147 bp, Homo sapiens
catgagcaggtaatctctgatgtcaagctgaaaggtgagtgtcgaagagttgatgtagacattgatgagtctgaaacgtcccattatctttgggtgggcttgctggggggcgtcctgagggtagaggaggagagggatgttggcaag

SEQ ID NO: 522773 - DNA, 818 bp, Homo sapiens
  misc_feature (1)..(1): n is a, c, g, or t
  misc_feature (79)..(79): n is a, c, g, or t
  misc_feature (87)..(88): n is a, c, g, or t
  misc_feature (90)..(90): n is a, c, g, or t
  misc_feature (200)..(200): n is a, c, g, or t
  misc_feature (224)..(224): n is a, c, g, or t
  misc_feature (228)..(229): n is a, c, g, or t
  misc_feature (236)..(236): n is a, c, g, or t
  misc_feature (238)..(238): n is a, c, g, or t
  misc_feature (242)..(244): n is a, c, g, or t
  misc_feature (247)..(247): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (262)..(262): n is a, c, g, or t
  misc_feature (264)..(264): n is a, c, g, or t
  misc_feature (275)..(275): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (336)..(336): n is a, c, g, or t
  misc_feature (355)..(355): n is a, c, g, or t
  misc_feature (378)..(378): n is a, c, g, or t
  misc_feature (385)..(385): n is a, c, g, or t
  misc_feature (396)..(396): n is a, c, g, or t
  misc_feature (405)..(405): n is a, c, g, or t
  misc_feature (421)..(421): n is a, c, g, or t
  misc_feature (429)..(430): n is a, c, g, or t
  misc_feature (433)..(433): n is a, c, g, or t
  misc_feature (450)..(452): n is a, c, g, or t
  misc_feature (471)..(471): n is a, c, g, or t
  misc_feature (475)..(475): n is a, c, g, or t
  misc_feature (478)..(478): n is a, c, g, or t
  misc_feature (571)..(571): n is a, c, g, or t
  misc_feature (578)..(578): n is a, c, g, or t
  misc_feature (584)..(584): n is a, c, g, or t
  misc_feature (597)..(597): n is a, c, g, or t
  misc_feature (711)..(711): n is a, c, g, or t
  misc_feature (713)..(713): n is a, c, g, or t
  misc_feature (815)..(815): n is a, c, g, or t
naagcactggtcctctgaaataaagcaggcaatcaccattcaataaacacacttgatttattttgtataaaagggttangtttacanntnaacttttttaaaaagtttagcatgaataagtacatcattacacttttgaatgcagaaatagacatctctgccactatacaagaaaactctaattaaagagttcacaaggnttcactcaaatagatatatttatntatnnatatatncncagnnntcngaaggngngngtcananaggtaatttcngaccaaaagacttcatttaagtgactgaatactggatccntcnggnatncacgctccaccnttgaaaaaaggcaaagtcngcttagattgggcaattccttgngattttnacgttttcgcnccccatggngggaatagtatataangaaaaccnnccnactgcagaaagggcatnnnaaagtctttttcataaatnacgntancacagtccaagtcagagaacaccctggggagatgatcattcttagttttccttccattttttttttctttttaaaaaggtccaaaaaaaaagncctcccngtgccntggttgacaaatnagttcagcacttaaaagattccgtgaatttgttgttgttgttgttgtgcaaagaataaaagaaatcatgaacaccgcttattcagccacacagtgctttgctgtcatttgacantnactcagaagggaattcagaagcctgctaggacaggatgctgatatccgtgttgagggtggtcagcggcgtcctggacgctgggttctgcccgggtctctggngat

SEQ ID NO: 522774 - DNA, 272 bp, Homo sapiens
  misc_feature (161)..(161): n is a, c, g, or t
  misc_feature (193)..(193): n is a, c, g, or t
ttcgacggtgtctgctttgtacccaggctgagagtgaagtggtacaatcatagctcattgcagcctcaaacttatttatttacttttttagagatggggtcttgctgtgttgttcaggctgatcatcactgtcttgggaaccaagtccaggaaggcttcancagaaaaaaaaatgcttcagccaggtttcagntggaggcataaatactgtgcatggggccaggtgccattgctgatgcctgtaatcccagtactttgggaggctgagatgg

SEQ ID NO: 522775 - DNA, 1573 bp, Homo sapiens
  misc_feature (1408)..(1408): n is a, c, g, or t
ggacgcgtgggatcgacccacgacgtcgacattctggacacataagaacagatagagtgttaaaaactcatatcccattaaacagagtgtagggaatgggatattgacagaatctgaaaagcatgacctgcactatacattagtacactgaaactatacactaatatatctaaagtcatgcatgtctctgaaacagcttacctagttttgtaaatagacttacatatggataatatcttatattaatgggaaaaacgtagtgcagacaatgtaacgtaccagaccaagtactgcaaaaaccatgtatacgctaatatgacacaaaattccacatagttgtagacatacatgatgataaactctatgatggaccagctaggacgaggataacaatcaagcataaagtgtatctttaaccagcatgattgaatacatatgcatggaacatgtacataaaatgaattccccctcaagtatcctgaagaccatatcacaatccacatacagtgagaaaataagaataacgtacaccatagtgaaatatacgagacaggcacaaaaaacgacagacaatcacgtagcgtaaagagtagaaacggtaaacagcaaacaagagcaacaaacaacacatacacaagaagaaaggaacaaaaggagaagagagaaccacaacacaaaaacgggcacgagggacacagacgaagaaagataagcagagaaaacagaagacggaccgaaacacagcgaatagcgacaaagagcagacaacgagaagagacggacagcagaaaaggaaagacgaaccgacggaaagaggaaaaacaccacaacaaaaaggaccagacaccacacgagccacaccacaaaaaacaaaagaaaaacaacgccagaacaacagcaaaaaaaaacacaacacagggaacaagaacacaagagaaacaccaaacccaaaaaaagaacacacaacaagagccgaacaaaagaaagaaaaaaaaaagacaacaaaagcaaggcacagagacgcgcagaagagaggaaacagcatgcgggagcgcaggagagagcaagaggagaagcaaaggggaggagcgaagagagaaaagacgggagaggacaggagcagacagcggaggaacggaacaaagacgagaggcagcgaggtagtcgagagcaacagaggccagaagccagagagcagacagcgacgagaaaggcaagaggacgggagagaagaagcaacgagggaagaggcgagaaggaaggcgaggagcggaagacgagaggagacagacaagaggacgagagcgagggaagacgggccagaagaagagaagggagaggggcaagccaaacaagaagacgagagacagcaaaggggaacgagggaagagaggagccgaacgcggcncagacacacgaagagagagacaaagagagaaggagaaaggagggccaggaagacggcaacagaggcgagagcagaacgagaagagaacagcgaggtggcacagacgagcgacgagggagagaagcgagaacgcaggagagagagagaggaggagtgagagcgagg

SEQ ID NO: 522776 - DNA, 948 bp, Homo sapiens
taaaagggttgggggggggtccccccccccttttgagggtttttgaaaattggggtttttttttccccaaaaaaaaaaaatgttgtccccggcctcctggtagaaatatggcgcaattattcgtggtaattcaatggtgaggagagaaatttattagactaacagcaaaggtaaaaaaaacatttgtgtgccaagagagtatactcatgggtaaaacaccccttctagtagttataaacaaagacatagtattatgtgtactactagtagtaataaggaatggggggggccaataatatataaaacgacaaagagataacacaatattaaagaggcaccaagatatagaaaactaattattaccccaggggggatgagcaccgagaagattggagaaacgtctattaaaaacaaaaaacgagcgcgcacatagtttgtcgccaattttatgtggtccccctttttttcaaaaaatctgcggtgggggcgctcctccttagagaggatttagtagaattctctgatggagaaaaaagagaaaatcattgggtactcatgagtatataaagaggagagcaaacaaagacaaaaacaatagggggcagaagaaacaaaaattgtgatggagacaggaaatatcctcggtctggtaaacaacaaaatcacgtgtggagggaaagaaaacatcagccgggggagcacaccaccacagagcaggaggagagaaaaaacacacaacccaatggggtgaattcaaaaaccaaatctgggggaatcatctcttgatcgtacacacccaggaggaggggtcccacaagagaagagggggacattcatcaggatgagagagaaaaaaaagagcagggaggggagaataaatgaatcagagggcacttatcacagaagagaaaagcggatcttctttggaaaaaaaaagcgcatcgaagc

SEQ ID NO: 522777 - DNA, 173 bp, Homo sapiens
tctcgacattatggctaaaaagaagcacactattggtaaaagtttcatgctgtttaaaatttaataatctccctgggcccatgtgtggtttttcttctatttgaaaatcctgataaggcagtttcggatggtggttatttaataccagaaaaccttttctttggtgcacaact

SEQ ID NO: 522778 - DNA, 142 bp, Homo sapiens
tatagaatagaagaaccagaaacgtctgcttgctggaggaagctggcatgtccgctcctccactccttttcttttccccttaggagcggtttatggttccttttgttttattcttttatttgtacaccgtgcttatctcaat

SEQ ID NO: 522779 - DNA, 259 bp, Homo sapiens
  misc_feature (57)..(57): n is a, c, g, or t
  misc_feature (77)..(77): n is a, c, g, or t
  misc_feature (173)..(173): n is a, c, g, or t
actgggttctgagagcttccagatcgctgaacatgtggtggttcctgaagggtggtnggccctggggagggcatggnaagctccacgtcccttcccacatgccttgccctatgcagctcttcatctgtatcctttggcaatatcctttactataaaccagtgtaacataaggnaaagtgtttccttgagttttgtggaggccctcctaacaaattcaatttaaacccacggagggtttgtgggggaaccccaatttcat

SEQ ID NO: 522780 - DNA, 503 bp, Homo sapiens
ttccctggttgatgccagtgttctcgacactctttccttatcatgcctcactgccccagccccattctaggactgaggaccttttagcgcaaagtcaaagcttctatcaccttttcttgcccccttcaagcagagtcccctcgcggctcctctccgctagtccggcccctgacccctttccccagtacccacttcctgcctctctcattaagccttccgtggctggctcaccatgaccccatcagaatccagttacaagactcttccaaatttcccaaggttcctcaataccccatctctctaacccatcaaaagggcctacagcccatcgtgaacaagctctgctcatgcagtcttcttagaccaacacaatctccatataggacccctatcctccctgttagaaagtctgatggctcataccgactcgttcacaaactccgagccagtcagtcaagctgtcctccgtattcatcccatagtccataacccctatccacttc

SEQ ID NO: 522781 - DNA, 474 bp, Homo sapiens
  misc_feature (112)..(112): n is a, c, g, or t
ttgcctcgctatctatattgttagcaagtatcgaggcgtatagtatcttccggtctgtagagtctccaggtttaagactcgcagcactgatggtctccaggtcatgcacatntgtgtcacagcgatcaatcctgtggctctgtgatcaggcccaaatcacaacagtgtgcctctcgagtatggcatctaatcgtgaggatgacactggcctgagctaggctagacatgcggtacgctagtaggtctgggacccgttccagaagccccgtcttcaagcatgaactcgactaaccatatctgttgagccgtaccacaacagaaagcttgtgcgacgagaaggacaatgataccggccttcatcatggaccgcgtgtgcttacataatcagggcaccttacaacgtccttgtaacggtcctacacgatatggtacatctgcactatctgcaggatctcatacagccgaacgtggtcg

SEQ ID NO: 522782 - DNA, 758 bp, Homo sapiens
  misc_feature (673)..(673): n is a, c, g, or t
  misc_feature (733)..(733): n is a, c, g, or t
  misc_feature (746)..(747): n is a, c, g, or t
  misc_feature (750)..(750): n is a, c, g, or t
  misc_feature (758)..(758): n is a, c, g, or t
gtggagacactttacatccggcacaggaagccttctgatggagcacacctggcccatgaaaagacaagggaaagaaacggggccaaaggtcacagtcctctcatcccatcatcctccttaaaatcatcctaatttcatgggccctgaagccagggctgtttctttacacctagaggccttggcgccgggcctcaattccgccctgttccttaccgtctaagacatgttgggaaaatccctagagccaggatcttcattcctgctaagccagacagccggaagacacacccaaattctgtccctcttacttcagggaacatgtccactttcggcagcgttacaattttggcaccaaatgtgctaactgcaattccaccatacaatgcgtaactggaaatggaggcaacatctccgatcctgaacgatcgatgcgagaatccaggatatgcacggcttattttggccttttcccactgaaacaagggccagtattaaaaatggcacgctatcctctgtttcactccctgcttttaaacgtctccgatgtttctccctgagacagggcctcacttccgtcagccgggcttttctacggtataattttccttgtttgcttttgtccaaattagaactttttatttcatctctaggaaacgttgatccattatcacanacgtatggaaatattatcaaacatgctgtgagatacgttgtttttattttcatcaattcnttaataaaccccnnatncgcccagn

SEQ ID NO: 522783 - DNA, 280 bp, Homo sapiens
ccctgtttgctgcctgctgagtacctgggattacaggcacgtgccaccacaactgtctacttttttgtatttttagtagagatgggggttcaccatgttagctggcatgtcttgaacccctgacctcaggtgatctgcccacctcggccttccaaagagccggattacaggcgtgagccacctgtcctgaacaattattattattttttaagagacagggtctcatgctgtcacccagactgtaatgagtgacatgaatgtagctcactgcagcctcaaa

SEQ ID NO: 522784 - DNA, 581 bp, Homo sapiens
attttggttgagttttttatttaaggccttgtaaaaaaaaaaaaaaaaaaaaggaaaaaaaaaaaaaactcgtccttcctgcccccttggccccttggctgcgttcacccggcccttttggcgttcatttgccgcccatttgcccgtccttgcccggggttcccccgtgttaccccgtgtggccccctcctacccatctcccttgcgttcccttttgctccccctgcgggtccggccctgtcccctttccggcccgtcctgccgcccgttgggcgccctggcctggccacggtgggcttttggcgttagttccggttcaattcgcgggtagttcggggctggttcaccccattggtcaaccttcgggccgtttgggccaatcccctttttgccctagcgttggtccgatatggcccgattcggcctccgggtcgcccctttcggcccttggtttgaacgttaatgcgctttcaccggcgttgcgctttgccccgttgctgccccttttgtttacccacgtcctcgttacccgtgttcggtccgggccgtttccgggccctcttggggccctttggggggct

SEQ ID NO: 522785 - DNA, 649 bp, Homo sapiens
  misc_feature (422)..(422): n is a, c, g, or t
  misc_feature (649)..(649): n is a, c, g, or t
gtggagacactttacatccggcacaggaagccttctgatggagcacacctggcccatgaaaagacaagggaaagaaacggggccaaaggtcacagtcctctcatcccatcatcctccttaaaatcatcctaatttcatgggccctgaagccagggctgtttctttacacctagaggccttggcgccgggcccttcattattcgcccttgttcccttacacgttctgaaaacgagtgttgggcaaaatcccctgagagggcgaggattcttcatattcgggataacccgagacaagccggaaagacgacaccccaaatttaggtccctcatgagttttaagggaacattgtgcccctttcgggcagccatacaattcttgggacgccaatagtgcctaacctggaagttgccgccataaccantggcggaacctgggaaatgcgagggactctatctgcccaacgctgaaccgagcggaatgcgcagaattacaggatattgcacaggtttgatgttagagcctcttccccttgaaacaaggggctatcatttaaaaaggcccccctaccccactgtgggaatccctggatgttaaagcatatcccattttcgtcctcgaagaggggcttacattaactaagagtgttcn

SEQ ID NO: 522786 - DNA, 122 bp, Homo sapiens
gcgcagtgcccttgcttctgcggtctgatctcttgaggactcccccttgcccttcagttttggctgattcactttctagtacgtgctcttacctagcaatttagcgcccttttctaggcggt

SEQ ID NO: 522787 - DNA, 408 bp, Homo sapiens
ttatatctctcagccgtatttttataactccccagtttattttgaaatattcatgattttgacattatctcacaatccacagaaattaccctacctctgcctatacatttactaaatgctgatgaagaatccttattcaatatttaagcatgccacataacaccacttttcgccacttttaaaattattttaaaaaataagccaatttatattggccatctgggttacatgtgcatccaaaaacagtcatattcctcaactgaccatagactagcatacaagtgtcctcctttctcgacgtaattaagtttcacagccaaagtggttcagatggcagccaatgggctgacctcctcatgaagtaaactcgacaaaactcatgacgccttgaaggtgccaacgactgat

SEQ ID NO: 522788 - DNA, 523 bp, Homo sapiens
  misc_feature (25)..(25): n is a, c, g, or t
  misc_feature (38)..(38): n is a, c, g, or t
  misc_feature (67)..(67): n is a, c, g, or t
  misc_feature (94)..(94): n is a, c, g, or t
  misc_feature (114)..(114): n is a, c, g, or t
  misc_feature (138)..(138): n is a, c, g, or t
  misc_feature (148)..(148): n is a, c, g, or t
ccttcaaagaaaagtccaggccctnatggcttcactgntgaattcatactgacagttaaagaagaanttcatacccagttctcaaacttcatcntgtgagggcagcatttaccntgattccaaaactagatatggacncaagaaaaanaatctataggccagtatccctgatgaacatagatgcaagaatcctcaacaagaccaggtgtggtggttcatgcctgtaatcccagcactttgggaggccaaggcaggtggatcacctgaggtcaggaatttgagaccagcctggccaacatggcaaaaccctgtctgtactaaaaatacaaaaattagccgggcaaggtggcgtgtgcctgtaatcctagctacttgggaggctgaggcaggagaattgcttgaacctggagggaggaggggcagaagttgcagcgagctcagatcgtcccactgcactccagcctgggtgacagagtgagactccatctcaaaataagtaaataaataaagagactcaactagc

SEQ ID NO: 522789 - DNA, 521 bp, Homo sapiens
atgtctgggtgactctgaggatcccgtgggctgggtctgtaggagatggtgccagcaggcaggcttcgagttcatgctgcgctacatctactacgggaggtcacatgccgccgatgactcgctgcattctcactccccagtgaactcccaggtccccaccaaggtgtcctggcacccacctcaggtggctttgaggcccgctctcctgccccagctaggtgatcttggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgtcacttcagtaggggtctgaacatggagggtcaggatgcctgttaggcctgcaaggccatggaacagcgctacagatgtacagaccccatggggggg

SEQ ID NO: 522790 - DNA, 105 bp, Homo sapiens
gtgtggttgccgtgttggctaccaggccgtcggcccgccaggcatccgtccgttcgggctcacggcttggctctccagggctgggtcggccagttgctcaggcgg

SEQ ID NO: 522791 - DNA, 2371 bp, Homo sapiens
ggtcgcggtactgctaatcctgggccgtgcggtgcctagcttgcttgcgccgtaacgtgatccatgcacgtctatgccggcttcacttcatcctgtggacagcgccgagactcgtcgcgtagagcctcaggctctgagcagcacgtccgtcacgagcaagtgttgacggcacccgacgtgtgcatgcacccaaggggaactgacccggcttttacgcgcacggactccaatgccccactgacttgcgccgctgatgtggacacaggccacagactctaggggtcccaattgcgaacgctaacactccgtacgtcgccggtcccctctccccgctatgcgcccccttcgaagcaacatgatctcctgcgatatacaagagcctaccaacctgtcgcgtttacgacaccgctcccatgacccggcgcacaccaaacatcactttcaacgcttgtccccgtcacagcatcccttgtgaaaacccgcactggctcccaaacgccacactcgacggccccaatgctgccagtatggccaacagctcccacaagcgcccaaatctcgtctgcgcgccatccccttggcaacatggggaaacgtattgacccggccgacgcattgctctcgataacggcaccgccctctagccgagcccccgccaccgccggcccccccacacgcaacgcaaccaccgccacaccgccggaaccctccagccgcaacccgcgcacactgcaggcaccaccaaccgcccaccccgggcccacccacccccccctacgaccccccgcacccgacccaaagccccccggcaccccaccctcaacccgctacctatcatcccttgaatcactccaatctttagccccacactctccagtcacaacttatcacctttctatatccacactctacgccttacgctccctacaacccccccccccccatcctaaccactctgtccccacaaccaacccgcccaatcctcccaaccctcacactccccccacctccaccacaccaccaacagcctaccccatcctcccccgcctcccccaaaccaccaaccttcaccacacatccacgctacccactccgcccataacctccacacccgacaacacatcccctttcaactctcgcctaccaacacgctcccccctcccacccttatccccccccacattttccccaatcccccctcctcaccccactaccacccccccacccgtgcaacctccacccacgcaaacagccgggcagaccacatcaaaaccgccacagcaatggccccccgcgcagcccactttctcctccccgccaactaagttgcccaacgcaacacatgaacgggaccccaccccgtgcacacaccaatacggcagatcatacacacgtctcgcaccacgcgaacaaattcggtaaacacaaacccccacaactgagcggaacctataaaactggccaccatgttagacaaacacacctattcacacaatcgtacaaatagcctccccaccatccactcacacatctacttcatctactctataaacactaatatcttatactccacacaactatacatcaccttaacacacattacgacaaatgaatactcttcactaccaatcaaataacatatatcaaccacccccactaatacaactgttgctactcactccacatatactccataatatatacacattagactatcacccaatccctctactgatgttaatactacctcacctacacccctctcaaccaactcctctaaccaccttgtgatccaccccacccccgatataacacaactcatgaccccacataactaagactctcaccatcatcacttcacacctcatatcttcacttcaccagcactcttctccaagcagcacactacaaactataccttcgcaccttctattcttaacccctacctaccaacatcttcatcacctcaatagcgctacgactcatccatctctctcatcgaacaactaccccactcaacatgctctccacctacataactcaccctataccctccaccctccttccatctcgcctactcccacaacactcatccctaccaaccctcttaccacatcaccacacacactaacccactacaactaccactctacacacacaaccccaacacattcacacacacctaacatcatcacacactgccgtccctccccactcactctgatctacatctcacttcaatacactagccaaccacttcccacacatccatcacccccctcaactcatccacacacacactccttcaatcttcacatgccctctaacataccactactactaccaccacaccatttctcgtcatcccaca

SEQ ID NO: 522792 - DNA, 445 bp, Homo sapiens
aaaggcagtggaaaaggcatgagcaaagacgaatgccacatctcactgaagatgatgcacagttaatttttaaaaaatgctggtggataaatttcaagcaaattatgtgagtgaaaagagcaatctcaaaagaagcatatagccaggtgtggtggtgtgcacctgtggtcccactaccggggagggtgaggtgggaggatcgcttgagcctgggaggtagaggtggcagtgagccaagcatctagccgctgcactccagcctgagtgacagagctagactccgtctcaaacaaacaaacacccctgtccttgctcagtcatctataatagctcttagttgcttatttaaaacaaaaatctttaaagcccatcccaccctaggttacccagcccctactttcagtgcctctctgagctactgtgtctgtaaaatcaaggtattgta

SEQ ID NO: 522793 - DNA, 350 bp, Homo sapiens
  misc_feature (5)..(5): n is a, c, g, or t
  misc_feature (16)..(16): n is a, c, g, or t
  misc_feature (46)..(46): n is a, c, g, or t
ccccnacccaaaaccncatgttgaaaatgtaaacccccaatgccgnaggtgggacccggtgggaagaatggatcatgggggagttttcctcatgatttaacaacatccgccctttgttgtcatgatagtgagttcttgtgagatctggttgtttaaaaatatgtgacacctccccccaccttccttctgctctggccatgtaaagtgctcactccccctttgccttccaccatgattgtaagtttcctgaagcctccctagaagctgagcagatgtccagcatcatgcttgctgtgcagcctgtcagaactgtgagtccaattaaacctctttatgaataaaaaaaaaaa

SEQ ID NO: 522794 - DNA, 669 bp, Homo sapiens
cgaattcggccattatggccgggcgcggtggctcacgtctgtatttccagcactttgggaggccgaggcaggtggatcacgaggtcaggagattgagaccatctggctaacatggtgaaaccccgtctctactaaaaaatacaaaaattatccgggcgtggtggcgggcgcctgtagtcccagctactcggaaggatgaggtgggaagatcacttgagcccagcaggttgaggttgcagcagtgagccatgattgcaccattgcactctagtctgagcaataatagagcgactctgtcttccatccatgcccgccgtctactccgagctctctccttttactgggaccacacctgcctcgcacctccgtcctaccgtctcctctacccagctagcactgcgactgcccgacgcccctacggcccgccccatcgtccctcccccatgcttctatccccccccctccttccctccaccgcactatcccccctcctcccccgcccctcctcctcgcattccctcctcgcatcctcctcccctcccgcccctcccccctgtcccctctcccgatcgtacctcacactccccctcctccccctgctcgtttctacccccttgtctcctcccgcgtccccacagtctgtgcccctcttctctccccctccttccg

SEQ ID NO: 522795 - DNA, 180 bp, Homo sapiens
gtagagacagggttttgcaattttggccacggccggtcttgaactcctgacctcgcgtgatcctctcttctcggcctcccaaagtgctggctgggatcccaaagtgctggctgggattaccaccatgagccaaggcacccagcctatcgtacttttttattgttgtactaacttaaattt

SEQ ID NO: 522796 - DNA, 1055 bp, Homo sapiens
ttgtgctgctcgtattctctgttggcggtcgctgtgatgtagagggttatgcccctttctgggtgtggtgatttcttggggggtgccttggttctcggcgtgcctggtcggcggttcctttgttctccccctgttagttgctggctacgggttgggttgtatcgtcgagggcgtggtgggccttgcgttctcctatggaaggtgctgccagggggctgtgttgcagttcggactgggtcgtagctacgcttgggtagtgtgtcgtttgctagggcgcgcgtgtgctggttgctagtgttagattgactttgttcctctagctgcttgctggggcgggtctaggaccgccctttgggtcacgcgtgttgggagattggctgggtaggctcaatgcactcggaagatcctggttaaagcatgatgcatctaggtgagccttcgaactgctggtccgttccctgtgtgtcggtccccgtctgggtgcctctatgcaggaagagcacgatctgggtgttccagggaggcccagtgctaccctcggctgatcttcctccgctgccgccgaggtcctggaacgaggggcaaggagcacgttccatttgcctcgtgatagccagtggagtccgtaggcagcgcccgttaagccccgtggcgtgagcaagctgtgatacagcttacgccctgcctcgcagttgcaccatcttctagatgtgcactgtgtaaaagatctaagctagtgggatgggagaaacttgagggtgagtcgggaacctcccctgctgagggtggtcgtcagggttccgtgactccatgtgggccagtggtagcctgtcccagacaactcctgtcaccccagctctgcctgtgccatttatcccctgatcagctgctgcactagccttccatgcttccctaaggacttagtggagggggaaagttgtttttggtactacttggtgggaagtaaggggaaggttggatcttggttactgctctacccacctcagagaaaagactacaacctgggagaaaaatatatagttttttcctgtcag

SEQ ID NO: 522797 - DNA, 408 bp, Homo sapiens
ggtactgtgagctcccggaggtgcatccaccgtccaagcggtggcggacacgagacaggcacgacacaaggctgcccgtacgttcatagtgaagttcggctctcgcgagtgggtgctgggccgcgtggagtaggactcatgggtgagcgacgtgccgctcagcctcaatcttgccgctggtcatcgtgccccatgggtgggtcggtcatcgcggtgtgtgctctcgcgtgcatagctgggaaggaaggaggccagtaggcctacagcggatacggtagttaagaggatcgatggtcccagtgtggagggcctggaggagacgcgtgcgggaccgtctgccaagaaggaatgtcacatgatccgtgagtgactctgatgagtggatggagcatgtaccaaagaggtgct

SEQ ID NO: 522798 - DNA, 259 bp, Homo sapiens
agttctgccctcaggagtattacactcttttcttatcagcaaagctctttatgtctgtgagtacacgactcatctagtataaagagcctctgtatacaggactgatatgcatctgtgctctatctcattgttcttacgtcccttccctgatcttctcttctttttttttgggcagggtctggcgcgggggcccaggtgggtttcccagggtcgcaatcgctcggggccactagttaccgtccagcctcccaggctccag

SEQ ID NO: 522799 - DNA, 114 bp, Homo sapiens
  misc_feature (93)..(93): n is a, c, g, or t
ggcagaagacatgtttaataacattttcatatttaaaaaatacagcaacaattctctatctgtccaccatcttgctcttctttgcctgttgcngaggcagacaaaggaaaggga

SEQ ID NO: 522800 - DNA, 140 bp, Homo sapiens
cacctgattcctaattacggggagaagggcgtggctgttcggtgtgtacagtgcttcactggcctttattcaagtcaagcactcgtattcttgatttactgctaaatcctcctttggatttctatatgctttcataaaaa

SEQ ID NO: 522801 - DNA, 107 bp, Homo sapiens
agatggcggaggtggaggttttgtgctttatggttgaggaaatttttttggggggtttggggaaattggtggggtaaaaaggtaattattggggggaaggttgtgtt

SEQ ID NO: 522802 - DNA, 237 bp, Homo sapiens
  misc_feature (19)..(20): n is a, c, g, or t
  misc_feature (46)..(46): n is a, c, g, or t
  misc_feature (67)..(67): n is a, c, g, or t
  misc_feature (84)..(84): n is a, c, g, or t
  misc_feature (123)..(123): n is a, c, g, or t
  misc_feature (205)..(205): n is a, c, g, or t
  misc_feature (207)..(208): n is a, c, g, or t
gaaaagctccaaactcctnnccccttccataagggccccccaaaantgtgttggggccatgtgttgntgggtccctccaattanctgtgactgttagtattgaagaaggttcagggtttttgncccttttgcatccctcccttgttccctttgggtggtccctcaccggcctcaatgtgttgccctggggactcattactttggnanntggctttttataaaaatgggtcaaaccca

SEQ ID NO: 522803 - DNA, 245 bp, Homo sapiens
atgagatgtggtttctccaagttggtcaagctggtggcaactcgggacctcatgtgatccgcccacctcacgtcgtccaatgctgctagcgagttgcaagcatgagccactgcgtgatgaccatctataatctactgttagtcactatggaaacggaccctccaccttagcaaccagagatcgaacccgtcaagacatgcatcaagacccttcacaagaaacgtcggggctacatgaggggtacc

SEQ ID NO: 522804 - DNA, 420 bp, Homo sapiens
ctatgaccatgctttcggtttcagtggccatcggtttacatccaacatttattcacttcttaaatctatttgtcagggtattgagacagggactccttacgtcaccccggctagaatgcagtggtttgatctcagctcactgcaaccttggcctcgcaggctcaagcagtcctcccacctcagccccctgaggaggtggtactacaggtgcgtgccaccatgcccggctaatttttgtatttcgagaagaggcgcttttttgctatgttgcccaggctggtctggaactcctgagatcaagtgatcctcccacctcagcctcccaaactgctgggattacaggcgagagccaccacgtctggctcacttcttaaatattgcctcgcgtcttttagctggctttctcccaacaagaccatt

SEQ ID NO: 522805 - DNA, 212 bp, Homo sapiens
tggggggagggggtctatttttgtcccccgggggggggggcgggggcacaatttaagttaatggaaccctcggcttccgggttaaagggaattttttgcctaaccctccttaaaagtggaaatggggggcttttcccccccccccaagttatttttggttttttaagaaaaaagggcccactggaaaaaccccctttttttctcaaaaaaaa

SEQ ID NO: 522806 - DNA, 200 bp, Homo sapiens
agtcagtggccagaactagcactctgaaaagtaaaatgatcgtatgcagctccaaggacgcaatctaaaagaaatttcaaggcagtatacatgaatgtcaagcatatggaccagaacgatctcaatcgggcttgtattgctgataagtttcgtggatcctttattgttgcctttgaaggatgccctgtgtagattattca

SEQ ID NO: 522807 - DNA, 150 bp, Homo sapiens
  misc_feature (84)..(84): n is a, c, g, or t
tattgcctcactcaaaactgagttaaaaataatctcggctgggtgcagtggctcatgcctgtaatcccagcactttgacaggtngacgcgggccctgcgatcgtcccaccgcactccccaccctggtgccagagtgagccaccctctcaa

SEQ ID NO: 522808 - DNA, 838 bp, Homo sapiens
acaggaggagccaggacaatttcggcaaacgggaatccgctgtggccgacgccgcatacacagtgcggagacggccgttggcataaaggccgaggccgccgacgacaatggttacaccacgggtgcccaacccgggggggcaaaaccccagcccaggtcgggcccctggggtggcaccgccgacccaccagaacaggaatgggtggcccaacccggccacaggacgccgcgagtcccgcgcccgccgcatagcgcccgcccgaagacaacctaggaggtgtaatcagggccacccaacaaccctggtgcgtaaccaggcaacataggaggattaatagaagctcaccagccccctcaggggcaactttataagccccgaggatgaggtgcacaccacagcttgataatccgccgagacccgcacgcgcccccccgacagcacaccgtcgcgggcaaccagtctctcaccactccagcaatgtgccgccggcagcccccaaagtagtggggaggaagtccactccaaaacccgccccgcacttaggtgtggggaaataaaaaaacccccccccccaaatgttcttccaccttgccggggagagaaccccccccagctgccggggccggggggtgccaaacccaatgagaaccccaccaccactgaggagcagtagcgagggcacggagaacaagcacctctggaggtcccagagcccactggactcccccctcgcgggtccaccacacgggggaggaaaccccaccctcttcttggctgaaaaaaaccaagaggaccccacccgggggaaaaaaccgatccaccccctccacaataaca

SEQ ID NO: 522809 - DNA, 1132 bp, Homo sapiens
tatgaaaaaggggtttttctctggcccccccggtgttccccccggggggacaaaggaaaaaaaaatttttccgaaaaacaaagaggtatagaaacccccacgtggtggtgggcgacaaacaaaaacatgagagacaccacgaaaaaccgcgggggcgtgagcaagagcggcgaggacacaacaaagaaacaaccatagagagaaaaacaacacaacaccatgatgggcaaaatttactaaaaaaagaaaaagaaatctatcaaaaacgcaagagggaataattctacgacaagagagtaagagaggggaagacaccaacggagcgggcgagcgagaaaataagtaagaacaaacacagagcaacagttggaggcggacaagggagtagaacaaacaacgagaacagcatgaggagagagacaaaagagaggtagtgaagaaaaaaaagaggacgaaataacaaaagtaaagaccggacgacacacagtagagaggcagaaaaaaaataacgaacagagagagagtgaaaaaaagacaaagaacataacaagcaaaaagagagaagaagagagaggagagacgacacacacaccagacgagaacgaagtagaagaaaaaacaaaaaaaaaaaaaaaacaaagaaaaagaacacatcaatgataccaacgccacagagaagagatgatgacaaaagggaagagaacagtagacgacagagtagacagacgaagcggaggtagcaacgaaagagagagaaaaaacaaagatggaggaggacaacacagcagaagaaagcggggaccaccacgagcagaagacgcagcacgaccagagaaggaaacaagaagcacaaaaccaaagaggaggaagaggcgaaggacgaacaaaaaaagaacaacagaacgaaagagaaagaaagcagagagaaaagacaaaaacgagaaagagaaagaaaacaaaagtaaatgcaagaaggaacaaaacacaaatagatataaaaagaagaagggagcaaaaaaagagaagagagagaggagatcacgaaacagaaaacaagaaaccggaaccaacaacacaagaaagacacacaacgtgacggccagcgtataccatgaagaaggaggaaacgaat

SEQ ID NO: 522810 - DNA, 105 bp, Homo sapiens
ctctccttgcggccgccagtgtggtgaattcgcatccgcccagacagatggataccaagcaactatccaattactgaaaactttcgagccatatacttgacctta

SEQ ID NO: 522811 - DNA, 153 bp, Homo sapiens
acagctggcaggggtactgtgtgtgtgttttctggatagggtgctgtgtgtgtgttgtccggccagctggggtactgtgtgtgtgtgtgtccggccagctggggtgttgtgtgtgtgtgtgttccggctgtctggtgtgctgtgtgtgtgtgt

SEQ ID NO: 522812 - DNA, 332 bp, Homo sapiens
tgattggccatagaagccggcgtaaagagtgttaagtcaccccctccccaattaaagctaatgctcatctgagtcgtaaaagactccagttgacacgaaaatagactacgaaaggggctttatagctatgtctgatcgatcacaataggtaagacccaaactgggattagataccccagtatgcttagccctaaaactcaacagttatatcaacgaaactgctcgccagaacactacgagccacagctgacaactcaaaggacctggcggtgcttcatatccctctgagaggagcctgttctgtcatcgataaaccccaatcaatcataggg

SEQ ID NO: 522813 - DNA, 367 bp, Homo sapiens
  misc_feature (17)..(17): n is a, c, g, or t
cgggcagtacggatgtngtgctgttcatatgtttgatcaaaggccaggacgaagacctagaagtcatgcttatcaaaggagctcatggcagaggtaagaggagggctacctgatggatggtgaaattctgattcaaaatgatcttgagatgtcgaaatgaacaatgcaatcaataatagaattgaatccagctcaacgctgcactatgacattaagaaccatgccccaatcaaggaaaataaagtcttgtagcttgggagcaataaaaatatggacacagaaggtctggggttggtgcggaggtccagagtctgtgtgaaaagaccgggaatggatctaagaagtgatgggagtagcctccccacat

SEQ ID NO: 522814 - DNA, 1041 bp, Homo sapiens
  misc_feature (1041)..(1041): n is a, c, g, or t
caggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggtttgttttagttctttttttttttttttctttctcttttttaaaaatatgtggctgtgaacttgaatgaacactgctcaaactttctgctatgggggggggggtgggatgggaagaaggggcgttggttaatcctggggtgtttccaggtgcaataaatagctacaaactttcttgtgcacctctgtgtttgtcccgtgtctgggtcaagccccttgagcggggaggtttcggtaagttcccagttccagatctgcccctgggcaaaataaaagtccgggtctacatctcgtgatgggaaaaacacaaacaacaaagaaaccaacaaaaacaaaatacaacaaaaaaacaacaagcaacaacaaaaaaagaaggagggggggccggcgcctacaaagataccccccggggggcggccccaacacaggcgcacgcacagcccaagtctattggatgaaaggggcggggagccccccacagaggggaggccgacgtcaaaatgacagcgaacagagcgacaaggacggacgcagattaaaacaagacagcgccgcgcaggactgggaacaaacaagtgtcaccagagcggagacaccatgcggggacaggaagcccccacgtcagcaggagcgggggggggaaatcataatgggtgggcgaccacacaccttcttccatatgggaagttatatgatcgcgccgcctatgggaggcctaaaatttaaccggacgtctggcagggcatagtatagcgggtctgtaaccaacaccaccagcgctgacatactctcctcggcctgctgctacacagaatagttagtgctcagccgaggagagatgtcattatgtgagcgagactattttccacggcagccacctgctgagcagtagatcaggn

SEQ ID NO: 522815 - DNA, 307 bp, Homo sapiens
ccccgactagcccgacagggggataacacgttcgcgagccgaagcagggcaaggcattgcctcactcgggaagcacaagcacaaggggtcaggacccacttgaggaggcagtctgtccattctcagatctccagctgcatgctgggagaaccactactctcttcaaatctgtcagacagggacatttaagtctgcagaggattctgctgccttttgtttggctgtgccctgtcgggctagtcggggactgtcgggctagtcggggactgtcgggctagtcggggatactatcctgtcgggctagtcg

SEQ ID NO: 522816 - DNA, 150 bp, Homo sapiens
  misc_feature (4)..(4): n is a, c, g, or t
ctgnttacacgaagcctgatttggttgttgtaaagaatgtgtgatatctaaaataactggtgcataattttgcatcacaggaattccacgataatctaccactaaatctccgtaacctaacattgttccacgctcgataattgctacatt

SEQ ID NO: 522817 - DNA, 840 bp, Homo sapiens
atgatatcaatggcttcctagggtggatcgtgtgagcacaccatatattgacagtaggaatagacgtagacacacggagcatatttcacctccgctaccataatcatacgctatccccacgcggtcgtcaaagtatttacgctgatctcgtccgacactccagcggaagcaatatgaaatgatctgctgcagagctctgagaccctaggattcatctttcttttcaccgtaggtggcctgactggcatgtattagcaaactcatcactagacatcgtgactacacgacacgtactacgttgtagcttcactgtccactatgtcctagtcaagtaggagctgtatttgccactcatagggaggtcttgcattcactgtattgtcccctattctcaggctacaccgctatgagcaaagggtacgccgaaaatccatttcactatcatattcatcgggtaaagtctaaggtttcttacccacaaaactgtactcggcctatccggaatgccccgtacgttactccggagctaccccagatgcatactaccacatgaagacatcgctatcatcttgtaggcgtcattcagttgtctctaacgagcgagtaatattaatcaattttcgtgatttgggagtgccttcgcttcgaagcgaaaagtcctaatagtagaagaacctccatgaagctggagtgactatatggatgccccgaggctacaaacattcgaagaacccggatagcataaaattctagagcaaaaaggggaggaatcgaacccccagaagcggtttcaaaggcaacccaatggctccatgacttttccaaggaaaaaaactctag

SEQ ID NO: 522818 - DNA, 1020 bp, Homo sapiens
cagccataaaaaggaacaagatcatgttctttgcagggacacggatgaagtgggaagccattatcctcagcaaactaatgcaggagtggaaaaccaaacgctgtatgttctcacttataagtgggagctgaacaatgagaatacatggacacagggaggggaacaacacttactggggcctgtggtgcgagggagggctaggggaaagcattaggaaaaacagctaatgcatgctgggcttaatacctaggtgatgggttgttaggtgcagcaaaccaccatggcacatgcttacctacgtaacaaacctgcacatcctgcacatgtaccctgaaacttaaaaaaaaaacacacaataaaataaccaaattacacgcttcaaaaaaaaacaaaacaagtcgaaaaaaaaaaaacttgtgtgggggcgggcctggggccctctggaaaagaggttttgtagagacccattgcggtgggggcgcgcgaggggccccaaagggtgaacaggtggaacacgtgggtgcaaacgggtggtgatccacgagggagaaaacccggggggccagaaaataaggcgtggggaattctctcaaccaaaattaaacaaaggccccggggggggaacacacacaagacactattttctgaaacaaaaccccaaaagggggaacttcagggagaggaccacacacagggggggaaccattacacaacagcaggggggttcaccaaagggagaagacccagaacaatcacaaaaatattagggcccccacgtcacggggtggtccaaaagagagagaaagagcgcgagaaaaacgcaaacgacaacagagaaaagagaaaagaaaaaagaaagaaaaacaacaaagaaaaagaaagaaaagaaggacgaccaagaaaagaggaagaatactaaaaaggagaagaaagcaaaaggagaccagaacaaacgaaagaaacaagaggagaagaagaaagaagagaggagcggaaagaagagagacgaagagaaaaaga

SEQ ID NO: 522819 - DNA, 371 bp, Homo sapiens
  misc_feature (50)..(50): n is a, c, g, or t
  misc_feature (200)..(200): n is a, c, g, or t
  misc_feature (284)..(284): n is a, c, g, or t
  misc_feature (330)..(330): n is a, c, g, or t
  misc_feature (351)..(351): n is a, c, g, or t
  misc_feature (370)..(370): n is a, c, g, or t
cccatctccacaaaaaataaaaaaattagttcggtgtgggcgcatgctantagtcccagttactcaggaggctgaggtgagaggatggcttgaacccaggagtttgaggcttaagtgcactatgatggtaccactgtactccagccttggtgacagagcaacatcctgcctctaaataaataaagttaaatcttcaaaanttttgttcaacataaaattgagattgttgggttcccccttctcaatttaggggaggaaagtcatatactttttagctttaaggnagttttgtcccattttaagtcttctggaggttttacaagtctggantttatatttccatttttaggnggattaacccttctgtatna

SEQ ID NO: 522820 - DNA, 208 bp, Homo sapiens
tttgggagaaatgtaaaataatgtaaagatgcagtattaaatcatagctgcataaaatgaactgtaatacacagtatgttactgaaataatttcacagccacctcctgttgctatgcagtgagctcaagtgttggcgtatgcacttaaaatgctgtgacactaatcacctgtgcatgaacaactcatcgccccagtaaactgcatatc

SEQ ID NO: 522821 - DNA, 526 bp, Homo sapiens
  misc_feature (17)..(17): n is a, c, g, or t
  misc_feature (66)..(66): n is a, c, g, or t
  misc_feature (103)..(103): n is a, c, g, or t
  misc_feature (107)..(107): n is a, c, g, or t
  misc_feature (116)..(116): n is a, c, g, or t
  misc_feature (131)..(131): n is a, c, g, or t
  misc_feature (154)..(154): n is a, c, g, or t
  misc_feature (167)..(167): n is a, c, g, or t
  misc_feature (175)..(177): n is a, c, g, or t
  misc_feature (194)..(194): n is a, c, g, or t
  misc_feature (227)..(227): n is a, c, g, or t
  misc_feature (283)..(283): n is a, c, g, or t
  misc_feature (337)..(337): n is a, c, g, or t
  misc_feature (440)..(440): n is a, c, g, or t
tgttctgctggggggtngctctttacaaatggggctggggtgttgtcagattatgaactgttaaanccaggttcttttttggtttttgaaagctaacattgtntttntctttcttncttgattcagttttnttttctcattcaaattaagttgntttaatatttatnatctaaannncatctgtttttttaccngcaaaagtcttttgaattcaagttatgcatgtngggccatcaaatctctgggtgagcctgaacgttgggacctggaaccaatgtgagtntgtgttaatcaatgtactgtgccatccagcggaagccttctccgtaaccttgtnttttgagcacactacacatgaaaacttctaagggtcgggcattcagttctttcagagatatactcccctttcctgttgtctgaccatataaaccaaacatctntcgcaacctctcttcactgatggcttcaggtctgtcgatcttattcccaagaatcagtataggcacattagcaatggtttcatctg

SEQ ID NO: 522822 - DNA, 182 bp, Homo sapiens
atgcagtggtcacagggtggtcggaagagtgtcggcatcggtggtgtcagaagccccatcgctatcgggcgggtacagtggctctccgcgagattcgccgctaccagaagtacagcgagctgctgatcagaaagctgccttaacagcgtctggtgcgtgagatcgcgcaggacttcaagacc

SEQ ID NO: 522823 - DNA, 138 bp, Homo sapiens
ggcacttaccgtcatacagctctgtccagctagagctcaatatggatcacaccgtggtgctgcagctggcagagaagaatggctacgtgactgtcagatgagatcaaagccagtcttaaatgggagaccgagcgagcg

SEQ ID NO: 522824 - DNA, 370 bp, Homo sapiens
  misc_feature (55)..(55): n is a, c, g, or t
agcgaacctctgtctcaaaaaaatgaaaaaattaaacttgaatgaataatgaaanaaaaagggacaaaactatatttaaaaattttagactgggtgcagtggctcacacttgtaatcccagcagtttgggagctgagacaggcagattatttgagcccaggagttcgagaccagcctggacaacatggcaagaccttgcctctacaaaaaaatcggaaaatagccaggcatggtgccatacacctgtggtcccagctactcagaaggctaaagtggggggactgcttgagcacagaaaggtcgaggctgcagtaagctatgattatgccattgcattccaacctaggcaacagagcaagactcttattta

SEQ ID NO: 522825 - DNA, 693 bp, Homo sapiens
aaaccaaacgttggttttttattttttttcccacattgttttatcctcttttccaaacatggactttggggggttttcacctattgggcacttgtgaaaacccggctttaaacatgaaggaggaatagctgtgttcccccttcattctttcgaatatattccggaagtacaatccaatttcgcacgagggtaatccttacaagctcaaagtttctccatatcagacatccgttgtacttttcgactagtgaccaaagtgcgcatcctcaccaacatgtggtttagacagtaacctctctaagtgactgtacggtgcagtctcattgttattgtgatctgcattacctaaggattagcctcggagaacgtgttttcatatggttgctggccatgggtcgatcatctctggaaagatatctgttcgaaggtccagggcgcgtgctcctccgggcacctggtccggggttaggtgtagagatcatgtattctggaatatgcggtgcccagtaaagctgtgcgcccccttgtccgtcctgaggtggacgtttgtggggaacatcgcgtgatcacttctgtttaaaacctgatctcggtatgggtttcgtacacaacataagcaggttccccgcaccgattaaaggaaagacagcccggcaacaaaggtttgttcttctttaccaactagcatagtat

SEQ ID NO: 522826 - DNA, 300 bp, Homo sapiens
taaaattttttttttgttgagacggattttttatgttgcccaggctggtttcaggctcctgggctcaaatggtcctcctgcctcagcttccaaaggcacaggccaagttgtagctttgtcccttgccatcatgcccaacaaaaggttttatcccttttaatgaattgactttcaaaaattggttatgttggtgggcaagttttttaagctggaaattgtaaattccccctgaaatgttttttcatccagttcccatgaactaatactccaataaaggatggttttgggggtcaattttta

SEQ ID NO: 522827 - DNA, 619 bp, Homo sapiens
  misc_feature (49)..(49): n is a, c, g, or t
  misc_feature (74)..(74): n is a, c, g, or t
  misc_feature (172)..(172): n is a, c, g, or t
  misc_feature (216)..(216): n is a, c, g, or t
  misc_feature (220)..(220): n is a, c, g, or t
  misc_feature (261)..(262): n is a, c, g, or t
  misc_feature (265)..(265): n is a, c, g, or t
  misc_feature (273)..(273): n is a, c, g, or t
  misc_feature (282)..(282): n is a, c, g, or t
  misc_feature (287)..(287): n is a, c, g, or t
  misc_feature (291)..(291): n is a, c, g, or t
  misc_feature (305)..(305): n is a, c, g, or t
  misc_feature (317)..(318): n is a, c, g, or t
  misc_feature (334)..(334): n is a, c, g, or t
  misc_feature (344)..(345): n is a, c, g, or t
  misc_feature (381)..(381): n is a, c, g, or t
  misc_feature (395)..(395): n is a, c, g, or t
  misc_feature (410)..(410): n is a, c, g, or t
  misc_feature (421)..(421): n is a, c, g, or t
  misc_feature (433)..(433): n is a, c, g, or t
  misc_feature (457)..(457): n is a, c, g, or t
  misc_feature (473)..(473): n is a, c, g, or t
  misc_feature (480)..(480): n is a, c, g, or t
  misc_feature (486)..(486): n is a, c, g, or t
  misc_feature (493)..(493): n is a, c, g, or t
  misc_feature (498)..(498): n is a, c, g, or t
  misc_feature (537)..(537): n is a, c, g, or t
  misc_feature (541)..(541): n is a, c, g, or t
  misc_feature (616)..(616): n is a, c, g, or t
caccttgaccatttttcactttttggaaatgaaaggcacttcccacttnctctttgaaggcaattccattctcnccaaggtccttatttccttcccatattctctcacactcccaaacttctgaagaagcggagcaaacattgtgcgccgagcgaggacaggagtgcgagcngcctctgtacttgtcactgcacctagcactgttgaatccacccntccngggtcacgccgcggtgctgggcggtcacagcctaggacccnntanagccgcancctccatgngaacnggantcaggtctggtgcngtgtcctcagtnnagtggcacacttgcancagaacctcnnggggctcggtagaggcaccaagggtcacgaagcaantctacccaaagatnctggggcgaccaacnaaccccacaangaagagaacaanaaatggctgtgcccaaccagcacnggcagctgacccaacncaacccngtccancccctcnacctnagcaaacactttcagcggccctcgagaaatggtaggatnggcnatgtgcagagcctagtggcacagcagcccacggaggcacgcaccgcgcctcaggccgcgcgtggccttggcaggnccc

SEQ ID NO: 522828 - DNA, 606 bp, Homo sapiens
  misc_feature (195)..(195): n is a, c, g, or t
tctctgatcgctcagtgattctcagttactcttctgattctctgattcgaaagtgctactgaagagaaatcacaagaatacgaaaaaagaaacatcggaaaaattcccgaaaacacaagaaagaaaagaaaaagcgaaagaaaagcaagaagagtgcatctagtgagagtgaagctgaaaatcttgaagcacaancccagtctactgtccgtccagaagagatctctcctatatctgaaaatagattcctaatgagaaaaagtcctcctaaagctgatgagaaggaaaaggaaaaacagagagagagaaagggaaagagagtgtaatccacctaactcccagcctgctttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcagggggataagagtgagttgaatgaaataacagaaaatcagagacgtccagttcgagtaacagagagc

SEQ ID NO: 522829 - DNA, 466 bp, Homo sapiens
agactgtagtgtgcaggagtacagtaggtcatcgctaagtatgttccagtaggaatctgtactcgacaactgcgcttctcatagataggacggggaattacaaaaacattccagatgagatagtaaatagttctggctaagctgtcatataggattttgcaatgggggaatgttgtacttagtacgcatttcaaaattacatgtgcttgatctattaaatgtgataactcaggaaccgggaagagcagaatttggtggcttatcctcatgatggaaaaatcttttacggcacctcacaagatatccctcctgaaaatgaactgcttattgatcatagccgagattatgctcaacagataggtgttcctgaacagccagatgtgcatctctgtaactgtggcaaggagtgcaattcttacacagagttcaaagcccatctgaccaggcacatccataagcatcttcc

SEQ ID NO: 522830 - DNA, 165 bp, Homo sapiens
cttcagagcgcctctgacacatcatcttcttcatcttcatcttcatcatcatcttcttcctcttctttctcaagtactcgctcttctccacctctcttgctgcgagacgggcggcgctggcggccggcggcggtccgggcctgtccccgcggggtcgagaagcgc

SEQ ID NO: 522831 - DNA, 206 bp, Homo sapiens
gattaaaaaccgaaggacactagaatgaggacaagctggagaagctggaggagctgacaatggatggggccaaggttaaaggctatactaggatgccacacggtcctccatgggcatggacatatctagccatagacttgataaacatacgagagctaactccagtacgtagtggagactatatctataaatacccggggtaccgg

SEQ ID NO: 522832 - DNA, 1108 bp, Homo sapiens
gagtgaacgacacagagcaggtccgtcgttccatctcctagaaatgagcatccaagcgttcaaacccgcgtcagcaatgtaaactgtcgcgaagctaaggcaagggcgaaagagtatggcttcttcctgcagcaattgcggaaggcacaccgagggtccactggtccgggtggttggagcaagtgtaagtccatagcaggagcaaggcttggcctttgcgaagtcatggcagacaagcagttacattcagagcatcaatgggttggtcttttgtggggacaaaggcaagcaacataatgccaggttatgtggatctggggtccagcaacagcagtggggaacttccagtggaactttgagctagattctgaggatggggggattcctattgagacgacgcagtggacaaagcaacggggtgggactttgacaaggacgtaggggatcaaaaggttcaggaacacggaagcacacgggtatctcggacggctgaccataacgttactgacactatttagccacgctgtgttgtacattgtccacattcgcaccaatgactgtgttgcgccaaaaaagcgttatggggaacaccacaagagaccccccggggacattagttagagtagaatgtcacatcggcctggaaccggcgacacgaggaagggacacggcttctaatggaggcgtttcagtagatttgattgaaaacaacaacagtggtaaccgaaaggggttaaaaacaaaagggagggaggcatagtgtatagcaactcggaaaactgtggacatgactgttttgtaagaagatgaattatcaatagggtatatgcgcagcggccacacaccaattagcaacaacaggcacgcgtcggcgcaagcttcaagcctggggggcgatgcgcacaggaggaaacgccccaccctttgcggcacggtggggcaccagcgctgagcaccactggcggcacggcaggacacaacggggtcacagcaagagggacacacttgggccacacgaggcgagacacaatgtgcaagagcgcagacacgaggaggcgggaggcagggcagacacaccaacagggcggatgagcacacagcgaacaca

SEQ ID NO: 522833 - DNA, 580 bp, Homo sapiens
gaaactgttagcattttatagtaactaaccaagttgtttgtcatttgttgataaaaatcaataacaagaggtaataactgtgtagttagagtacatgtgttttccatatgataatacagtcactgactgtcagccagggtgtaaaaacattaaaaaattagcccagtggccaggcgcggtggctcacacctgtaatcccaacactttgggagtccaaagccggcaaaatcacgagatcaggagctcgagaccagcctggtcaacatggtgaaaccctgtctctactaaaaacacaaaaattagctgcgtgtggtggcgtgcacctgtagtcccagctactcgggaggctgaggcgagagaatcacttgaacccaggaggtggaggttgcagtgagccgagatcacaccactgcactctagcctgggagacagagcagactccgtctcaaaataaataaataaataaacaaacaaacaaataaaaataaataaaataaaaaataggctgggcacagtggctcatgcctgtaattccagaactttgggaggcagcagcatgagaatcatttgaggtaaggag

SEQ ID NO: 522834 - DNA, 184 bp, Homo sapiens
tctagaggatcaccatggaagatgtgctgggatactgagtctctgtctcctaaatttgaatttaattatgcaggcagactataccagttggtactataaattaaagctgaagaaaaagcaccatgaagcagagttgggttcatggcaaggcacatgaaatgcacattcttccaattggagatgt

SEQ ID NO: 522835 - DNA, 384 bp, Homo sapiens
gtgtccacactcaggaaagagcgtatacggggcgtcgttaatacttgaggaacagagctactcagcggccgatcgcttatacacgtggggaaagagctataccgggccggcgttttgatggagggagaaagtatacttgcgagctacggatcagcccgcggttcatggtcagcttgccgcaggctgacctcaggcggagtctgtactcagagggaggagcagtagccgggtgggactggggcgtttacatctcgagtcaggtcaggcagagtctggtccagcatcctttgtgtacagaggtgctcctctatgaatgcattacagtttatcttccaggtcatcaattgtctttaccagcttggctaccgatctctcagcaaactc

SEQ ID NO: 522836 - DNA, 118 bp, Homo sapiens
cgtcagcccagggtgggcacctagatgtctcatgcagaaagcctcaggatctcagtcgaagttttattaacaacccgcacagcctacccgtcttccaccgcctacccgtcttccacag

SEQ ID NO: 522837 - DNA, 337 bp, Homo sapiens
aagagatggccactgagctgtacttttctattagttataaagcctttagagcatcagtgcagtctgggttatcagagcatttttctcaaatgctgtcaactattttactagtcatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttgga

SEQ ID NO: 522838 - DNA, 460 bp, Homo sapiens
  misc_feature (94)..(94): n is a, c, g, or t
  misc_feature (110)..(110): n is a, c, g, or t
  misc_feature (114)..(114): n is a, c, g, or t
agtgcatggtggtgtgagagaagtgctagagtcaggagagagggctccctttcatttacacctggacacttggcttcctctgtggggaatcccngtgctagaatgttccngccngggccttgttctaatgacccactttcataggatcatggccgggacgcctctccccgccacaccctgacatacccttattagggctgcttagttccttctgctccagacgttacttcctgttaaattcggatatgcctacccgaggagaacacaccgagcctcatccatccttatgctgagttttttccttgggatgatttgttcccgccctccagtaccgagcctggcaccgagaagcacttgctgaaccagatagagacccatcccactccctctgtaaatatgggcgccaatgccccctatgtgtcaagccctgtgctcgtgccgggatcctctacgttcagcc

SEQ ID NO: 522839 - DNA, 212 bp, Homo sapiens
ctcttgtagagatgaggtcgccaagaatacgaggaagtgatctgtcccagccagcgggttgaagtcctgtgccccaagtccagtgatcctactccacctcattggcgaccttcttcacttgccaagagtttgttattcggaatcagtccgcagccactctcgctggatctcatacacactttttctgagacactcatcttttcagtgttcct

SEQ ID NO: 522840 - DNA, 242 bp, Homo sapiens
cacaaagaggcacattgaacatgggaagggcaggcgcgatggctcatgctgtaatcctagcattttgggaagctgaggcaggcaggttattgagcccaggagtttgagaccagcctgggcaacacggcaagaccgtctacaaaaacatacaaaaatttacttggtgtggtggtgcgcatttgtagtcccagctactcaggaggctgaggtgggaagtcagggttttgggggaaattccctac

SEQ ID NO: 522841 - DNA, 132 bp, Homo sapiens
  misc_feature (98)..(98): n is a, c, g, or t
ctccccacccatctgagagacttcatctggctgcagcacagtgaagactgtgtgtgtccctggacgggcgcctggctggggggtggctcccagtgcgnacctcttcggtggagtaagcgaggttctcgttga

SEQ ID NO: 522842 - DNA, 115 bp, Homo sapiens
tggactcgacgtttgctggaactggaacggtttggcatggcactgtacgtttggatagtaactgcaacgtttggctctggaactgcaccgttcggcaggacactcgtaacatacg

SEQ ID NO: 522843 - DNA, 308 bp, Homo sapiens
ttcggccggggtgctagaagccagctgggctctgatctgaggcacctgcaccctggagagacggagcaagacctcggggcctttgcacagccttccaaaccgagcacccacaagatgaatggatctttcatttctaatatttatcccctctcattgctgggtatatacccaaaggattataaatcatgctgctataaagacacatgcacatgtatgtttattgcagcactattcacaatagcaaagacttggaaccaacccaaatatccatcagtgatagactggattaagaaaatgtggcgcgtata

SEQ ID NO: 522844 - DNA, 382 bp, Homo sapiens
  misc_feature (342)..(343): n is a, c, g, or t
  misc_feature (358)..(358): n is a, c, g, or t
  misc_feature (365)..(365): n is a, c, g, or t
  misc_feature (373)..(373): n is a, c, g, or t
ggccaccggcaagcccccccagtacattgcggtgcaagtggtcccggaccagctcatggcctttggggggtccagcgaaccgtgggcgttttgcagcctgcacagcattggcaaaattggcggggggcagaaccgctcctacagcaaactgttgttcggcctgttggccgagggcctgcgcatcagcccggacagggtttacatcaactattacgacatgaacgcggccaatgtggggtggaacaactccccctttgcctaaaagccgcagggacccccgctgtttgggctggctccccccgggaaccccccgcccgctgtgttttaggcccgccccccccnnccttttggtgggganaaataancggtttanagactagga

SEQ ID NO: 522845 - DNA, 578 bp, Homo sapiens
  misc_feature (52)..(56): n is a, c, g, or t
  misc_feature (84)..(84): n is a, c, g, or t
  misc_feature (161)..(161): n is a, c, g, or t
  misc_feature (356)..(356): n is a, c, g, or t
gaattcggcacgaggcagggtacaaacaagaggtggagcagctacgtcgacnnnnngcgtggcttcagatgaggctggacatcngtcactgctgtgcccctccagcagagccccccatggactatgaggatgattttacatgtttgaaggagtcagatggnaggatactgaggattttggctctgatcacagtgaaggctgcctttcagaagcaagctgggaaactgttgataagaaagagactgaggtgactcgctgggttccagaccatatggcatcacacttgctataactgtgactgtgaattctgggtggcaaacgaagacaccattgcagaaattgtgggaatgtatttngtgctggatgctgccacctaagctgcccattcctgacagcaactctatgaccagttctcgtctgaactcatgttacgacaaattcaagtctttcgtgccagggacttatgaccacagtgagaacccattgtacagtcagttgatgcggggagaacctgccattttagaggtttgaggggacttttcagtttagttggaggtcttgtgtggtatgattaaaga

SEQ ID NO: 522846 - DNA, 259 bp, Homo sapiens
gcctttgagattcatccatggtgttgcatgtataatttctctctattgcaaagtggtattctgttgactggatataccttactttgtctatctgatcacccattggtggatatctggcttatcccagtatttaactattaagataaagctattatgagcatcttgagtaactgtcttcgtggacacacagtcatttctctctggtaactacctaggtgtgatattgctgagtcacatatatgtcagtgtatactctagg

SEQ ID NO: 522847 - DNA, 93 bp, Homo sapiens
ggaggaggcggcgtgcgtggagctgcctcctgccggcgggccgggccgggccgagcccggggcgctgcggtgacgcctggatcctgcctccgc

SEQ ID NO: 522848 - DNA, 104 bp, Homo sapiens
  misc_feature (15)..(15): n is a, c, g, or t
  misc_feature (45)..(45): n is a, c, g, or t
acacgaccgggggtntactacggtcaatgctctgaaatctgtggngcaaaccacagcatgcccatcgtcctagaaaattcccctaaaaatctttgaaatagggc

SEQ ID NO: 522849 - DNA, 192 bp, Homo sapiens
cctttttttctacttgtgttgaggtcagtagcattatgcgtaggtagaagtagaggttaagtgagggtgatggtggctatgatggtggggatgatgaggctattgttatgtgaattcttcgataatggccatttgtgccaaatgcctggttagcgggggcaggcctccatatggagaggcagtggtggcatg

SEQ ID NO: 522850 - DNA, 668 bp, Homo sapiens
  misc_feature (147)..(147): n is a, c, g, or t
  misc_feature (168)..(168): n is a, c, g, or t
  misc_feature (365)..(365): n is a, c, g, or t
  misc_feature (369)..(369): n is a, c, g, or t
ttgggtcagtgcatcctcatggtcacgccctgtatctctaggggctgccaacatcagtctagttccatgtctagaagcaaagaggggtgggggcagatcctgggaagcagcagcttggtcctgctatcagcagcctcaggcagtccnatttcctcaggcagtacaggnttaacccactcagatgagttggggaggctaccactagggttaggaaggcctcttccactgaagactcatcaggatttaggggttgtcttcactgttcatcagggtcaccccacacatcctcatcccaactgacaggatcccattccttcctaaccaatgccttcatttgcacagcagacaccgtgaggctgggagtnccanatgtgctataatccagccactggaagggcgagattctgggtttgattttcagtagtctcagacccgcagctaaaggaggtaagagtctctcttgggacagtcataactttcagattattcatgtgacacttcagctgggaatctgaatcctgagctcactcccatgatactttttctgagatggagtctcactctgtagcccaggctggaatgcagtggggcaatcccggctcactgcaacctctgcctcccaggtgcaagtaattctcctgcctcagcctcccagagagccggaaggg

SEQ ID NO: 522851 - DNA, 806 bp, Homo sapiens
ggcacgcgtgggtccggacgcgtgggtcgacccacgcgtccgctaaaagccaaaatgggaaaggaaaagactcatatcaacagttgtcgtcattgcgacacgctagcattcgtggcaagctccaccgactacatgcgcccatctgactctatagaactgcaggttggcgagtcgaccacatatagaacccattgaacaatagttgtgacgacaggacggctggctgacgcactgcggcaaagcggctccctatcaagagtagtgccctggagatacttgcgattaaaccttcgaaacaggcttagagcgccgttgaaccacgtgcgttactcaccccatttcgactaatcttcccattgttgcgaaaacttttgcgaacgaccaagccacacgttacctaactagttgacctagtccatatggaattagcccccaaggaaacatcaaagaccgactcttctctaagttccaacacaatcagttgcagttaacccacaggggcaacaacttctttcacgcgccatggacacttggtggccttgttcacataggactttgataatagcagttgctctgcgcattgctttagcggctaggacactctttcggaacacggcatagggctaactacgtccgcctaaaaggcagaatcgggcgccaagaaaccaccacgctaggcgacgcccaattggacccacattttacataggcgcgctataagcgagccaacccctagcgggccattgcttcgcaacacaccaacacgcctcagaactttcggcaccgacgactgactgacacaacca

SEQ ID NO: 522852 - DNA, 265 bp, Homo sapiens
gtatacatgatggttggtttgtctgtctatccatccatcccatccttatgaatgcatggcatctttggaagagtaaacaacaacaaaaaaatgatggctggttacctccagtgaaggggaactaaaagtctcagagctggatatacgagggaattttttttttttttttttttggagacggcttcctcgcttagtggcccaggcatgaagtgagactccgtcctaaaattaaaattttaaaattccacgagtatgagcggccgga

SEQ ID NO: 522853 - DNA, 432 bp, Homo sapiens
gctgggtgatctagaggatctccgccgttgtcagtgatggaacagtaggtgacctagaggtaggcctgatgacaggttgtgtggatgcataaagggtcttggaaagttaagacagcgtttgtagtcacagggccgtgtatgggcttttcattacttgtgtaatgggtgaggctggacatgtaggagcgtaaaagttgaactgcacgacctgtcagggtattttcggtcatttcattgatggagaagttggccaatgactgcatatgtaggagttagaaggggctttttccttcattacgagggtggtaggttaagctagtaactacccagtttttcgtgggaatgagagtggcaacgtaagtggtagctgatagagaaatgcaaagccagcgtccttcgccaaagaagggttggactggtctcaacagagag

SEQ ID NO: 522854 - DNA, 787 bp, Homo sapiens
  misc_feature (1)..(1): n is a, c, g, or t
  misc_feature (273)..(273): n is a, c, g, or t
nggtgttttatctggaaaattagtaagtccgttcctcacacgggtatatttttcctcgtcgcacatgtatctcctttcctcaaaatttcttctggggcgcaaaaaaacaggtggttctccagtgcgcgcctcacttgccacactgtttacatactccggggggggggtcgctcccctccccacatggtgttgtctcacacttctcgctcatacctgctgcgctcatacgcaattgctcactcccacacaccggtgtttctcggaaagtcaccnttctctcttcccaatgagagccccctctttttggtctggcgacaacacaggtgtctccctcttttttttgtacgacacaccaggatctcccctccactaggtgacgggccgggggactgccctagagtagcctcctcggagagacaccctctctagggcgagaggagagtcgtgcctacagacgtcaccacggtgttttatacccccgcacccctgcgggtgtccccccttggtgcgagggtcgccagcgctctctttctctctatagcactcctgcttccagcagagagtggctcccccacccggagatacatggggttttgttcgcctctcttagagggctgggggcccagttcccccggctgaggtttttggccctctattccccccccggcccgaaaaaaattttttataataaacccgcgggttttgaaaccccagggggaacgacccccacaccccctttccaaggggggttccccccccccccaaaaaagttgtttggggggggaga

SEQ ID NO: 522855 - DNA, 561 bp, Homo sapiens
  misc_feature (524)..(524): n is a, c, g, or t
tcgcgaacgtgtgatctatgttgggtagagacaagtagagccgagaacgaggggctgtttatgctaatgggctttatctttaaatagtctcagtcctcggtgggatcgcgtcacccctggggccagggccctctggccccactcaaacgttggtgtgtgtgtgtgtgtgtgtgttgatgttgttgcggggggagggtcgagatcgcctctcccctcaacctgtggcatagtcagcagacatcaacatgcccagctgtctttttcttttggcttcaaaataaacctcaagggtggacagtgaagaagcatcagagcgcaggactagtgcaggtcggggatggggtctgctggggactggccccggataaaatgtggaacaaattatcccaacacagccgggatcgctttgactttggggtcttggggcccaaggccctaagcgttggaaaggacactttgcctatgcagcagctttcccggcagaaagtgaattcaaatcgaagatgtttcaccacgcgggtttngcctaagtatgcattttttcacacctctctaaaaaac

SEQ ID NO: 522856 - DNA, 907 bp, Homo sapiens
agcggcgtggactagaatcctgcagggcatcgtggtgggggcgtcttgcgaggaacgggcggggtgtgacgcacgcctaggaggcctggcactgcagagtggcgtgggccttcctccactcctcccgttgccgctggtgggcctcgggatttatcgtggctggctagcgtctagactgggtacgcggggccgtcactcctcgcgtggaaccccggaaccttctctgcgagggactgtgggcccagcggccccggagggaagcgcgtcgctgcgcgcgcgtcatgtgtagccgaaggttcggaggccgcgggggaggcgagccttcgcggcagcgcctcggggttctcccgtgggtgcgtgcgggtgcgcgtcaagcattggcccttctcccgtgttgcgacgcctgtgtgctgccgttggcgagagcgttcgcaacagcctcatttggcgaggggcccgatagtagccaacgtgagggagggcgtgtgctgacgggacaggtaagccctggcagccacagggttggcgccgcatggggcaacatgggccgagccccgcgggcggccaaaaatgagcggtcccggccggagagcgtgcccgggccctgtggaccaggggcatggccggcctgtcggaagaacgaaacacctcggggggtccgggtcccctttgacgacaccagacggtccgcggcaagcaacatgggaaagggtgtcgcccctgcgcgagcgggcggacgggtatacctgaaggagggaaagccccccgacttggttaccagcattgcctaggcgtctggcaccgggttagcccagaaacaagcccgcggggacccactacaagggcgcaccgggggtggaagtgcacaggcgcgtggccggggcctgaataccaatgggccgacctt

SEQ ID NO: 522857 - DNA, 171 bp, Homo sapiens
gtaacagcgtgacacacagaagcaaatatgagactccagctgtatcttactaagcagaccttaaagcagatttgcaaatatctaaaataatgctatttctctcacttttttatggtattggaaacatcattttccatacaaggtcatttatgttaacaggtgacagattta

SEQ ID NO: 522858 - DNA, 782 bp, Homo sapiens
cgtgggctgtcgcgtggagtggtttctatcagatccatgcttcctgttcctgtggttggtgtgggatagatgagttcgggatcctacttgggttctgccgccaggccgcgggatagacagctctccagtggtagtcgcaagtgcgatgaaacaaggcccgaatgtcttaagaacttcatactggtcgagcagagcgatcggtgaccgtagagacattagagagggtgggctccatcccctcatgtggaaagccttgcatgatgttctagtatggctagttcgtatggcgcatgcctacagacaaggtagccaatgtcccgttcatgattgcatcccgattattccttgtagacccctgatgctggtgcataatgcactttaaatggtactcctcattgcagtgatgataatacacttacgaatggatgttggaagagagagttctggtagaatggagctatgatcttaggagaaatcctgagatgcggttcttggcaacccaggtaaaatgagttgttggaagaagggtcaaagggggtcagggagaggtcactgatattgagggaatctaagatgatatgcgtagagttgtcctatggggtcacgagtgtccggtatagggcaatgtaggtgatggcttattgatctgtgcctattacgtgttataatgggtgtggcttgggtgattgtgaggattggtcagaaggcgatggcacgtttctggcggtaaaaatacctaaggtgcctgtgtgtattggcatgagcgagagagtctggggtca

SEQ ID NO: 522859 - DNA, 393 bp, Homo sapiens
atgtccttgaagtttctttttttaaaaaaattatgagtacatggcatatatatttatagggtacatgacacattttgatagaggcatgcagtgtgtaataatcacatcagggtaagtgggatatccacctcaagcatttaatgattttcaaagattccaattatacctttagttatctttgtacaataaacttaactgtaattaccctgatgtgctatcaaatactagatcttattcgttttatctaactatatttttgtacccattaaccacttcccccagccccactaccctttccagcctctaatagccatcattctgctctctatctgcatgaatttgtttcaatttttagctcttacaaatgaatgagtatgcgtttgtctttcttgc

SEQ ID NO: 522860 - DNA, 196 bp, Homo sapiens
ccccctccatagtgtgtgcccaaatattaaattactaggtattagaatctttattaaaaacaacactgtagaatatttaacacggcgaattttttaacacggttggggagacagagtttccctctagatgcccagcctgtagggcagcgccacaacctgggctcacagcaacctcggcctcccaggttcatccaat

SEQ ID NO: 522861 - DNA, 145 bp, Homo sapiens
aaaaaaaacacacaccaacaaaaaaaaaaaagtaagtactaacgcatatacccatacaattgtggggggcggcaatggcccggtcggtttttatatttttgttccctgaaaacgacgagcgcaggagtagtgagcgaggaagcgg

SEQ ID NO: 522862 - DNA, 270 bp, Homo sapiens
atatctgtaggacattatgtaaattgaatcatacagtatgtattcttttgttcactggcttctttcactacgtatgtactcaaaatattcatccatatatgcagcatgtatcactagtttcgttcttttttatttggagtaatattctagtcacatggagtataaccgttgtgagcacattacgtgttcatcgatttgatgagacatttagggttatttctcactttttaggctcttatgaactcatgctcgctataacacagtcatggt

SEQ ID NO: 522863 - DNA, 151 bp, Homo sapiens
  misc_feature (29)..(29): n is a, c, g, or t
  misc_feature (55)..(55): n is a, c, g, or t
  misc_feature (125)..(125): n is a, c, g, or t
acttacagaattaaagatggcccatagcngaattccagaccaatatttcttctgnggtttattctatgttttatatattatctaaatatatgtatatgctgtgtcatactcataatcgtggaaantgaataaaagtgaatatattccgtgg

SEQ ID NO: 522864 - DNA, 501 bp, Homo sapiens
  misc_feature (2)..(2): n is a, c, g, or t
tnctcactaggtcgcacaggttgtcaaactcctagctacaagtgatccttccaccttggcttgtagtacccaagcgagttagaaaaacgccacactttgagacaaattaagagtcttttattagccggcgacctagagacggctaatgctcaaaattctctcggccccaaggaaggggcttgattaacttttataccttggtttaggaaggggagggggggtctagttaaaacaattttacggaagtaaagtagtcaaaaagttaaaaggacaaatggttacaggaaagtaaacagttccaggtgcaggggctttaagactattacaaggtgatagatccggggctttgggcgtttatcaatcggacgaattcctgggaactgcggatatagcttgccacagtatcttatcagttaattgcattcttggatgtgctaggagtcagcttgcacaagttaagtccttgaggaaggggctgccactgaaagagccaagatggag

SEQ ID NO: 522865 - DNA, 480 bp, Homo sapiens
  misc_feature (383)..(383): n is a, c, g, or t
ccaagatgccccaccttggataggccccgtagccccctgcgcgacctcaggggggggccaagggggctccccttttttttggcaagcaaaattggttggaatgggaggttgtgcaatgaggccaattaaaacctcatcttttaaaagccttcaaggaaaaaaaacccggcccctgcgcaggcagagggaaggttgccggttggccctaacctttttttttttttttttttaaaaaaaaaaaacctttaaaaaacccccccttaaaaaccaacctcttttgggttttaacaaaggaattttccaaatttgattgggttcttggtttaaaggttaggaaaattttcagcccaaaaagccccccggtttaaggccctctaaatttnaaggttggggaatgggggagggcaaggggtttttttttttttttttttaaagggggggggaacaaaaggaaataaaacaggggctgtggacctttta

SEQ ID NO: 522866 - DNA, 513 bp, Homo sapiens
ttgatggatcctggttgatacatggaagacgaactcagcagtctggctgatctccatcacagagtgtgttgcgtagaggcgccatttggagcctagagcaccggtggtccatcgatgtagatgggccgtcgaccctcattggcaatgaagaaatcaccgttgtacttcagcttgatgacaccttgtttccgggatatcttcgcgaggccggaccctccagagagaggtccacatcaatctggttctccttggttgctctgcccatgggttgatctcacgcgaagggcatcaggtaccgcaccatgcggccccgaggcactgccagtgtactggttgtcgaagtccggagaactcatgcctgtgatggctgtccactcagcactagcagttatgcagttcctgtgccagttgccgaatctctcgcttctggggccggtcagacaccatcagctcatgttccaggacctcatctcgcatgtccttaagcttattgtacatcaatcaggtcctctg

SEQ ID NO: 522867 - DNA, 258 bp, Homo sapiens
agccggtccggtgttcccttgtcttccttccttttttttttttaaaaagagacagggtggggccggggagccggtagctcatgactataatcccagcacttgggaaagctgagccggggggatcaccggaggtcgggagttggagtctgtaaggagcggtgatcgtaccacggcactaggtgacaagagcaagaccctatctcaaaataaaaattttttgggttcaaaaagtagggataccagacaaggggaaccacg

SEQ ID NO: 522868 - DNA, 921 bp, Homo sapiens
agcggggcactatggtcatggcggaggggacggcagtgctgaggcggaacaggccgggcaccaaggcgcagtatattccacacaacatacgagcagattgctccgagtatagagaaaatgatggagacgaaggtgaagagccgaaggagagaagggtgatgtggagaggtaggaatcaatcagaggaggagggagtgaagattgagagcataaaatggaagaatgaatgggaagaggataaggagggtagagatggaagggcggaagaaggagaagggagagggcgaggagtggaacggcggacgagagggacagacagagggggaggaagaggacagacagtggagggcaggggagcagctgaaaagaggagccgaagcaagagggagggggcgcgcgggagagagcggagccagaagacgcaagcagcacagaagaggcgcggggacgggggaggggcgcggcaagtgcgacaggaggagagcaacgatagagacagagcaagaaaccaagggggagcacacacgacggaaggggccaaagggcgagcaaagagagagaaaagtaagagaggagggagagcagggcagaccgcagcgggaaaacacaggcactaggcacgcgaagaggaaacaacacagggagaagcagaggacgagacgatagaccgtaatggagagcaaagcaggacgagccaggagacagagcgggagagagcagtagtggagaagaggggcagacggaggaggcagtagggcagtcggggagaagcggagtagaagcgagggggagaggaaagacaaaccggaggagagtggcgcgacagggcagaagaggcggggaggcggggaggggagaggcgagaagcaaaggaggggacagaggaggagaacaggagagagagacgaaggaggcaacgag

SEQ ID NO: 522869 - DNA, 917 bp, Homo sapiens
ggcggcaaccacgggcagctctcagggaatctccgtcggtgaggccgagaggctccagatccccgtcgagtccagatgccggtgtccagtcctgccaagacagatagatcacaggaagaagatggtaagcagagggtgatgtctgctgctgagagtgaattggggaggaggaaagagaggtgaggaggagtcggagtcgggaggtacatgacatgaagtaatgaaaatggagatgtgtccgaaagtggtaactgatgatggatatatgagccgatggcgcaggcatggtgaggtgtggtcagggatgtaagatgcttggagcgctggaagaaagcaagattctctggagtgcttagaggaagaacgtttgggttcaggggatacgacactgaagtcatgcatggtgcgtttgtggtggatggagggaaacgttgggggtgcatgaagaacgaagggcctccctgaagaatacctcctggaatgcccctctcttgcgagggtgtgcctggtcgagacggccgctggcacttcctcgttgaatttcccgacaagtgtacaacggagtgggcgggaggaattcttaactacgcagaggccgtctcatggctacgtgggatattgttggatacaaagggaacacctccagggagtagctcgaaagcgtagagtggatggacattgcttgggggcgaaaagaacatccctatgagcggcaagcccccattgggcaaccggaggcctttggaagaacagcggccgatggtttgagaatccgtcatggaggaccgacaggccgtaccatagaggggcggagaccccctagcgaaagagaacccagggaaatcgccaaaggagggggcaattgacacagagtaggggaaacctggtccaaggaaatcccgcgggaaaccgtaaaa

SEQ ID NO: 522870 - DNA, 103 bp, Homo sapiens
tgtatttgacaagagctgaagctgttcggcgagtatgggctcctggaacaaactgtgaggtctggagggtcaaatttaccctggccaatgatcctgcaaggcg

SEQ ID NO: 522871 - DNA, 371 bp, Homo sapiens
gtcttttcatgaacctgaaagtgaggccctcaccagacaccaaactggttgagcattgtcttcccattctctagaactataagaaataaatttctgttatttataagccacccagttttcagtatgttgttacagccgcccaaatgggctaagacagccactccactagggaagcctgagtgtggagccatcaaagccagcttggggaaatagattgctggcctttggcacccacatggctcatttttgcccagtgggggctaaaaatatctcctaaatgctgctgccctccctattggtttgggccatccttagtccatcccaatttaggccctgtatttccctctttcccccggttccctttggggaaa

SEQ ID NO: 522872 - DNA, 481 bp, Homo sapiens
cgaagcattttttacaaattgttgttcactgaaatgatgccaagcgataattgtggcttgtgccggttgcactgttggtagaaaaacagaagccgccgagaacagggcgcgattttacctgtgacttagagttcacttctcttcttctgttggcacgtggggataatttaagcagcgcaggtgtaaaactgagggattgccctgtcggattgacagaattttaaacgctccttggaaaaaaaggacgccgtattatcaggcgggccggacggatgcacttaaactgcaaaaatatcccttacaacacttagtaggtttgaaaacgcctggggctggtgcaagaggagctaaacctgtgcggtgcgattggggatatgtgtttcacttaaacaaagcgtaaaggtacatgcatggaacgcgaagcgattaaatggcatctctaagatatcatatgcgcaatcgactttcctaggtgttgaag

SEQ ID NO: 522873 - DNA, 114 bp, Homo sapiens
ggaaatctcctcgggagaagagctgcatccatggacaacaacagtaaatttgctaagagccgaagccgagctgccaagagggaaggatctctccagtcttggccagagggtgct

SEQ ID NO: 522874 - DNA, 501 bp, Homo sapiens
ttggggctcagtcaggtcttcacgaagatctggcatcccacctctgagagggagcaccaggtgcagcggggcctctttcggggatgtggtagtcggagagggatgcgtccatcttccagctgtttcccagcaaagatcaacctcggcgggtcaggagggatgccttcctgtgtctgggatcttggccttgacattctcaagggtgtcactcggctccacttcgagagtgagggtcttaccagtcagggttcttcacgaaagatctgcatcccacctctaagagggagcaccaggtgccgggtggccacttcctggatgtggtcgtcggagggggtgcgtccatcttccagctgtttcccagcaaagatcaagctctgctgggtcaggagggatgccttcctggtcttggatcttggccttgacattctcaagggtgtcactcggctccacttcgagagtgagggtcttaccagtcagggtcttcacgaagatctgcatccc

SEQ ID NO: 522875 - DNA, 211 bp, Homo sapiens
ggatccttagaggcacaaggaggggaacggctgagtatgttgcagatgagacaggctccccaccagctataaggaagaggtgcgcttgtgccttcctgggacctgcccctttcctgtgactctcctcctgcctgtctcagtcactcagactgtggacccttggtactggggagagagcccagcctttggcaccacgccaacctgtgcctgc

SEQ ID NO: 522876 - DNA, 122 bp, Homo sapiens
tccccgttatagaggaccacgtgttatcgatgcagtatattctcatcatgccatgtaagacatgctaatcaactacggcactctcttttcaggatgcatccaggaagctgctagtcatcatt

SEQ ID NO: 522877 - DNA, 414 bp, Homo sapiens
atacacataggaagggatctagagaacacgtcgccaggggcttgagaaggtaactagagtgagttattgggagtcttactaaaataaactagatattaggtccataccattaaatcagtgccagtgtctccttgaactgcgtcacaaactagaaggcttctctaccacagtagtagtgcccctatcactcataattgttctatagaggagaagggggtactactgtaaacatctagcctaaagtatacaactgcctgggggggcagggttaggaatctcttcactaccctgattctagagtcctggctctaccctgtctgtcccttttctttgaccagatcttctcttccctgaacgttgcttcttccctggacggcagcctccttgttgttacgaggcgtgatgacttgtgca

SEQ ID NO: 522878 - DNA, 422 bp, Homo sapiens
gggagggagagggggagaggaaggggaggaagagaggaagggaaaggaggggaaggagaggaagaggggagagggggaagaggggagagagagagggagaggaggagaagaggaggggagagaggggggagagagaaagggagggggggagggaagaggagaggggggaggggggaggaaggggagaggagaagggaggagaagaaggagaagaggaggggaggaaggaggggggaggggaggggaggagagagagagggagaaggggagaaggggggaaaggagagaggggaggaggaaaagggaggagagggggagaggagagagagagaggaagaagggaaaggggaggtgtagctatcgctctatatatatctatatatatatatatatatatctactatatctatactatatccgcg

SEQ ID NO: 522879 - DNA, 263 bp, Homo sapiens
ccgtattgaagcatgaccctcgctggagagcacaggacatcaggaagggaagaaacttgagtcatggatatgagggaggagggggccacagattagaagtttgaccttctggccgagcacggtggctcatgcctgtaatcccagcactttgggaggccaaggtgggcagatcacgaggtcatgagttcgagaccagcctgaccaacatggtgaaaccccatctctactacaaatacaaaaattagccaggcgtgtggcgcaca

SEQ ID NO: 522880 - DNA, 1171 bp, Homo sapiens
  misc_feature (476)..(476): n is a, c, g, or t
ggcaagacagtgcgcccgagctccgtcgatgtcgagggccacaccggagagctcgtgccacagttctcaccgcacgggtctgtgctcctggctggtgccttaagtagagcccaggtcatatcactcgtgaccattctttctcgtcttccactgtgggagtcagcgactccgcgcgccctcactgcagccactctgcgtcgtcgggggtcgtcgctcgcgaccggcgtgtcggttcctgcatcagagccaacgattgcctcagtctagcatcgagactgcggctactgaggagccctgtgcttaggagagtgcagacttaaattccaaaccatgatcgccgtgggctcatctggattaataaagaggagaatgatcttccagagtcccatggatagcagtgcatgccaaggcatggctgggacattcaactaagggatgccttgttggttccaggacgctgggccacttcacgacanggcctgatacaaagcaggggaaaaggagccgagatccctaagacgtggaaggccaactttcgactgtgccatgaactccctgccagatatcgaggaggtgaaagaccagagcaggaacaagggcagctcagctgtgcgagtgtaccggatgcttccacctctcagcaagaaccagagaaaagacagacagtcgaagtccagccgagatgctacagagcaaggcaagaggaagtcatgtgcggattccagccctgataccttctctgatggactcagcaggtccactcttgcctgatgaccacagcagcttacacaagttccaggctacattgcaggacttgggaggttggagcaggcctgaatccagcacttgtcggcaatgttcctcgtccagcagccctccttcccgaatggacaatcccaagtggcaagttggtgccggaacagcacccgcgtgatcctgcgtcaaccttcccgggtgcaccccagtgggcgtccaaacttggtgaggttacacggaattagtgactgacgagcgcgggaaatacctgcgggcactctgtaagtcttgtgccactgggatgtgaccacaaaacgtggtcgagggagtacacagtaacggaagaaaccaggtatagaatgacttagggaggccaatacccaggcgtgatagactcaggcgtcactacaacact

SEQ ID NO: 522881 - DNA, 133 bp, Homo sapiens
tggggtaacataaacaatggcacgtgttcagagggatcacatagacacttatccaggattaagatctaaataggctgtaagattatcttgttacagtcatgaacaatgtatggcagagatcactatctcgcaa

SEQ ID NO: 522882 - DNA, 234 bp, Homo sapiens
cagtggtcttgagcgttggaggtggctatcagtacccagcagtggcagagccattggcgggtggcctcagctactataggaggcggcagtaccaccatcaagtacaccaccacctcctcctccagcaggaagagctaataagcactaaagtgcgtctgatagctctcggtcccacagtcctcaggcccctctctggctgcagagccctctcctcatgttgccatacggagaaca

SEQ ID NO: 522883 - DNA, 1169 bp, Homo sapiens
aaagccagtgctggctcctggtcctgggaatttatgggcatcgcgggcgtgcgtgttgcctggtgtccctggcctgtgctgactccgcttcttggggccgtgcctgggcctccgcgagtacctgggtgtcgatcttcggatgtctgcgatgcccacgccatgggtgtgcccgcttcccacccctctccccgagcggcgtccccgtcggggtcgaaccttcctccctgcgacatgtgctgcccatgcctgcccttgttcccccatgtgccttttgcctgctggacctgcctctgtgtgaatctgtgctgtcttgtgtgatgcccctgatgtgtgtgcttggctgtgtgactctgtgtgtgcccctggggccattgctgtgcatgcctgctcccctgctcctctcctgcggaacacagtccccctgtggcccacaatgcagcggtatggcctggcaatgcctgtgccgttttctttgctcactcggcttgccagcccgggtcttgacccacctggaaccctgtgcagccctgtgaaccccctcgtcaggcttgccccttgtcggtgacctctgtcagccctgaatttgcccttgcgcccccgtgggactcaatgatccctggtcccaattggcctcgtttctcaaactgtgccttgcgagtggaaaatttccttgctcagagggtccactttccatgaacgcctctggtgcacccccgtgtgagtacacgggccttgctgtaatgtcgtacatgtcgatctgcctttccctagagtgggatccacgcggtttacacagtggggccgtcgtctccttggccttggtgactcacctatgcacagatactgccggggaggggttccgcaaccgaaggaccccaggataacttgagcgtccacctagtgtgggcgcttcctcgctgcatgagtaaaggcgactactcgaggtcaggcagattatgcccacttaggcggatgagcgacagctctttccagttggtgcatcacatacgaggcgccgcagccaaataggtaccaggagaccagcgaatcagtagaagacgccgcgtagagtaccataaggttaaccgctcaggtaagggcatactcggttcaagtgcccataaagttcagcgcgacacacaacatggagtagttggagtcaccaacca

SEQ ID NO: 522884 - DNA, 853 bp, Homo sapiens
cccacgcgatcggactgcgaggccttctgccaccgcaactgcagcgccgcgccgcagtcccgagcccgccgccggtctcgccacggtatcccgagctgcgcctcttcgggggcctgctagcgcctgcgacgcagctgcctcgaagcggcttgcgaagcagtggcctggccagccttccgccagtcccagcgccgagcgcgcggaggtgctggcgggacttacgcagtgccgctgagccctacaagttcctagtcagttcggcttacttcatggcaaataatctccccaaagcctatcgccgcttgcttcacgaccgtttctacgtgaagcatccttgattgatgaagatgatgaagaggaactatggcgatatttatgaggagcctgcctggtgccgaggactatcgagttaaacgacgcttggaatgccaacgtcgtatgaccagcctgttcgatcccgagccagtgcggggcaatacaagcggtgagaactggagaaacaatctcatcactagaccatggagctggcccttcccagacttcttcaaagcgcttttgacagagtgtcgtcgcgagcctgcgagggttccgggtagatcgaggacttccaggctttctacctttccatagcagatcatcatgtagaagttctggaatgcgaaatacagtgtgaacgagaatctcagcccagttataggaggctaatccggtggacgacatttggtggctactatgtatcattgacttgcagtaagccgtatgatcatgttgaacgacctgaacgaatgcagcccccttgtgcagtcagctatctgctctgtgatcagcaatgaccaaggtcctgcagtagaac

SEQ ID NO: 522885 - DNA, 146 bp, Homo sapiens
gagcaggatcttatacatgaccaagcatcatggtgctgtaagtcgagtgtatacaccactgcggtgcatgcctccctgtacaagtaccgtcgacacgtgagcacgtgctgactccaaatatcgtaagctggagctggtcgactcta

SEQ ID NO: 522886 - DNA, 478 bp, Homo sapiens
  misc_feature (364)..(364): n is a, c, g, or t
  misc_feature (430)..(430): n is a, c, g, or t
  misc_feature (456)..(456): n is a, c, g, or t
  misc_feature (472)..(472): n is a, c, g, or t
atcatattggaagaaacatgggatattaatacattggctgcatgtacagagggaagatgatgtgaagacacggagagaagatggccatctacatgctaaggagagaggcctggctggaacagatcctccctcatgatcatcagaaagaaccaatcttgatgacaccttgatctcagattttgagcctcaagaaccatccaggaggtacatgtacagctttgttacctgggtacattgtgtgatgctgaagtttgagtatgaatgatcctgtcactcagcccccacgtgaatcattcaagagttaaacaagagaaatggttcctgtcagtgcaggtgattgaaagagatcattacaacataactngaaggtcaagacaaggataaataccagcaaaatcattgtaagaatgatgctatcagggcttatgcntggcctactgatcccagaggagagantcatagagaatttgtngaattt

SEQ ID NO: 522887 - DNA, 306 bp, Homo sapiens
atctgatagtgagatcatagcatgtctactctctccctttatttttagtctaatgtcttccacttttttactgacttctgtggttttaactgaacattttatataattccatttctctcctttcttagcattagttttacttcttttattcgtgtttgttggaggttgccctagagtttgaaatatacatttacaagtccactttgaaataacactatactactttatggttagtgcaagtaccttataataataatttttaaatatcccaattcctctctctcatctcttttatcatcactatca

SEQ ID NO: 522888 - DNA, 153 bp, Homo sapiens
accgttgcatgtccagggctctgtttgtcacaaagtactaaattcaaccatatctccgtatttgaggagaagtagatccttccacatccttggcttgacaagcaatagtcagttccaccccacagattatcatttgttttgcaactccaacag

SEQ ID NO: 522889 - DNA, 675 bp, Homo sapiens
ggtggcaagtgtatggactgtggagtaagaagtacctgcctctgcctctgacttgggttctggcctataggaacaagacattttcagtaatggaagaagcttcttccagtaatggaagaaggggaagatcatcgtttccagtggtagctgactgagatgatacgacaccacttctgggaagccaaatagacagaagagagagaacatactaagtgctagccctaaagtgaacgaatgggcaaagccagctgaaataacaggaaaaatgaaaatgcacgatgtaatgtctgtgaggagagagcaggcagttcttcagggaggggtctgtcatcgaaatgtggctgtgggcttcacagaggagtggcgtttggaccagtctcagaaggtctgtacaaggaagtaagtggagaactacatcaactagtatcatagggtatcgaggcacaagcagatcgctcttcaagtggagcaaggagaacccccaggatagcagaaggagcagccacagtcaatctgtcaggtatcatccaggagaggacctacagatggagggaaatgcaggaaagtagaaaatcacacctcatgcagatctgctaccgcggacacagcgctcagaacacagagcatgaaacatcaggcttctccgcacctgtacagagggaccatagctggaca

SEQ ID NO: 522890 - DNA, 279 bp, Homo sapiens
aaactctagaatttcgagctgttcgtcccaccccacttcttccacccccacttcttccttcaccaacatgcaagtttcttcccttcccgtgccagccagattgaatgacagatggaaaaggcaggcgcggccttcgttgtcagtgctctttatttgaaaggggcagcacagtcttttaaacttgatccaccctcttgcatcttacaaagttaacagctaaaagaagtaaaataagaaggcaatgcttgtgcaatgtacagtgcatatgggctgcaccct

SEQ ID NO: 522891 - DNA, 352 bp, Homo sapiens
tcccgtctgacgggcccttgagcctttattggcgaggcagaagaagaatgttgtgcaataaaaagaaatattccgacccttcgtcgaataataaccgacggcaacaggcggtcattctcaccaagggattaaacctttcctctgtgcagggcacatcatagctggctttgccctataaaaggggcgaataaccatcccagcttatggctatagcatcgttatcgttacgtgcttatgacaaaacgatcattgaatacatgtgacctattggttagaactctacacaggttggcgccgtaacggtgccgacacatcggctcgccacgccggcagcgagcctaccaacggcaga

SEQ ID NO: 522892 - DNA, 281 bp, Homo sapiens
  misc_feature (31)..(31): n is a, c, g, or t
  misc_feature (258)..(258): n is a, c, g, or t
ggtgagactcagtgagtcaggagatcactanttttcttttagcgaatcaaacagacttccagaggcacaattctctgatttaacggaggtttaacgctatccctcccacagacttatagagcatgaaatgataaaattttgtgaagcgtaaacaaaacattccacctaaagccacaaaatcccacactctacctgataaaaattgccacgcaacttaattagcacggaaaaccgtttttcgccaacacgaacaaaatngcagcaatacatttgctataacc

SEQ ID NO: 522893 - DNA, 681 bp, Homo sapiens
  misc_feature (228)..(228): n is a, c, g, or t
ccgtgtggtggtgcgcgggtttgtggccccctgttaacttttttcgtgctgcgcactggagtgtctaaagaacactggtaattaagggggtgggcaagcaggtggtccgtatataagtggggtgcctgcttggtcttaaagacctctttctggcgggacaccccacagggtggtacacaactgtggcggagggggaaccaccacaacgtgggccactctatgtatgtncacacgcgtgcggacccccccagatgagccttctcttgttccaccaccgcgcagaaatgttttctgtgctacccctatcgcccatatgaaagaggggctacataaactacttgcaggttatattccatcgttcttcccactataagtatctcttttacctaccacccgcctattttacaagctataaagaaattgttttatccccacagcctcaccgctctataaaataagaccgtgcttcctagtacatccccactctatttttacgttccctcaagattttacacccctgttctcgcccttattttggaatcattaagaaaaataagaaccttttctatccccttataattatatcttatatataattattactaacagcttaacaaaatatcagctaataaataagaatattaaaacaaaaatatctctgtttatcaattatcagagcaa

SEQ ID NO: 522894 - DNA, 347 bp, Homo sapiens
cacgaggggccagctcggcctcgatgccgatgcgtgtctggaaggcgacgcctgcgccgcgcttggccatctgcagggccagctccaccgaactggtttccagcggcgccttgtgccgcgggcgagtgcgtgcgagcagcggcgccagcaggtgatggatggaaaggtcgctcttggccaggattagcgggtactcggcgcaggtggcgaagctgacgtcccggcgttcggccagtggatgccccggcgcgacgatggcgcccagacggaaatgaccgacgcccagctgctgcaggtcggcggtacgcggcagggcgaaggccagaccgatatccgcctggccgctg

SEQ ID NO: 522895 - DNA, 249 bp, Homo sapiens
tggagaaaccttgtctctacaaaaaaatacaaaattacacgggtgtggtggcacgtgccggtaatcccgagtggctgggactacaagtgcacgagattggcacttttaaattcgctgttgatggaagcgtcgcgcatatgcgcgacgcttccatcaatagggtccatgatccatgtggggttgtccgttaagatacttttttcccgagctggaggccaaggttgatgcattgatggaagcgtcgcgcat

SEQ ID NO: 522896 - DNA, 901 bp, Homo sapiens
catttcttaaaagaacaacagtcttgtcttcaagactcaagttgctttataaagttgctggatacaacgaaaatatacagttgtactgttatttctgactaattgagaaacctagtctttctaaggcatttttctcctcatcttaagcagttttgaaactacgtgttatttcttaaatgttataggatgtagctttacaattatattgtactatgtacaccgtgtaaaaaaggacaaatagaagttctttcctatattgatgtctgaggtctctattgatttatttaagaagtttggcgtatattagtattgaagaatgtccatgctcttaacttgaggatttgatgtctaatcataaatacacttgaagtttgccagagaactaaatagtaatagtttcatagaatgagaatctatttattcacttaaatattcatttctcaacgttgagtgagttcccacttctagttttaggcttccgacgcaaactggaagccttctaggtgctatcagagtttatgtatatcatcggctacatccgatgacattggctgagttatgtgctcctctggctgggtatacttgtgctttgggaagaaaaagagttgatagtcctataatgagatactggcacaggtgatgtcactcggaaattcagtaatgtctagtggtatggaatgatgataagtctttaagttattgtgctgatagttggttagatcaagtcaaattaattacgtagtaatgaatctacaggagtgggggaagcagcttatggtagttaaaggtaggtacattacagtaagttagagtaatttgcgataaaaagaggtaggttatttttttaaacaaagaaataaaaatggcatagggaaattgttttacaatttttcttttttga

SEQ ID NO: 522897 - DNA, 1176 bp, Homo sapiens
  misc_feature (1176)..(1176): n is a, c, g, or t
gttggtcaacgggccgtgcgacaagcgcttcgccacgtccgaagagctgctgagccacttgcggacccatacggcatttcccgggacagacaaactgctgtcgggctagcccagctcgtcgtctctggccagcgctgccggcggccgccatggcttgccacatgcacatccccacctcgggcgcaccgggcagccctgggacgctggcgctgtgcaggccccaccacgcgctgggactctagcagccggcttaccacgcccttactccaatgagcccagcgttcccacgcctggacgccccctgtgccggtgccctgacggtcgaccggaccggtacgtacgtccgccactatcgcctcgtcgtaacggacgacgagaactgactcgacgcgcctctggcgcgtggggtatcagtgagggcggccgggagggcgagcgagggacgacggacgggagagggggaggggaggagtccagggagaggcgggatcacgggccaggctggtgacacccgcgcgtggggaggcactcgggccacgaagggaaagaaatgtataccgaatctatctaagccgatagcagcgaccgggacccggttgggaacactccccgttgtccccacatttcaccgtcctgcagaccagaacttttatctctagtttgaggaagtatcatttgacttcttagtaggaagactgaatggaaggatccgaaggaattcaatcaggagagcggtccaaggaggtggccatgtgtgaccgggcaaagcggtttcctggcccaacgtttttgtgttccaggggggtagactgggcagcgccgaaaaaaggccgccaaagtcacaaggccggtactggagcccacacaaaaagtgtgtggtgaacaccccatagacaagacagagtgctctagacacccagttatgtgggggtttgcgcgtgaaaaaacaccaacgggagcaaagctgtgccgcaacaaacactcaccccaaaactgggggggggaaaccccccacacaactaaaaggggggacacatcatcttgggaccaccaaccaacacgtgcagccggctacgcgcgggcgcccccgccaaaaggaagacacacaagcagggcacgaacgacacgaaacaagagtcgtcgcaccccacacggaggccgagaacaaaaccaacn

SEQ ID NO: 522898 - DNA, 274 bp, Homo sapiens
tcctttgcgacgccgataaagcttcagctggaagagatcgctttcgacgcctccctgcgtgtcatcccacctgacctacggacccccccattgcaacgcatgctgcctggcttgcaggcacctctcaggaccctctctggaatccccgaaaagagcaagtcagacatactgtacctctttgactgctcacccaaccttgtgggccatttccctatttctctgtaacttactctcctagcatgatcgatgagctcaatgacgtggccagaaacga

SEQ ID NO: 522899 - DNA, 854 bp, Homo sapiens
aatgcatgtgtgcaaccctgtgcccagctgctcctgatgcgacctggcgcaatgtggttcgatgtgccacagacagcagtgaccccagagtgtgccttgctggtgatgtgtggcctgctgcctggtggcctggtgtgcccccctgactgatgtggaccagcaaaacctggcttagtgaggagatcgagaagaagtggcatggagctggagaagctgcccctgctgggagaataatgcgggtgcccctcactgccctgctcaacccaaagcctgctgggagagctgccgagggcccccaagtgaccggccacgaggcactgggagaaggagtgttcaggctcttcgtgggcccacgctggatgtgcgtggcgtctccaaggggagtgctcctcagagtgcactgagatcccaggaggattggcacatccccccgggtacatctcacaggaggcatgtcagctgcagcctggcagagatgagtcctcgcaccagcaggtgatggaggagctgagcggaccaagagcgggagctgagggcctgtgaggagaaggagtggtctggctgatgagaatggagcacggctcagcattgaggccatgagaggctatagggagagcttgagcgagagctggcaaacaggagttcagcaggccgggatggctcggaggccagtagattttggggctgaggaaagtggtgaacggggcatcggagtgctggattgggcctcggggtggagggagaccttgccgttatggccggatttgcaacgagcatcgctagatacgggttcggatagggggaagcagcgaaacggggaaaaaagtgggatgggattctatgtgcacctcctg

SEQ ID NO: 522900 - DNA, 289 bp, Homo sapiens
ggtatggagcagacatcttgggggaaatccatgcatggcgacttatacctttgcacccaaacataccatgagcgtaggaaagagatctagcaactctactgatgttagaattttttttttttttcgagacggagtttctctcttgttgcccaggctggagtgcaatggagtgatctcggttcactgcaacctccgcctcccgggttcaagcaattctcctgcctcaacctcctgagtagctgggattgtaggcatgcaccaccacacccagctaattttgtatttttag

SEQ ID NO: 522901 - DNA, 233 bp, Homo sapiens
gcaacgtgcgctgggcactggctcacatcggaaccagtgtcttcctggagatttggcgatggagatgtccacgcaggtggactctgtgacgtcaccgtatgccctgacatggtggccccagagcagactctatgaacaacctcgtttccataccacagaccacagccggagagtccaggccgacttgcgcactcagagcagaagggtaggagtcctctccacgcctctgtatt

SEQ ID NO: 522902 - DNA, 149 bp, Homo sapiens
tccagtgtgacgcttgcttgttgtaggtagaatcatagagcgatccccctacatttgcaggagaatctacttgaacttgataggtggaggatgcagtgagccgaggagtcacgctcattgcactccagtcttgggcagacagagccaga

SEQ ID NO: 522903 - DNA, 873 bp, Homo sapiens
gggggtgtggtgtgtgtgttattttttctttttccttctcttcacgttcttttattgtatttttggttttgttgttggagtagggttgtgtttgcgtgcgttctcttgggatgttttgtgtgttttctttctcctcctcttctctctgttgtggttggtattgttgttttttttctttttttcttactctcctcctcttcgcgctggttgtgggttgcgcaccgcctctctctctctgtatttatcttttttgttttctgtttttatttgattttttttgtctcctcgcgccccctcttggttttcttctttcttgtgtgttgtttgtgtcgtgtcctctctctatctcttgtttgttgtgctctctccctcgctctcctttttcttttgttttattatgttgcttgcttttctctctagatatatatttggtttgtgcttctatcctctccccgctcctcgttcttgtggtttggttgtgttgtcttgtttttttttcccgctctcgctcttctgtgttgttttgtatgttgtttgtttctctgtctctctctctctcatacgatgtgcgtagttgtgtgtgtgtgtattgagtttttgttttttctctcttgctcgtgtgctggattgatgatatatatttatttctctccccctcccctcgttgtgtgtttctctgtcgtcggttttctttttttcttttgccttcctcttctcgcttgtggtttctttacaatgaagtagcaggtggtttggttgtttttttttcgtcttcctcttatgtgttgcgctttttttttttttttttttgtttgttggtgtgcgtcgtcgcgggacccccccccccctccccccctcctgtgtgttgtgtta

SEQ ID NO: 522904 - DNA, 147 bp, Homo sapiens
aacgggtgatgcggttgtcgtgagggtatgtgtggttgtggggtctgcagagggggactgatttctgagcccgttgagtcaccaggtgcgagcatgccgtacttagtggaactgcgggaccagcgcatgcagcgtggcgaagggcca

SEQ ID NO: 522905 - DNA, 109 bp, Homo sapiens
gacggcaaaggatgtgctcgccgaatggcgagactgctgaccagacgcctgtctctgactggagccgcccgaggggaggccccttaatgttccacatggcctgtggaga

SEQ ID NO: 522906 - DNA, 360 bp, Homo sapiens
ggaacacccgttatgtgacctgacagtcagctctacattgtgatactacattcacagatgatccccaagtatccttggcattagaagctttggaccttttgtgccactgacttggggctgatctgtcacacactaaatacataatctgatgtcatggcgtctgtccatctctgaatatgcattggcatgaccagactgatgctatgagagaatatgttggacacatactgtcataccaggttccacttactgagttactgcacagctgactgtcttctatggtgactacatagaagattcttcaatggttttcgtatgcagtgctaaaccattaacaggggaaatagaggtggcgggcct

SEQ ID NO: 522907 - DNA, 264 bp, Homo sapiens
aagtgggatggtcagggcctgggcccttgccaccaaaatgggggctttctgggtaggggggtccctccctttactccctgaggtagggttagggagggtttttgcccccacccttgcaatgggaggtggaggggcagggtcagcctcctcattgtttaaatgaggccttaatgtgtgaagggcgatttttggttttgtggaccccccccccccctttccccaggtgcctttgggggtttgtgtcaataaaaagcccaaccctga

SEQ ID NO: 522908 - DNA, 450 bp, Homo sapiens
  misc_feature (377)..(377): n is a, c, g, or t
gctcactgcaaccttcacctcctggttcaagcgattctcctgcctcagcctcctgagtagctgggattacatgtgcctgccaccatgcctggctaattttgtatttttagtagagacgggatttctctatgttggttaggctgttctcgaactcctaacctcaggtgatctgcccgccttggcctcccaaagtgctggggattacaggggtgagccaccatgcccggccttaaatacttttttaaaattttaaaatgactcatttttattgaagttcagagtgataaacaaacgttccgttaggccctatgtcctgctgtgctctgctaggttaactgacttcttggaattctcttttcccttttccttgtaaaatngttaattattcaaaaattatatgatatgcttctgatgggacgaagatgggccatcagcactatcaacagtcac

SEQ ID NO: 522909 - DNA, 144 bp, Homo sapiens
aatttaatgacctctgataaccttataagtgctctcaacaaacatggtttaggtactgccctgatggcgagactggagattaactacgatatcttaaagtcctttcagactccagacacacaaaggagacgtggggtaggaggt

SEQ ID NO: 522910 - DNA, 300 bp, Homo sapiens
  misc_feature (160)..(160): n is a, c, g, or t
  misc_feature (227)..(227): n is a, c, g, or t
tttgcttggctctcattgttcctgagatgctgttagagtccctaggtgtcagcagcagtttttgcttttcatcattgggttctcataattgtatttacagcacaccttagaactcccatcaggtttagattggattttagatgcttctggtgagtgtaanggatatatacacactatcttccctgttggcttcttggaattctcttttcccttttccttgtaaaatngttaattattcaaaaattatatgatatgcttctgatgggacgaagatgggccatcagcactatcaacagtcac

SEQ ID NO: 522911 - DNA, 135 bp, Homo sapiens
gagatgggaaaaaggtggatcagtacaagggaaagcggggaattgggagtcactgaggggagtacgtagagtcgcagcatgcagcgacagagacctgaggccacggagaccgtaacgcccctcagaggccccggt

SEQ ID NO: 522912 - DNA, 246 bp, Homo sapiens
  misc_feature (246)..(246): n is a, c, g, or t
gacccactccaccttacgtaccagacaacctttagccaaaccatttaccaaataaagttataggccatagagattgaaacctggcgcaatagatatagtaccccaagggagagatgagaaattataaccgagcataatatagcaaggactaacccctatacactctcgcataatgacttaactagagatagacttttcacaggagagacccaagctgagacaccccgcgaccagaggagatattcn

SEQ ID NO: 522913 - DNA, 212 bp, Homo sapiens
aggcctcatcccctgcagagttcctgacactagtgatggtgaccaaggcaacatttcatcagaaaacacagtgctaggcttgtgaaagtgtctagtagggcttccactgccccgtataggctgcaggcagctgctttagttgagagatagagtgagctcctcaaagaattcctatttaagttacaaagcagcgactggatgccctgctgggt

SEQ ID NO: 522914 - DNA, 772 bp, Homo sapiens
  misc_feature (2)..(4): n is a, c, g, or t
  misc_feature (12)..(13): n is a, c, g, or t
  misc_feature (270)..(270): n is a, c, g, or t
cnnnggggcgtnngcagaccataaactacttatacaagtatgtaaaatagtaggattgaagctagtcagaaaacgtcgtagaagtcgcaaaccaccaacaccaaccctccagcggcacgatgcagaccaatcctaatacataccatctccaccgcttgtgtatgttatgatacaggtcaaactcgacttatgaaagtgataataaaatatttaatctatattaataatcgagcctggagcgcgcaaacagccccaccgccacacgctgcnaaatctctcaacatccagtgacctgtgtctctttcagaaggggacatactattcaattcatcaagctcttcacccgcatctcgcacgcggctcagaatctacaccgagagcacataccacagagagtcgctctcacacgcacgaaagtattgatctgcatgttaacctaataggatgcagcacataagctctcgctcgtgtgtatcgtgtgggcccgcgcgcgcagcgcggtcgaggcggctctcccgacgcgtcctctcctctacgcagtctacgcgcgagatagcgtcggcgcgtagtgttcgtggcgtccgtttgctgccgatcactgaagactccgctgtgttggcggtctgagcgggcggcacgggcagaagcccgatgagtcagacgcagagagaagcagaaagtcgcatctaaagtgcgcgcgggctgctatgctcgcggtggcggggcgcgtgtgcggaggtatgcgcgttcctatattatcttatgatggtcg

SEQ ID NO: 522915 - DNA, 871 bp, Homo sapiens
  misc_feature (13)..(13): n is a, c, g, or t
  misc_feature (254)..(254): n is a, c, g, or t
  misc_feature (295)..(295): n is a, c, g, or t
  misc_feature (302)..(302): n is a, c, g, or t
  misc_feature (313)..(313): n is a, c, g, or t
  misc_feature (360)..(360): n is a, c, g, or t
  misc_feature (376)..(376): n is a, c, g, or t
  misc_feature (382)..(382): n is a, c, g, or t
  misc_feature (385)..(385): n is a, c, g, or t
  misc_feature (401)..(401): n is a, c, g, or t
  misc_feature (411)..(411): n is a, c, g, or t
  misc_feature (420)..(420): n is a, c, g, or t
  misc_feature (428)..(428): n is a, c, g, or t
  misc_feature (437)..(437): n is a, c, g, or t
  misc_feature (501)..(501): n is a, c, g, or t
  misc_feature (529)..(529): n is a, c, g, or t
  misc_feature (541)..(541): n is a, c, g, or t
  misc_feature (612)..(612): n is a, c, g, or t
  misc_feature (635)..(635): n is a, c, g, or t
  misc_feature (704)..(704): n is a, c, g, or t
  misc_feature (710)..(710): n is a, c, g, or t
  misc_feature (743)..(743): n is a, c, g, or t
  misc_feature (797)..(797): n is a, c, g, or t
  misc_feature (840)..(840): n is a, c, g, or t
ttatatggtgatnagtaaacatacagtggtctgttatggcacttacttaaagttagatttgcgtaggttatatctgttgcatagccacagtataacttcacatgttcattaaaaaggcaatattgaccgctaaaacttcataagaaaaagtactaataaaaaaagttttaccccaaaattgcaaacaaatacattaaaagattagaagaggtgatagaaagcaccagatatttaacaaaataataaataataanataaattcaacttaaaaggtccccatttagcaaatactttnttaagtntggtctgtttnttaattgtgctatatcaaggactttttagcagataattgctcggttnttttatcttaggtttntttttnttnagtgaaggtataaaanttaccaaacntttagttanttttaaantggcacatnggttttaatgctattggtttttccttcctaacttttttattttttcccatggtctttgttgatnaactattttaaacgttttttactccatnctacttttaacntatttgtctttcagatatgtcatcagtcatgtctaacaggcaaatagcaaaataacagatttaaaactatncttaactagctagcaggacattnactttggattctgcataactgcaaactgacatatttgtaaagctaaaaatcagttttaatacatgattnacaganactctcatcatgctcattactttaactattgcnctttcaatcgctatagaaatatcacttaatccaataagcttgatttcaatagtncaggaagaaaaggtcaaaaaggcacaatgtgaccttagctganaagaattaccatcctgtctcaagtcttttgt

SEQ ID NO: 522916 - DNA, 137 bp, Homo sapiens
aaaaatagttcatcatcagagaatggtcagtttccattcccccatttgaaagattttaaaatggggttgaattttagtttaaagttagcagactacccaaatttggccccctgccaataaagtttcattggaaccca

SEQ ID NO: 522917 - DNA, 171 bp, Homo sapiens
tggctgcaccacacctgggctaattattagccaggggggggggtacatgccggttaggcccagctactcaggaggctgagccaagaaaatcatttgaacccaggaggtcgaggctgcaggtgagccatgattccaggccctacactccagccggggcaacagagggagacg

SEQ ID NO: 522918 - DNA, 1191 bp, Homo sapiens
  misc_feature (60)..(60): n is a, c, g, or t
  misc_feature (63)..(63): n is a, c, g, or t
  misc_feature (85)..(85): n is a, c, g, or t
  misc_feature (95)..(96): n is a, c, g, or t
  misc_feature (125)..(125): n is a, c, g, or t
  misc_feature (128)..(128): n is a, c, g, or t
  misc_feature (131)..(131): n is a, c, g, or t
ggtgcggacgactttgtctgtaggagcagcggcggcttgaggacccggggagaccctcangantcgacccatcaggacgccaganctgcttcagnnggtgaccaccttctccctctaacacattnttnccnttcttcacaaactggcccactgtcatgacgaatgtgctcaacggtgtgtgatgcctgcctgctccctggccgctgccccctgtgactcccagggctttgctctatcagtgggtgctgtgtgtgttgtgccgcgctgtgcgagtcgggctcctcgtgccttgtgtgggctctgtggccaatttccctgtggcccccatcgcaatcactccaatggcctatgcttgcagacttggcccatcacgcgcggtgcctcgtgcaagcagccaggagccctcgcgtccaggaacctgaatgtagctgacggacgaggcggtcagggtgcgcgtgcagggcagggccaactgatcgcgactgcgccctatccgagggcgcagccgggggacggcagcgtggcacgcagactcgaacgatgctgcctcctgagctggctgtcacagtcccatgcgccccacacgtgactgggagacgcgccgcagccagcgccgtgcacggaaccacgccatagagctgagcaggggggccccatggcagcctgcgtggcacgaccctgctgtgagcaaccatggcacaattgccggcacgcacttctgccacgctgtcatggccatgtcacctgcttgggtgggccgggatacctggcacggccgcgcgctgcgcggactgcgctgccgcgggactgccacatactcaatcgcgcgacgtggcagctcaggcaccgctgcgcacgccactccagggacgcaccgtgccggcgaccctgcggatgccctgccgttaagcctgactgccgcctgctggaccagacgaacccttgcgacaccggggcgccgcccacggccctcctcgcccaacacctggctcggggccgtacacccagtgctcgcgtgccttgcgtggagaacactccgaccgtgaacggccacccgcggccgcccacgggcccacacacacagacacgagcaccaggccaagacagactcctagcaccacctacgaccacaccctaaaccagccccgccacgcgccaagtacacccaatgacaagaccgcagaaccacac

SEQ ID NO: 522919 - DNA, 1103 bp, Homo sapiens
  misc_feature (60)..(60): n is a, c, g, or t
  misc_feature (63)..(63): n is a, c, g, or t
  misc_feature (85)..(85): n is a, c, g, or t
  misc_feature (95)..(96): n is a, c, g, or t
  misc_feature (125)..(125): n is a, c, g, or t
  misc_feature (128)..(128): n is a, c, g, or t
  misc_feature (131)..(131): n is a, c, g, or t
ggtgcggacgactttgtctgtaggagcagcggcggcttgaggacccggggagaccctcangantcgacccatcaggacgccaganctgcttcagnnggtgaccaccttctccctctaacacattnttnccnttcttcacaagatcggccgcaggtcagcacgagaggctcgaagggggagccggcctggccctggcgctgccgcccggcctcccagggtttgctcttcagggggccggtggcggcgggcggctggctggcatcctgcggcgtgggtggctctgggctaattgccctggcacccctagctgctagaccttcgcaagggctatgctagctaagagtgggccagtcgacctgctgggcatctggagaggtatgccaggacgcgctctcgtccagaaaactcgagtgaagtgatggatgaggctgtcatgtggtctggcaaggagggccgatagtacgggtcatgcctatcctggaggaccaaggcggggacggacggtaggacgcgggactcgaagtgatgctggccatccggatgttgcctggtcactaggcccaatgggcgccctcagctgctggagggaaggccggacgcagggcggtggcggaccgatgcagatgaagcgaagaggcggggccctgggatgcttgctgggtcggaccttgttgctgagacacagttgggacagattggcctgcagaatctgctggccaagcgtgtctgtgggcattgcatccctgcttggggtgggggccgggtatcctgggagggcgggggggcttggagggacttgcggtgtgcggggcgggtacaccctcatcgcgcacgtggcagtcagaggtcgttggccgccatccaggagcaagtgtgcttggtccctgggtggccctggggtaacgatggctggtgctggctggaaccgcgagggcctgggaagcacggggggcggcgtctagggccgcctacttcagccaatactccgtgacaagggcccgaaaagccaggaaggtcgggggttggtggcagtcggtcccactgggacggggtaaccaagggatacaaagggggccatggacaaacgggggcaaagccaacgc

SEQ ID NO: 522920 - DNA, 617 bp, Homo sapiens
  misc_feature (296)..(296): n is a, c, g, or t
gcactcattggtgtggaaaccccccaccaaaatgcgtcactgggctccatgaaccttgccaataagcaatattacgccatccctcggtccagagttttccaaggtccttggtattctggcaactccaggaggttcatcagggtggggtggggtgcaagaattccattataacaccaagcatctcggtcatctttagagcaccgttctctggtatctggtgtttgccatccggcattgtttcggtcatacgatccgaagaacaatccgatgtcaagagcaaggagccgagtttctcncatcagtgtaaacgacgatccatgagtgcacagccggctgtacctctgcaagtgttcattgagatgtggtatttgttggcttcattttggacaggcactcccagaaaatgagcgtttatcttgactcctgcctacagatcatgcagtccatgcttacgtagtcatcgacataaaagcagtatactgtgtagaatagaggacacactataaacagtgaacagtatgcgtcagtacatccgttcaggcattcacggaatgtaatattggtggattacatgtagcagcactgtaagcagaagccgcgatagagcggcagatacg

SEQ ID NO: 522921 - DNA, 937 bp, Homo sapiens
gaggagctggcacgagcaggagatcgctagggctagtactgacagatgaggagaaagagtctattggagaacgtaggggcttaactctgctctgaagacacgtcctctcatctaaagacaagaggaacaaattctggaacgtgtgcggaggcagatctcgaaatagaatagatctgctcaagagagccgcaggacaaagcaagggtgctatgttgggggctttacgagagcaagggtcttggaaatacacagcccagaatatggagcattcggagaacagagtacagcattcctggaggaacagaatttgtcccttctagatcaactgaggaaactccaggacacatggtgattgagagtaatcaagacgaaaaccagcagcagcagcacgctgcatcttggtcagtaactagtctccttctgcctcctccttgtacctgcatatgtactccatctgacacaagggggagccttgccagctgagcatggagtagttgtcccgccagcttcagtgccctcccctagtgaggacccttaccagactggagtctgcgttgccctgcgagtcagaattgcgcgaaaagacaggacacaccagtggttagacggctcaagactgtgtacatccaggcccctggcaacacttacgctgcgatgcctgcattacatagcctcaggctcccagtgacagagcctcccactggagtggccattccctgacctgcttctcagagcctctctgccgaggtcccatcctccgcctgcaggcaaatctcatcaaggaagggaggatggcttcctactggtagcccctctgtcatctttggacaggacagatactcaggctagatatgaggatatgtggggggtctcagcagggagccaggggggctccccattctgtgtccaaatataacgccgagggccaaggctagcc

SEQ ID NO: 522922 - DNA, 935 bp, Homo sapiens
  misc_feature (587)..(587): n is a, c, g, or t
  misc_feature (935)..(935): n is a, c, g, or t
tacacataaatatcatcgcaatcaggtgatcaagtacagacacaataggggccagtcccgtctaacggatcaaagagacaaccactttggcgaatcagtatcaaattacaatccaaggtccaaagtatcatgcttggataatcactgtgtgttctgaacgtatattgaacgatctaaagtgatatcagatttcgtttgttggagagttgagtccgttgctaaggagtctgagattagaagtttaatgagtggacttgagcccctaatggcattcgttgtatgttggaagaattgtttagcaacgagtgaaagagtgtgtagtttctggtatatggttacgcgataagtttgatgtatgtagtgtccagatctcatgtagaaatttaatatttattaataactgaaactgttggtcttccgttggtatatagtctcgcatattatattatagcaggccaagataaaatttgacagctctttaagcccacatgcagcagtgggtcagataaccctgtggcagtgacacgggcaaattggcatttgaataaagccctgggaccacctcaacatgcgtagcctcttgtctntaaatgtactccccatggcagcatggaggaggccagactgtgggtcaattttgaactggccttacttgattttaaacagagactcagggaagtactaaccaaaagtttctgatttacttgggttctggagttggttacggacaagcttgtcaggaatataacgggagaggttaggatcacagatttaatatttcaccaaggattacttacattcgagtgatatcactttttccataatcagggtaggaaaaatgaaaataagggaaaaaggtggggttgaaaaaactgtgttgggggtatttttgttaaaaaaagggggcaatgggggaatacatgtaacaattaacn

SEQ ID NO: 522923 - DNA, 239 bp, Homo sapiens
tgtccgagagaaattaggattttaaacatacaagttgcatttagacattaatgtatggaagcttaaatacagtaaactagataatgtgtatcctaagtatgcattctctgtcagtctacactagagtggatcttgtcttagttcctcttaagtaaaagacaaaacatttacctcatctaaaaatgaaggtcaaacgaaagaggcaaaaataaatattgctaatttctctcggaccaatg

SEQ ID NO: 522924 - DNA, 340 bp, Homo sapiens
ctccgacccctcataatgtgtgcccaacaaaaagtggttattctgactggttatggagatgactgatcagactaaggcatcagatgccttcatcagctgttatttggcctgagatctatttaagataaccttttcttatattgtctactcagtattggccataatcgtatcattcaagattcagtgtgggctatttctttgataagcactgaatgcggtcgatcggagcggctcacgcctgcaatcccagcactttgggaggccgaggtgcgaggctcacaaggtcaggagatcgagaccatcactgctaacacgctgtagccctggctctactaaaaat

SEQ ID NO: 522925 - DNA, 344 bp, Homo sapiens
gggcaattttttttttttggggggggggccccatttttaacaaggccccaaaaaaataaaacaggttttaaacccacaaatttcggaaaaaaaaatataaaaacccaaggttttgcaaactgggttaattaaaaatccaaatttttgggctttaataaccaagttggttaaaagaattttgggccatgtaaaaaaaaaaaagaaggaaaaagttaaaaacccgggttcaaaatgtaaaaaataagccgggccttgtgggtaaattggaacagttaaataaaaaaaaacccccccttttaaaaaaataaaagggtcttaagtaaaaaaaacccgttaaaaatata

SEQ ID NO: 522926 - DNA, 102 bp, Homo sapiens
  misc_feature (60)..(60): n is a, c, g, or t
cacgcagacgcgccaaccgaagcgtcgaacgtatctacctcatatggcgcctcctgctanatacgaacgacgagcgcagcgaagtagttagcgaggaagcgg

SEQ ID NO: 522927 - DNA, 806 bp, Homo sapiens
  misc_feature (42)..(42): n is a, c, g, or t
  misc_feature (62)..(62): n is a, c, g, or t
  misc_feature (111)..(111): n is a, c, g, or t
  misc_feature (114)..(114): n is a, c, g, or t
  misc_feature (133)..(133): n is a, c, g, or t
  misc_feature (136)..(137): n is a, c, g, or t
  misc_feature (139)..(139): n is a, c, g, or t
  misc_feature (148)..(149): n is a, c, g, or t
  misc_feature (158)..(158): n is a, c, g, or t
  misc_feature (164)..(164): n is a, c, g, or t
  misc_feature (175)..(175): n is a, c, g, or t
  misc_feature (189)..(189): n is a, c, g, or t
  misc_feature (201)..(201): n is a, c, g, or t
  misc_feature (228)..(228): n is a, c, g, or t
  misc_feature (232)..(232): n is a, c, g, or t
  misc_feature (243)..(243): n is a, c, g, or t
  misc_feature (252)..(252): n is a, c, g, or t
  misc_feature (259)..(259): n is a, c, g, or t
  misc_feature (271)..(272): n is a, c, g, or t
  misc_feature (278)..(279): n is a, c, g, or t
  misc_feature (287)..(287): n is a, c, g, or t
  misc_feature (298)..(298): n is a, c, g, or t
  misc_feature (316)..(316): n is a, c, g, or t
  misc_feature (334)..(334): n is a, c, g, or t
  misc_feature (537)..(537): n is a, c, g, or t
  misc_feature (796)..(796): n is a, c, g, or t
atcccgaaaatataaacacaaaccagtaaaaaacaaaaccgnaaaacgtcaggcctggagcngcaataagagaggaggagaggagcagctcacacgtggcctagggggggnggncgaggccataaatagtggnggnngncggcaaggnngccctaccncgaggngaaagcagggngtcggcagcgaganggctccgggggnttagacactgctgggttggggcccggnggcnacctgcctctnactccaggngcgagcngcttcatttggnnccctgnncctccgantcctcctcgtngtcttcgtacatctcgcnctcttcctcggccgtggngtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttcccgatgaaggtggaggacatcttgaggncgcggggcgggatgtcacacacggccaccttcacgttgttggggatccactccacgaagtagctgctgttcttgctctggatggccagcatctgctcgtccacctccttcatggacatgcggccccggaacacggtggccacgtcagtagcggccgtggcgcgggtcgcaggcggccatcatgttcttggcatcgaacatctgctgggtgagctcgggcacggtcagggcccggtactgctggctgccccgggctgtcnagggggcgac

SEQ ID NO: 522928 - DNA, 547 bp, Homo sapiens
tctgaagtagctttggaaagtagagaagaaaatccagtttgcttcttgggagaacactggacagctgaataaatgcagtatctaaatataaaagaggactgcaatgccatggctttctgtgctaaaatgaggagctccaagaagactgaggtgaacctggaggcccctgagccaggggtggaagtgatcttctatctgtcggacagggagcccctccggctgggcagtggagagtacacagcagaggaactgtgcatcagggctgcacaggcatgccgtatctctcctctttgtcacaacctctttgccctgtatgacgagaacaccaagctctggtatgctccaaatcgcaccatcaccgttgacgacaagatgtccctccggctccactaccggatgaggttctatttcaccaattggcatggaaccaacgacaatgagcagtcagtgtggcgtcattctccaaagaagatgaaaggaaaaagaggcgacgagaaagaaataagattgcagctgcaaagtgccgaaacaagaagaagaaacgcaa

SEQ ID NO: 522929 - DNA, 678 bp, Homo sapiens
  misc_feature (88)..(88): n is a, c, g, or t
  misc_feature (385)..(385): n is a, c, g, or t
  misc_feature (405)..(405): n is a, c, g, or t
  misc_feature (416)..(416): n is a, c, g, or t
  misc_feature (481)..(481): n is a, c, g, or t
  misc_feature (492)..(492): n is a, c, g, or t
  misc_feature (511)..(511): n is a, c, g, or t
  misc_feature (528)..(528): n is a, c, g, or t
  misc_feature (551)..(551): n is a, c, g, or t
  misc_feature (586)..(586): n is a, c, g, or t
  misc_feature (631)..(631): n is a, c, g, or t
  misc_feature (640)..(640): n is a, c, g, or t
  misc_feature (671)..(671): n is a, c, g, or t
caacaacactgggggcgtcgatcaggttcagcaggtcatcctcctcctggtgctgggcgtacgtgagccgggagcgttcctgtgcggnacacagcaccttctgtagcacctcaatgctccgcagcttcttgcagaggctcgcctcccgcaccgactcctcgtgatgagccatggctctgcgcaagtgggacttccccagctgtcggcgctgctgatcattcttcagtgtggccaagggtgtcagcccctctggcatgtggtcgtagagctgggacaggcacttctcctggtggtccagatccgtgcctggcttacctggtggtcgatgaggaggatggcaagtgaagtaatgggccagggccgcgtagtggtgggccttacgcangctaagctggccaagagtangggatgttctntttaccggcgcctggctcatggcttgcgtgtagctgttggtagacctctccacctgaaatagaanggacacttggnaaaggcaccccggcacaanggcccttatgaacccantttgcaaaagaaagaaccctttnttttttccattcaacaaccccttgccaagggctgnttccagaaatctgggaagcaacttccaaaaagaacccctccgttntttcatttncacaagttaacaaaggggggatcaaggctgnttggcat

SEQ ID NO: 522930 - DNA, 126 bp, Homo sapiens
ctccagcctggacagcagcacgagagcttgtctgttttttcaaaaaagaggaacactaacctttgatgtattgatactttaataaatttcctgtatctttttggaaattttgattgatgaaacata

SEQ ID NO: 522931 - DNA, 1109 bp, Homo sapiens
caggaggccgccattgtcggctactgcgacgccaaatacgtctgggcagccacggccgggggcgtctttcagcagcattacgccaactagaaatagactatgattgctacggaaaacgaccgggaaggtcttctttaccaaccggtctcgactcttggccgcgaagaaatgctcagtgtatcagagcatagctctataacgtcgcatggctgacctgcaccaactggacactccgggacacacagagctcacaggctgcggcgagccacacactaccacactgtggcatgctcgcgccacgacgccctggctagcacgcaactcgggctccctacgctcactgggcgcaacacgcgcaaccgatgctcccacagcgaacgcggccaccaaaccctctacacgcaccaggcaaacagccaactcactgcacacctccgccattctcactaaccctggcacgcggcaacgcgctccctgaattggttgctacaaggccaacggcaccattcttcccccccactacgtaaccccttcagcaaaaccatgggctccttttccagctccaccagcccaacctgccccttaacacctctcactggcggctacgcagccacacctggccattaaccccagcgcaccccttggggcatcagcaactgcggctaagccgcccttaaacctttctacactgccacatgtttagccccccatcaaacattatactatatcagccttaaacacattggggtctccccacttcggcaactcttcccacccctgtcggtatacactgtggaccccccccaacaccacattgggcggaccatatccccaacattttcattcttcgcgcttaccacttggggattattcaacaacacgcacgccacacaaccgatggggcataaatcgtagcggcataaacagcacgcacgccgcacaacacgccaccagccgccattatctaaacactacacactatggggcggcgacagcaaacaccgaacatttataaccagcagtttagtcagaggatcaccagcacgcagacacactcacgaccagcatgtcaccaacatccattatgtgggaacaacttcctatagcgg

SEQ ID NO: 522932 - DNA, 275 bp, Homo sapiens
gatctccgacgagttgtccgagttatggatatttatttaaatacaaggtattactctggtgccctgactggagttatatggtgattatggttccctaaagcatattttttgagggatcaggaattccttatacgtcagtcttccaagtaggtctgactgcaattagtgtgcaatcgaatctgactgattgtaaagtcctgactgacggcttcttattggttatgtttgtttctgaagatttggtagagaagaatttgactactttgcacaagctt

SEQ ID NO: 522933 - DNA, 124 bp, Homo sapiens
  misc_feature (100)..(100): n is a, c, g, or t
tatccctttcattgatctaatgtatcagtatctaaaacacctttcgctttctaaactcgtctagctcataattggtgttttgcctgtgctacgccaaccntgaggagttcgtacatacgaacag

SEQ ID NO: 522934 - DNA, 430 bp, Homo sapiens
  misc_feature (430)..(430): n is a, c, g, or t
gggctctgaaaacccggctccacacgtgtgatctttttactttacaatccttaatccagacttgctctgatgggtgtctggagggaccaacgaaagtgtggagacgctccaaggattaagtgatcggcgctggttaataaaaccttccaaacagataaaccccacccaccctaacaaatatgaggctgctggagagaatgaggaaagactggtttatggtcggaatagtgctggcgatcgctggagctaaactggagccgtccataggggtgaatgggggaccacttaagccactaactgtatcatacattgctgctgcaacaatattatataacagcggactatcattgataacagacgatctgaccaccgctttggtgcatctaaggctttttctttaccttttatcaattacacccattacctggtn

SEQ ID NO: 522935 - DNA, 166 bp, Homo sapiens
gacggtggaagcgcggtcgaccttctgggcgcggtgcggaaaatacagccacgaacgcggagcatgaacagtgagccgaggataaagccgagcagcggcgagatgaagatgaacgcgatggtcttcagcagcccgtcgatgttcagcgagctccagcccgacttgg

SEQ ID NO: 522936 - DNA, 180 bp, Homo sapiens
  misc_feature (7)..(7): n is a, c, g, or t
tttgggnagcttcttgatggaggggatggaaggagggtggtctcagctacagcagggagagctttctgtttttgagctaaagacataacagggtgcagagctgagaaaaggagagtctaagcaacatgtcacgagctatgtacctcttcacactgcttctgaaataaaactaacagtagg

SEQ ID NO: 522937 - DNA, 216 bp, Homo sapiens
catactatgtgagataatgttaataaaaaaagtactagactcgtgtggttcatatgtgctggatgtggttcttgtgatcgtgtggttcttgtgatggatgtggttcattgtgctcgtgtggtatcttgtgctggatgtggtatattgagatcgatgtggttcttgtgcatgggattggtgagctcacaccttgtaatcccaagcacttctgggagg

SEQ ID NO: 522938 - DNA, 417 bp, Homo sapiens
  misc_feature (32)..(32): n is a, c, g, or t
  misc_feature (45)..(45): n is a, c, g, or t
gcccccaatggaatcagcgataagtgcgcgtngggatctttcctngagctgggcttccggcagagaactggtgatgtactcaatgctggtgtacccggcggctttcagaacgtcgacagccgatgggtggacgccttccagaagaaggaacttgatcttgctcttatcgagagaagtcttgctcatctgcgtaagcctgtatcccggagaaaattggcagggagtcgagcagcgcaagctgacccggacggcaggaaagccgtcaccgcagaaacgccctttgggtctgtcctgcgggggcggtatgctagcatacgcaccccgctaaacacctattcctgcgacgtgaagcgttctcaggatgaccatgaattgttcgtgtgttctgtcgatgacccatcctgccctgattgatga

SEQ ID NO: 522939 - DNA, 933 bp, Homo sapiens
aggaagccagatcctgttcctctaaccagacagatcgtgggcagacacagtgaagggtggacaaaagctcgactgctgcgtctaccaagtacgatgtcttcagacaatttgctctggaagggtctggactaagtgttgaagacctgaagagataacactccttcaggtaaaaaagtgatcgatgatttggctgactctccagctccgagtaagagttgtgtctattccaataaaaccgtccgtgagcaataggtccctggggaggaggaaaagcagtggactttcagaacagcaccaaaagaaggactcgtgaccatcatgctgaagatcctataaaattctcacgcttccattaggtggctatgggagtgtttggcacaccggtaggactttgaagtatgcacatctctgtccagtatgtaacatgaaattggctgaatgatgggaggagaatcgtgtaacccagtgtgcattgtctggattaggcctcatcttgagtaatttacccaagcagatgtgaggtagtgcctcagcactcactacccatgtcatgacgagagtaaatgtgggaatccgcaccttacgagacacgaacccttcaaattctcctctcaagataatgagaaagcagtacgttccactttgggccagttcgttgagaaaacaatcagcccatggaacaatactacatctcgcaagagtacaacagaccatatttagtaaagttgaagattgctcttacgcaagagagacgcacgctttcccagcttctgtgccagtaattaagatggacacagattcctcagaccaagtgagcacaaaggaatgatgaaagatcagagagtataaagatttcccaacaaacaggagctgtctacggttgaacggggccaggagggcatgttgtccccaggccagcgtccatggtgcttc

SEQ ID NO: 522940 - DNA, 184 bp, Homo sapiens
gggactacacgcatggcatcttactagtgtgctttgctgaatgaatttaaaatatccattagaaaagcaggaacacacattcgagagctacgcgaatcttctgctgatcctgggagtaatattaaatatcctgtagtatgagaaacggcgctggatggtagacgccccagtaacagcgtacctt

SEQ ID NO: 522941 - DNA, 967 bp, Homo sapiens
ttaggctaggtacgaggctgggtgttgaatcggccgagggcgaataggaacagctctggtctacagctcccagcgtgagcgacgcagaagacgggtgatttctgcatttccatctgaggtaccgggttcatctcactagggagtgccagacagtgggcgcaggccagtgtgtgtgcacaccgtgcgcgagccgaagcagggcgaggcattgcctcacctgggaagcgcaaggggtcagggagttccctttctgagtcaaagaaaggggtgacggacgcacctggaaaatcgggtcactcccacccgaatatgcgcttttcagaccggcttaagaaacggcgcaccacgagactatatcccacacctggctcggagggtcctacgcccacggaatctcgctgattgctagcacagcagtctgagaccaaactgcaaggcagcaacgaggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgctcctcaagtgggttcctgaccccgtgaccccgagcagctaactgggaggcacccccagcagggcacactgacacctcacacagaggtattccaacagaactgcatctgggggtctggctgttgaggaaactacaaccagaaggaattaacggaaaccattgtttaccttattaaagaccaagtgtatacccaggtggggaaacggcggaaaatggacttaagggggacttttccagagggtccagagaaaggggggttgggcaag

SEQ ID NO: 522942 - DNA, 165 bp, Homo sapiens
tgaataataagaaacaacacgctcacacgttactggggttggcgctgttgggaggcttgatgaccacaggtaaatgtgcaggcgggcggcttctccacgccaacctacggtgcgcctggctgggggcgcgcgtttggtggcggttcattgttcaagaacgaccca

SEQ ID NO: 522943 - DNA, 365 bp, Homo sapiens
  misc_feature (77)..(77): n is a, c, g, or t
  misc_feature (173)..(174): n is a, c, g, or t
  misc_feature (192)..(193): n is a, c, g, or t
  misc_feature (211)..(211): n is a, c, g, or t
  misc_feature (332)..(332): n is a, c, g, or t
  misc_feature (346)..(346): n is a, c, g, or t
  misc_feature (359)..(359): n is a, c, g, or t
ccttagatattgcaaggcaccgaaatcaaacccctttgcccattgatcaagccatattccggtcctaggttgccacnccatagatactgcttaacacctccaaactataggctgacctctttacagaaaggcatccacttctgcgggaagaatcccagtcccgcggttaagtnntggttcagttactagcannccaagtactcccacactnggcacaccaaccccacagacccatgtctgtttcaactacagtagggactcccatgtccctcacaggtcaaaggtttacagtacagatgcctacttctcagtctccagctgtaaaagcttcnaatttcctggcaanctccagcagtttnagaatg

SEQ ID NO: 522944 - DNA, 545 bp, Homo sapiens
ggatatacataggaagctgtgttacacatggacaggggacatatgggaacatctcagtaccttccactcaatgttgtgtgtgaaactaagactgtgctaaaaaaatacagtctattaagacatgaataataatcacagagtagggccagaggcaatgtagatgccaaaataggccatgagttggtaactgttgaacctggaaagggataattgagagagttcactattctgttctctttacttttgtatgcttgacattttccataataaaacttaggtttaagtaggcaggaaagtttttacaaaagcagtgggacttactccattctacctacctacatgaaaccacccctccaatgctatgttcaagtacagactcacgcattcggagagaaagacacacagtgaagcgagtagagacaaggtgaccaaaacagtgagcagctggggccttgaagagtgagcaaaggagacgtgatggaagtacacagtcacagtctctaggactacctaaaggccatcctgtgggagaggaagggactgtc

SEQ ID NO: 522945 - DNA, 494 bp, Homo sapiens
  misc_feature (25)..(25): n is a, c, g, or t
  misc_feature (267)..(267): n is a, c, g, or t
tgcttggcttctttgcctgatgatntgcctcattcagaagcaggaatgagagtaaaaactgaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttctttgngacagtcttaagagaagtttccactaaaaatgtaaccagctttaatctggactccaaatttttcaattatgagatgtcatagccagtaatttcgctgtataccaagcatagccaaatgagggtccctgccttaagaagattccctttaaaaaccaaagtgttagctgctgttgtatgggccattcctatgttttagagttccagtaaacctttgatgataccctcca

SEQ ID NO: 522946 - DNA, 246 bp, Homo sapiens
  misc_feature (47)..(47): n is a, c, g, or t
  misc_feature (93)..(94): n is a, c, g, or t
  misc_feature (122)..(122): n is a, c, g, or t
atttttttccccaaatggggattttaggggtaaaaacccccgggctnctgggggaaatattttggcccttcccgggggccaaggataaaaccnncaggggcagtttccaattttggatggcncatttttgggttaaatatcccatggggccgatttttaaatttggaagaaccaaatttgtttaaaaaaaccccctggtctagttttggggccctgggggcttttggaataaaatccaggaagcca

SEQ ID NO: 522947 - DNA, 358 bp, Homo sapiens
gccagagccactatgaagtgggtaacctttatttccctactagggctctatagctaggattattcgaggggcgcgtgaccccgagatgcacacaggagagagggcgctcatcggtggaatcttcagcagtgtccatatgaagatcatgccatattcgagaatgaagtaactggctttgctaatacatgagatgatgatgagtcagctgaaacaggtgacacatcactacataccctatttggagacagattatgcacaggtgcctctataagagcctctggagaagtggctgactgatgagcataccatgaacctgcgagagatgtgctcattgccacacagataggacagcccatcg

SEQ ID NO: 522948 - DNA, 390 bp, Homo sapiens
tttgatacagagttccgctcttgttgcctagcctggagtgcaatggcgccatctcggctcactgcaatctccgcctcccgggttcaggtgattctcctgtctcagcttcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccagaactgagggaggctgaggtgggaggatcttctgagcctaggagttactggacaacatggcaagaccgtatctctaccccccacc

SEQ ID NO: 522949 - DNA, 1729 bp, Homo sapiens
  misc_feature (474)..(474): n is a, c, g, or t
agcgagtggtataggcgtgctgattgatggtgtctgttcagatacagcgatcgaatgcgtgggtctgcggagacaagctgttgttgacctcgtgggccgtataacgcaaccacatcaccgctgtcgcgccgcggaggacaccacgcgatttgaggcaacaatagtggtggtgtcacgtgccccgcgatgattgttgtcttgcgcgcgctcggtgagtgagttgatgtccaccctactgatgagttgtgtagatctcggaccgagtgaatagacacgacggctggtgaggacaagatgaggttgcgttggtggttggggaatgccactgttgggctcttgtgctgcgtggctggtgttggttcgggtgggccgcccgcacgagtagttgtgtgtccgcgtgtgcggaaggatgggtggaggtcgtgtgcggacgtcatcgcgtggagtcgtgctgttttcgatcggactcgggtncgttgtgcaatggttgtatggtcggcgtgctcctgccgccgcccgcggggcggtgctgcagagtctgtttggttgtgtgggtgcttggctgcggtgcgccgcacctctctcctcctgccgccgtggagtgcgcacctactctctgtgtggtgttgttggtgttttgtggtgtgggcgcctacgcgtcgtttgtgtagtggactcggcggatgggagggtgttcggtcagggttggttggtgtggttcgttccggcccccaagggtgggtgggtcgaccgcgtgcgttggggcccgtcggtgtttgttttgtgttcgccggcacgaggcgcagcttacgttgtagttgtgaaggactagtttgtgtgtggggtgatgcagctccgcctgggacagtacgggttgtgtgagtgggtggtgtggtggtggccgttcgccctcgccgcgcacattgctgtggctgtcttctcttagctctctacttcggaggagggagggggagcgtttgttggtgtggctgccccccgccctcagaggggggggggtgctcttctctgtcttcccccccgggtgtgtgtcccgcccgcgtcactgttttttcgcgcggtggggactacacactgctctcgggttgcgcacgctcgcgatgtggctcccgcacacgtgtagtctctctcttttcgtctcttgttacttgtattgttttgtctctcgcgcgcgcggaggggattttatgctcattgtttcttgtctcctgcacgccacacacaatgtatcttgtcgtgcgggctctctctcccggagagagggacaccccgcgcgcgcggttgttgcgcggcggggtcccgccccgcggggcgggctcgcacaccacccccccgtggtcacctcactctcttctctctctcttgtgtggggcgcctcgctctctccttttttcttctccaccccccgcgcactatattattataaatgttttcttctgttgtgtgttagaacactctctctctctctctctctctcgagagccgcgaaaatctctctcttactatatgtgtagaaggacacacgccccccctctcccccggcgggggagaagaaaagagagagagcccccccccccccccaccacccacccgcaggaaacccccacacaacacacaaattattaaaccacaaaaaaagagagagaggaggcgccccccccccacgcggggtgaagcgcacacccccccgggccccacccgttttttttca

SEQ ID NO: 522950 - DNA, 620 bp, Homo sapiens
  misc_feature (99)..(100): n is a, c, g, or t
  misc_feature (418)..(418): n is a, c, g, or t
  misc_feature (423)..(423): n is a, c, g, or t
  misc_feature (615)..(615): n is a, c, g, or t
aaaaaaaacaacccccccccccctaaggtttcccaaaaaaaaaagaggtttcttttaatacccgggggcggggttaataaaaggaagaaaaaaaaaagnnaacccccctttttttccccgccccggaaaattttttttttgtgggggcccccccccccgaaaggggaaaaacaaaaaaacaacaagcccgcccccggaagagagaaaaaatattatgtggtggattttctcccccccggggggggggtgttttttcttcccccccccccccccctatataaaaagaaaggaagaagagaaggaaaaaaccccccccccctataaaaggaggaggtggggagggggggttttttaaatagccctgggggggtttttaaaattttaaaagggggggaaaaaactcccaaaaggggggggnttttnaaaaatttttaagagaggggccccccccccccaaaaaaagaagggggaaaataaaccctaaaaacccccctctcgggggaaaagggaccccccccaaagcaccccaaacccggaaaaaagggaagccccaggcaagctattttgttttttgaaagcaggtctgtagcaccagcggtctaactctggccaagnacagc

SEQ ID NO: 522951 - DNA, 299 bp, Homo sapiens
agttcccatttctcctacctcagcctcctgagtagctgggattataggcacgcaccaccacacccagctaatttttaatttttagtagagacggggtttcaccatgttgggcgggatggtctcaaactcctcacctcgtgatccgcccgcctcggcctcccaaagttttgggattacaggcatgagccaccatgctcggcctgaaacatggagcctttgagcatccccaaaatcatcttcttgatgggcttatgctgataccatttgcagtaagtctgacagaggcaggtgaaatggga

SEQ ID NO: 522952 - DNA, 869 bp, Homo sapiens
gcataggggcttcggcgccaggcccagcgcaagtcggcctggtagggattacaaaaggtgcggtatgagcaggtctgaagactacattttgtgagttgtaaacacagaaacgctgtagaaagtgtggtgtctcagcaagggcctcagtttccttccttacagccctgtgtaattggacatcgtgctgcttcatattttcatacataatgcagtaacactccaccatatagaccccggtttataccttatatcagtgacactggttaacagtagctccagaaaaagtgcttatgtggggcaatgctaaatatgggcggcagtttttatggcattgtgttacccatttattgtgcgtaataagcaagttcatgctctgagtcctgaagaagaagttatcatcaaattaaacaagggctggcctgtgtactttggaatactgagttgtcaaggactttctatgtgtggcaaatttccagaaaaaaacccttttgtgtgcacatgtaagtggagctgtgctaaccttgtgtatggggctcattatattattgtgtgttccagaccatccttttcctaacaaaatgaggcaaaatcccatgaacacacgtcttctggctcagactggggttggtatctggtgtggaaggaaagtggcacttagcattgctgccttgctcatcacgttttggccaggggcaattgtggcgcctggctttgaacagaacctcctttggagcccgcaggacaagtgtttttgttcaattgatcctatgggacaaggaggatgagataccccttgggttcccgactaccttcgggtgtcacacatcttcggggggccgccatgatacccttagaggcgggctaaaaaa

SEQ ID NO: 522953 - DNA, 278 bp, Homo sapiens
aaaattttgggggccccaaaaaaacccccccccctttttttgaaaaggtttttttccccccgggcccccccccccgtgttttttttttggggggggggaccccaaaatccccccccccccccaatttccccctttttttttttcccccccagggttttggggaaaacccacgggggcccccctttttttaaccccaaaaattttttcccccgatttcccccccttttttttaaaaattttttttttttttttttttccccccccccccccccccctta

SEQ ID NO: 522954 - DNA, 126 bp, Homo sapiens
gctggcattcatggaagccgactccgtgtcgtccaagggcttacccaggcccttacaacatgtcttcggctccgggactcccgatccggctcccgctcgggatcatcgctcacggatctcgcatcc

SEQ ID NO: 522955 - DNA, 476 bp, Homo sapiens
ctgtgagctccttgggtacgggtaccttgtatgtttaattttatatccctagcacaaagcaagtgcctggcacatagtcagtgctcaagtatctgcatagtcaagaatgccagcctctcttgtgtctgggctccgtacgggcgtaaagggcttgattttgggctcagatagggagcctcttgccgcaatgaactggcctattatatgcgtcatggtgtcgctatgcttctgtctcgcccatcaagtctgttattagcgttcgcagcaaggaactcgtcgtgacgccgctgacacttagaagtgcatgatcacatgcgtagttccgtgatcagcggagttcctagtggtatggttcacgcgcaagccaagcattcctttgtgctgctggatcagcctttaaaacggagtgttctggccagcagggagaggacccaacagcgtcacagatatagggtctcacgtgcagaaaggaaggg

SEQ ID NO: 522956 - DNA, 120 bp, Homo sapiens
gagagactggatttttatttcaaagacaaacacacaagctgtactgcagataaaactatatgattcaatgcatgagtaatcatgagtacatagagcgagctctctcttgtcatgcatctg

SEQ ID NO: 522957 - DNA, 327 bp, Homo sapiens
ctagaggatccccattgagccccggatgccatcactagatagtgttgagagagggagggggtcaatcttgatcacgagaaagcaatacatgtagcaaccatctgcatgccagattgatgttagtagtgttccacgagtcaagtaatgctggcatccaccattcaatgaagtaccggcagccatatagcaaatgtctctctcctacagcctcctaaagcacagtcgcgtgggcctgcgaagctagccttgttttaggctcaatgattctagacttttggagtactagccgcgagaactgtgagataatgaatttctgtggttataagt

SEQ ID NO: 522958 - DNA, 948 bp, Homo sapiens
gtccccacccccaggacacaacccctggtcttggaccagtagaggacacggagggttcagacccctcctcagaccctccccacatctgaaactgcctccccccaaccacagcagcagcagggcctcctcccccacagtcgtccccacagggcccctcagacatcatggagacccgcaggacggggcttagccacccactcaaacccagggccccctgtgcacctggacatctggcccgtgtatttcatggacacagaggccccacacttatcactaacatcgatgactcccattccgcacttcttttccgtactgtgaagaaagaactctcacaacaccagagatacacacgccatgcccactggaactggagtaggaggaactgtagccatacataccaccaggaagaaaacaagaccacactacatgactcgacatgagggtgggacgtgattctgtgatagcccactgaaggggggttccagaagatgagcaggagccacctaggactcccagagagccagaacaagacataacagagacaagaaacgcaagacatgaagaccgagaggacatacgaaccagcgaacaccaacgaattaggacaagagagaagaaaccatcaaacgaaaagagcacacaataggcaaagaagcaccaaaacaacgcatgctacgcacaggaaaagggtcatgaggcaaaggtggcgcaacatcgagggaagtagccaagaagagacagtacgagcaataaaggaggagacaatagagaataggagaccaaagggcagaacaggagagacacaagagaccgaaggcaacgatcacgatcagggcaagttcgacgacgtgcacgccataagatacatcgcaggataacatgaccccagaaaaggaaaaggacaaaagacatagaagaaagaagaagcgaaagcaacgcgaaaaagaa

SEQ ID NO: 522959 - DNA, 284 bp, Homo sapiens
gtacaaacacataacataaatagtgtacttaatatctataggtgtagtaataaataatgaaataataatagcaactcaccatcatgtagaatcagtgggagcctggagctagtattcctgcatactaaacagcagttccatctaggaggtagatggaagacaatgacagatcatcaggcataagattctacataaaggagccataatactaagataccctcgtaatgtgcagttcacagtagggcaggagctcctaatgagaatactaatagccacagctagat

SEQ ID NO: 522960 - DNA, 102 bp, Homo sapiens
  misc_feature (13)..(13): n is a, c, g, or t
  misc_feature (31)..(31): n is a, c, g, or t
aaaggactactcntccctgagaaggcagagntgctggctggcctgcccttccccaggcttggataccttgggcccccttattcctgcaccaacagcaaactc

SEQ ID NO: 522961 - DNA, 306 bp, Homo sapiens
attcggccataatggccgggggtccgggttggaacttaatcaatgttccaaattggacctgttccagggatgtgaaaaaactgattgcagccaaggcctttcggaaacccaaaatggtgaccagcttctggggttgaattaattgaggggccttttgacatgagtttggcttggcccaacttcttagttcttaatattaaagacggatggttttttggtttttaattgaggggccttttgacatgagtttggcttggcccaacttcccaagtttttaatattaaagccggatggttttttaattgg

SEQ ID NO: 522962 - DNA, 681 bp, Homo sapiens
tggtgagctggaacatcaatgagattcggatacccctgcgaggggtggctaatcatgaacccaactactgtgccgccgtggccgtggggcgcattttggacgagctggatgcggatatcgtctgtctccaggaagaccaagagctgaccagggtatgcactgacgagagccccgtggctatcggttgagggttatcatcgtcctatttcagcttcagccgcaaccgtagcggctattctggtgtagccacacttctgtaaggacgaggctaccccagtggctgctgaaaaaggcctgagctggccgtgctttgccacccagaatggggatgttggcttgctactgtgaaacagtggatgagcttgacgccacagaggagactccgggtctctgtgctagtgatgggcagggccctcctcatcacagcataagatccgcacatgggaaggtacaggagaagaccttgaccctaagtcagcgtgtactggcccccatgcggaccctgggaggcctgagcggctagtctttcagatgcgcttctatcggcagctgcaaatccgatgcagtaagccctcctgagcggcaggctagcccatgtgatccattctgggtgacctgaatacagcccgacgcccattgaccactgcgatgcagtcaacctggaatgctttgaagaggacc

SEQ ID NO: 522963 - DNA, 163 bp, Homo sapiens
gcggcgcccttattttcctccttccgctcagtctggggctatctgcttctcttcccgtgaacccttctctttccgtggtagtagtccttatataggtatgggtctctagcaaactatatttagcatacaaactagggccatacttctacacatcagtattcac

SEQ ID NO: 522964 - DNA, 127 bp, Homo sapiens
tgcacagctgaatatcaaactacatcatagcatctgtgtggacgaagttgttgctgcaacaacttcgtccaccgggatcttgctcagtctggggtctcgtgcgtgtgcagtgatacctgagctcgaa

SEQ ID NO: 522965 - DNA, 215 bp, Homo sapiens
gctctgctctctgctctgctctcttcgcttcttctgcagctaaaataaaaatgtcaaatacaatcttagttcttacaagataatgtcttacgtcctcgtaccacttcaggtagacgtagaggcctaaccttgacttaagggtatactcacgctttaacacattgttgaggacaggaccacgtttgaccagagtcgatatactaataacgaagcta

SEQ ID NO: 522966 - DNA, 437 bp, Homo sapiens
tcctggagcaagcggggaaagggcacattggaaccaggatcgcccggacaggggctggccttttggtatgtgtttccccacccccgtgacctagcgggtatctgggggatgtttctggtgacaggggtaaaagtaaataaatggcatttaaggggtaagcaggtgtttaaaaacaaaacaaaacaaaaggaaagaaggtggtcgcagctaaggaggtttccacatgtggtttaactccagtaaagtctggatccagcatctgaggcatacaagggttttcttcttgggcatgagccattttctcttctaagtcatcaaggcttttctccaattaagttacggacctctcggaaaactcagccggagtctcagcctccttcagctggtgggaagggacctggatctcttcctcatatctgtcttccttcggcgagtac

SEQ ID NO: 522967 - DNA, 338 bp, Homo sapiens
  misc_feature (17)..(17): n is a, c, g, or t
  misc_feature (110)..(110): n is a, c, g, or t
aaaaaaaaaataggaanttgcctcggggccccccctttcaaagggggtgtgtcccacaaacccttctatgggtggggtgggggggtggggtgctgcgtaaccagtgtttnacttttttttcaagtgggggaaagtgggaaaggactaaaagtaaggcaagttttccccagcccctgtccgtttgtttgtttgtttgggggggtttttgttttttgggaggaaagggaggataaaaagtcattcccccccccttccaggcctcctgtaaaatttgggggacctgactggtttgggtggagtcccaaaagaatgggggccctttaaaaaaggaaagcaaa

SEQ ID NO: 522968 - DNA, 111 bp, Homo sapiens
gtcatttgctacagctacactgtctctgttctctcttccagtgaactcctaacattacatattgattgtctatgtcttttttctttatttattcttgtgtatgaaattgaa

SEQ ID NO: 522969 - DNA, 513 bp, Homo sapiens
  misc_feature (9)..(9): n is a, c, g, or t
  misc_feature (15)..(15): n is a, c, g, or t
  misc_feature (44)..(44): n is a, c, g, or t
  misc_feature (459)..(459): n is a, c, g, or t
  misc_feature (475)..(475): n is a, c, g, or t
tagatcagntatccnagaggatttttactcctccagtgccaagncaggcctacgtcccattaaactcagccaggaagtagttacggaaaacagatctccgccccttctgcagcccccttaagatttaaggaggagtatctaatctctgaaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcgatttgcatataattaaaagtggatacaaataccactgcagaactgcctctgagctgctactgtgggcgcacacctgtagggcagccctgctttgcaagganagcgcctctgctgctntgtcacagccggccgcttcaataaaagttgctaacacc

SEQ ID NO: 522970 - DNA, 261 bp, Homo sapiens
gggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacgcaggagaatgtagctgaactgttaaaaatctcacgagaagatcaagatagtttt

SEQ ID NO: 522971 - DNA, 403 bp, Homo sapiens
gatgaacaggcagccaaggattcagttgctgtgaccacaaccacacagtcatcctactatctttctccagacccagcatctgtccagcagccgatcctccaaaacaagttcagagctcacactgctgtcaccacatccactgctgctaccctagtcagggccgatctcgcctggttcctgtaacaaaactaagccaggtctcctggctgctgagctttgcccgctatgctctgctctcctgtagcagccagagtgtccctgctgagaacacaagtcagatccagtcacttctctactcatggcctttctgtgctgctcctgttgcactccagataaaagccagagccttcatggtgactagtgagctccccacaggctcctgacctctccccccacatcccgc

SEQ ID NO: 522972 - DNA, 133 bp, Homo sapiens
gcggccgcctactactactactactgctcgaattcaagcttctaacgatgtacggggacatgttcatacacctatcccccattctcctcctatccctcaaccccgacatcattaccgggttttcctcccaaaa

SEQ ID NO: 522973 - DNA, 928 bp, Homo sapiens
  misc_feature (65)..(65): n is a, c, g, or t
  misc_feature (115)..(115): n is a, c, g, or t
  misc_feature (154)..(154): n is a, c, g, or t
  misc_feature (180)..(180): n is a, c, g, or t
  misc_feature (184)..(189): n is a, c, g, or t
  misc_feature (192)..(192): n is a, c, g, or t
  misc_feature (215)..(216): n is a, c, g, or t
  misc_feature (233)..(234): n is a, c, g, or t
  misc_feature (239)..(239): n is a, c, g, or t
  misc_feature (251)..(255): n is a, c, g, or t
  misc_feature (272)..(272): n is a, c, g, or t
  misc_feature (311)..(312): n is a, c, g, or t
  misc_feature (316)..(316): n is a, c, g, or t
  misc_feature (318)..(318): n is a, c, g, or t
  misc_feature (327)..(327): n is a, c, g, or t
  misc_feature (337)..(337): n is a, c, g, or t
  misc_feature (344)..(344): n is a, c, g, or t
  misc_feature (382)..(382): n is a, c, g, or t
  misc_feature (386)..(386): n is a, c, g, or t
  misc_feature (395)..(395): n is a, c, g, or t
  misc_feature (398)..(398): n is a, c, g, or t
  misc_feature (422)..(423): n is a, c, g, or t
  misc_feature (428)..(428): n is a, c, g, or t
  misc_feature (433)..(433): n is a, c, g, or t
  misc_feature (444)..(444): n is a, c, g, or t
  misc_feature (446)..(446): n is a, c, g, or t
  misc_feature (453)..(453): n is a, c, g, or t
  misc_feature (455)..(455): n is a, c, g, or t
  misc_feature (472)..(472): n is a, c, g, or t
  misc_feature (478)..(478): n is a, c, g, or t
  misc_feature (482)..(482): n is a, c, g, or t
  misc_feature (487)..(487): n is a, c, g, or t
  misc_feature (495)..(495): n is a, c, g, or t
  misc_feature (499)..(499): n is a, c, g, or t
  misc_feature (511)..(511): n is a, c, g, or t
  misc_feature (515)..(515): n is a, c, g, or t
  misc_feature (519)..(519): n is a, c, g, or t
  misc_feature (523)..(523): n is a, c, g, or t
  misc_feature (532)..(532): n is a, c, g, or t
  misc_feature (536)..(536): n is a, c, g, or t
  misc_feature (539)..(539): n is a, c, g, or t
  misc_feature (557)..(557): n is a, c, g, or t
  misc_feature (581)..(581): n is a, c, g, or t
  misc_feature (587)..(587): n is a, c, g, or t
  misc_feature (589)..(589): n is a, c, g, or t
  misc_feature (709)..(709): n is a, c, g, or t
  misc_feature (713)..(713): n is a, c, g, or t
  misc_feature (724)..(724): n is a, c, g, or t
  misc_feature (728)..(728): n is a, c, g, or t
  misc_feature (836)..(836): n is a, c, g, or t
  misc_feature (838)..(838): n is a, c, g, or t
  misc_feature (853)..(853): n is a, c, g, or t
  misc_feature (861)..(862): n is a, c, g, or t
  misc_feature (922)..(922): n is a, c, g, or t
aaccttaagcaccgtatttgaattttagaatgtggcaatctatataacagtaaatatatgactgngattcttttctatcttctctaaacgccattcaattctctcctctctttanttgaatttgggaaacaaggtttgacaaagggatacaatntttaaagtctactagaagcacaaggnaaannnnnnccnccagggcacatcgacacgtttgnnctccccacccctttttnnctgangagccccaattnnnnnactagaggcgttatggnctattgtgaacacacatcttgggggtgggctcagatttnntttntnttctttttntttttttttnccttttntttttttgtttttttttttttttttttttttttttttnaganactgtgagngtncttaagtccaaagttcctgggaannttggntgtanaagagaagttncnatgcaancnaccccaatgggctcttngtgagnagcnggttnttttttcnttcnctccctcatgtntgcnggcntttntggggtctntggnatngcgtcgtatttggtagangaggagtggagagacgtcaggggngggggngngaaaatgtgtgttttctaggcctccagtggtctttcttctctttagatggtttaactgcaggtgagttgatctttctcttcctttggcgtgacggtgttgggatgtgctatgggtagaantctntgggggctctnaaanatcttgtctcagttcttcttggatggtcatctccagagcccaggtccatggcttctgggtagctggggaattcctgaggtaaagggaactcctctgctgaagagtgantncagtgcccgaacacnttttcctnnagctcagtgatgtcattgcggatgtcagccagcataagtagcaggaagtcgaaagaacanggggtc

SEQ ID NO: 522974 - DNA, 233 bp, Homo sapiens
cgtggggaacagtgggagtgagactgacccttcggtttgcatggtgagctgggatgaggcctgtgacgtgcatggcgtttccccgctagtttccactggacaaccgtgcagggcatcagcagaggctaggcataagtcttccgtaggttacacaagctcgcagggacctggggaatctcactccatatcccgctacagcaggccagcgagcgaagaccgcacccgaaaggagg

SEQ ID NO: 522975 - DNA, 234 bp, Homo sapiens
  misc_feature (1)..(2): n is a, c, g, or t
  misc_feature (186)..(186): n is a, c, g, or t
  misc_feature (215)..(215): n is a, c, g, or t
nnctatgtccagatgaggttagggctaagcatagtgggctatctaatccagtcggtcttagctattgtgtgttcagatatgttaaagccactttcgtagtctattttgtgtcaacttggagttttttacaactcaggtgagttttaggctttacttgggggagggaggtgctctacaaacactctnttacgccagttccctcatccttggggagngggtacccgaggctccgaa

SEQ ID NO: 522976 - DNA, 283 bp, Homo sapiens
gggggggtttttagaaaaaaggggtggggggaggggggggccccccccaagggggggggggaaggggctttcttcccgcccggccgccccccttttttgagaaccttttttggggggttccaaggggggggggttcaaaaaaaattgggccctgggggggggaggttttgtggtttgtttcggggttttttcggggggtttgggtttttttttttttttttggggggaccttgggggggcccccccacccccccccggggttttttaaaggggtttttcccca

SEQ ID NO: 522977 - DNA, 341 bp, Homo sapiens
aaaaaaaaaaacaccgccccccccacgcccggggcacccccctcgcggccctcccccgccccaccccgcgcgcgccgctcgctccctccccaccccgcgccctctctctctctctctcccccgctccccgtcctcccccctccccgggggagcgccgcgtgggggcggcggcggggggagaagggtcggggcggcaggggccggcggcggcccggcggcgggggcacggtcccccgcgaggggggcccgggcacccggggggccggcggcggcggcgactctggacgcgagccgggcccttcccgtggatcgccccagctgcggcgggcgtcgcggccgct

SEQ ID NO: 522978 - DNA, 923 bp, Homo sapiens
caatgaataaggagatgtatagaggccaagaaataatgtgtccttagtcagcagggtcatgcagtactctctaatgtcccatgtcgtcattaagcaaatcgttagtaaagcgtgggaggttgcctgtaatggttcctctagttattaagcaatgcgtggctaattagtataggagccctgtataggaagagcatgtgcagcagacccgagattaactataaatttctggaagatgagagtctgtagactgcctctcacattcgattctatctcacactatcgtatttccaagtctgcagggccttacagtgatgtcgtgacatggggagtggttacagtaagccccgcaagataggcgggaaaaggggaatgaatcttagcgtggccaatgattcgcagaaactagaagataaggtggccactgatagtgatgatgctcgtgcgccactggtttacaactgaaaagttctgggtcagagttagaaaagtcaattaggtggaggacctctgatagtaattgagaacagaatatgatgaggggagcagtcagaaatttgaagtgataaacctgtatatggtggtggagtatctggaggtttgttcttttcgtcttttatcaaactgggtgtgatcccgatggaatgcgctagtgtcacatgaacgctaggtagtaatgttgtgtgtatggtcggtgatgaatctctcttgtcttatataattccccccttttctataccattaccttcgttaaatctgctacccctaccgggaaagccaggggggggaaacgcgagctgccactaggggcggtcctggggtcacacgggcctgtatccagagaaagaacttggtttgccggtggctgaaagtggggacagcccatttgtgcaataaatctgggcggacacggtcgactggggtta

SEQ ID NO: 522979 - DNA, 356 bp, Homo sapiens
  misc_feature (24)..(24): n is a, c, g, or t
  misc_feature (63)..(64): n is a, c, g, or t
  misc_feature (91)..(91): n is a, c, g, or t
aaaaaaaaaaaaaaaaaaaaaaanaaaaaaaaaaaaaaaaaaaaaaaaaaaaaaaaaaaaaannaaaaaaaaaaaaaaaaaaaaaaaaaanaacagaaacacaaagaaaaaaaaaaaaaaaaaaaaaaaaaaaacgaacacacagtaatcccccctccccgggggagcgccgcgtgggggcggcggcggggggagaagggtcggggcggcaggggccggcggcggcccggcggcgggggcacggtcccccgcgaggggggcccgggcacccggggggccggcggcggcggcgactctggacgcgagccgggcccttcccgtggatcgccccagctgcggcgggcgtcgcggccgct

SEQ ID NO: 522980 - DNA, 1527 bp, Homo sapiens
agcggggtgcggacggcctggtggcctgagggtagcttgagcgcggtggcgggttgttcagtcagagcgagaacattccagagtgtctgcccatgtctcctgagcgctgacgggtgtggaccagctggacggtcgcttgggacagccccctccccgctgctcgtgccggctgggcaccttgtgccctggctgatccctcgccttggcgctttctggtctccgtcatcctccggaactctggacttctggtttatattgcggccgtcaagccttcattccccaatgtctcctgggtcgaagcatgttgttcgggtgtttgtcattgttcctttttattttttgacctgaagaaacgcggagggcttggttcggcaggcagagcccaattgtgggttaagcgcattgttacttcctgcgcgggaaacagccaagtaatgcagtaacgaaatgcagcagaaaggccttgtaagcaaggaggcttcaagggttgcgctgacacacaacctcgttgtcttccactttgtttccagtggatgcaactcgggagggaagacgcttccttgtggcagaggctccgggttttaagtttggtccaattcccgctttatccatgtccttcgccatggaaccatggacaagaataacgccagagagagacgcttttgcacagcttctacagagggacttccttctttttccagtccgtttagttttggagttacatgactgggcccgagcttaaagactaaaacggcgccaaacgagacattggtccttcgtcccacacttgtgttccgaaactccgtggcaagggctggttggtttcaaagagaagcccaatgggttacttaaagttccaggcttaacataaagaatttggccccacctgggtctgggaatttgggcccaacgtgggtctttgagacggggcgcccacaagtgatgcccaatcttgttgggcaacatttccacacgagaaccaaggttcaattaccggttcagcacacattcggggtttttggaccatgttttggccccaccaatgggtgctgtctcttaaaactcctggggtggccttcccaaaagcgggttaatttccaccaaccccaaagattactttttgtggggctctgtatgtaagccattgtgggagatcgaacgagaaccccccaagcttttggcacttggtcttacaaggcaaactgcaccgcgcgtcaccattgtggtcacactcgggcatccatccattgaatgcgcgcaaattacagcttgccacacgacccattgttgtgccctgtcgaatcccacttcaaccacacattctgggtcgctccgtgttgccgcggcacatgttgtgtacaacttcttgtaacaccggacacgcgcgatggtgcaaatgccgaccacaaaaccgacacgaacggcgggccacgtcgataaacagacacgttgctgctacactgcggccattgactgtgcgacccgcaccactacaaacccatttcgtgcctctaactatcccacgaa

SEQ ID NO: 522981 - DNA, 161 bp, Homo sapiens
  misc_feature (115)..(115): n is a, c, g, or t
cgagtcagttgcggagatctggggaatagctcttaatatttcaagttttggagcagtggttctaggtctgagtgaagtgaaaagaatctctaggggcatgtggtaacagataatnccatactatgtactgcgtagagttaaacgagaagaggcgagagcat

SEQ ID NO: 522982 - DNA, 592 bp, Homo sapiens
  misc_feature (330)..(331): n is a, c, g, or t
cccgttttgcgtattcatgggctcctgccctgggtctggtggtaggttcacatgtcagcaaccacgagctaatctcacctcacagttactctaatttctcgtgtctgtcaagtttcccaaggaggagttgttttcccaaatcagcctgtttctttttataatataagctgtttagaggccaggcacagtggctcacacctgtaatcccagcattttgggaggccaaggcgggcagatcacctgaggtcaggagttccaggccagcctagccaacatagtgaaaccccatccctaataaaaatacaaaaattaggtagggccaggtgcggnngtcacgcccataaccccaggactttgggaggccgaggtgggcagatcacctgaggtcaggagaccagcctggccaacatggcaaaaccctatttctagtaaaagtacaaaaattagctggtgtggtggtgcacgcctgtaatcccaactactcgggaggctgaggtgggagaatctctagaacccaggaaacagaggttgcagtgagccaagatcatgccactgcactccagcctgcgcaacagagtaagacactgtctca

SEQ ID NO: 522983 - DNA, 696 bp, Homo sapiens
  misc_feature (298)..(298): n is a, c, g, or t
  misc_feature (324)..(324): n is a, c, g, or t
  misc_feature (326)..(328): n is a, c, g, or t
  misc_feature (330)..(331): n is a, c, g, or t
  misc_feature (333)..(333): n is a, c, g, or t
  misc_feature (353)..(353): n is a, c, g, or t
  misc_feature (367)..(367): n is a, c, g, or t
  misc_feature (373)..(373): n is a, c, g, or t
  misc_feature (410)..(410): n is a, c, g, or t
  misc_feature (415)..(415): n is a, c, g, or t
  misc_feature (421)..(421): n is a, c, g, or t
cgggtgctttcccgccgcggactcggcggtgtgcttcgtgctgtagttatcgttagttcctcttcccgagatggggccgccgagagaccccagcgcctttgaaaagcaaggttgtgctgcgcttccagttccgaaaagcagatgtttaagcccttggactgagggtgggatcgcagctccgaagacggagaggagggaaatggggccctttcccctctattgcatccccctgcccgatccttccccgcacccacgtgccctagattcatggcagaaaatgaccaaatcctgtgtattngttttatatatttaataactgttttntnnngnntnttagtaaaaaaatacaaacnaaaaagattaaatngctatngctgtagtaagagaagctcttgtatctgaacatagtngtatngaaatntgtggtacaccaatcttctcctacaacacttcggggggagggcatgggaaggatctaaccaccgaatataatacgttaccggcttgacgatgaacctcttatgacaccctttgcccaacgttgactcgtatccagtggaccgtgggcctggtgcgcgccgcttcacctatctctgtacgttaactgctgggttctcccccgggcctattagcatacagagcatgcgtcccgttccgaggcacaaccataccacacacacagcacgctactacacg

SEQ ID NO: 522984 - DNA, 897 bp, Homo sapiens
tggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaattttttttttttttttttttggggacagagtctcattctgtcccccaggctaaagttgcaggggcattgactctgggcctccctgcaagcctccacctccggggttcaagcgattctcttggcctcagcctccgtggagtagctgggactacttgcgcacaccaccagcgtccggcataatttggggatttaaggtagagacggggtttcaccagtgttgtggccaggctgtggctctgtgaacctccgtgaccctcggtgatccacccgcctttagccttcccaaagtgtgctgggattacaggcgttgagccaccggtgcccggcccaggacttttaaaacaagcttcccaggggatctccggtgcctaccagaaagtcgcaagctgttgggctctggagggcgcctaggagatcggagtcgcctaagaggggataagggctctagggcaagctcctagccttccccaatatctcgtgcctaagacccctgggcccagttgcgtggggcacatgagcataacaccgtgaggcttccaagaaggtcgggtggccaacgggaacggaccttgtgagaaaccttccaaacgccgccagggtcccaagggcccgtgccgcacccgtgggggaacaaccaaggaagttctgttcccgacaagaccg

SEQ ID NO: 522985 - DNA, 205 bp, Homo sapiens
ctctcacggatccccacacttcgatcgcggagaaggccataggagttatgcaacacttcgactcgcggtagaagtgagagctacagcgcgacgctcgcttcatatttgatggagaatgatgcttgagtccttcttgatcgccatccgattagcccgaggagaactgagactctgcttttccaccgcagtgcgtggtcttctctcc

SEQ ID NO: 522986 - DNA, 485 bp, Homo sapiens
  misc_feature (298)..(298): n is a, c, g, or t
  misc_feature (324)..(324): n is a, c, g, or t
  misc_feature (326)..(328): n is a, c, g, or t
  misc_feature (330)..(331): n is a, c, g, or t
  misc_feature (333)..(333): n is a, c, g, or t
  misc_feature (353)..(353): n is a, c, g, or t
  misc_feature (367)..(367): n is a, c, g, or t
  misc_feature (373)..(373): n is a, c, g, or t
  misc_feature (410)..(410): n is a, c, g, or t
  misc_feature (415)..(415): n is a, c, g, or t
  misc_feature (421)..(421): n is a, c, g, or t
  misc_feature (445)..(446): n is a, c, g, or t
cgggtgctttcccgccgcggactcggcggtgtgcttcgtgctgtagttatcgttagttcctcttcccgagatggggccgccgagagaccccagcgcctttgaaaagcaaggttgtgctgcgcttccagttccgaaaagcagatgtttaagcccttggactgagggtgggatcgcagctccgaagacggagaggagggaaatggggccctttcccctctattgcatccccctgcccgatccttccccgcacccacgtgccctagattcatggcagaaaatgaccaaatcctgtgtattngttttatatatttaataactgttttntnnngnntnttagtaaaaaaatacaaacnaaaaagattaaatngctatngctgtagtaagagaagctcttgtatctgaacatagtngtatngaaatntgtggtttttaatttatttaaatnngggggcatggaaggattaacaccgatatattgttaccgc

SEQ ID NO: 522987 - DNA, 366 bp, Homo sapiens
tgttagagcaggaacgataggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtgcttactggagttgtgcggtgccctcttgaggcaatcttcccttacgagttcctaggggaaggtcacactctgggggaacttgtccgtggggctcttagggagcattctttacgggggtggccaacggggggggggtgggtaaagggggt

SEQ ID NO: 522988 - DNA, 206 bp, Homo sapiens
ccccattcgacgtatgattgctctctaccatcttttttattgctccatcgtcacatggcgctcatgcatcctgatctcccgctctcctcagttttttcagtgcgctcaccccccaaaggtgtctgtgaccctgccactccgagataaccagtggatgcccaggatcttatacggacaggcctctgtaataaaagagttttaacaaa

SEQ ID NO: 522989 - DNA, 203 bp, Homo sapiens
  misc_feature (6)..(6): n is a, c, g, or t
  misc_feature (12)..(12): n is a, c, g, or t
  misc_feature (156)..(156): n is a, c, g, or t
  misc_feature (162)..(162): n is a, c, g, or t
  misc_feature (201)..(201): n is a, c, g, or t
tcggcngttagnatgctactatgctgcttagttgtcctgacacattattttttcagtgttaatggtatgtcatatttttactgttaagtacttaatgtatgaataaatgtaagaaaacaattgcctattgttagcatgtagattaagagtcaggantgccgnctcttgttgacatgggtggctgagatagtgacacctttncc

SEQ ID NO: 522990 - DNA, 148 bp, Homo sapiens
agggcggcgaagctgtggtcttagatttatttttgcatattatcgatgctgtacaggtgctagctttgtaaacgctgtgtattccctctgcccccatgctgctggtgtaaataactgcatctccccggtacagctccccgggataaca

SEQ ID NO: 522991 - DNA, 155 bp, Homo sapiens
catggatttgctggtgcagtacaactaggcttaatagggacatggtggctcatgcctggaatccgagcactttgagagactgaggcagtaggatcgcttgagctcaggagtttgagagtagcctgggcaatatggtgagaccttgtttcttatca

SEQ ID NO: 522992 - DNA, 191 bp, Homo sapiens
cgtccttcatcatacctacccgtcccaagagaagaacaggtcccctgttctagaaacagagattctggttgagaagatcaccttgaaaggatccatgtcctccacagaaggaccccaatgcaaattcatgacagcaccccctctcctctcatctcctgttggtcatgcccaggtaggtatgatgaaggacg

SEQ ID NO: 522993 - DNA, 168 bp, Homo sapiens
tttacgacatacaccctgacctccagatgatctacctgcctggcctcccaaagtgctagggattacaggtgtgagccaccatgcctggcctcatatcattatataaataagggtaatattgactagtacctttaccaatttaggatgtctatattatcttccattatg

SEQ ID NO: 522994 - DNA, 216 bp, Homo sapiens
ggggaccgaggcctagtggtttgcctaccttttgaaatgacacctgtttctatcagctgacacacatcctcatgccagctggctgaatataatgatgttttttatacgagctgtcggctctccactcacccaacaatagaacatctgacgccgctgcgtagaatgcatttctatatcttaccctcacgggaacccggtatgctttcttgcccgttg

SEQ ID NO: 522995 - DNA, 162 bp, Homo sapiens
tcctttgcctgggttttaattccagcgctgccccttcctttttgcccctcctggcaagttttttttattccccccgtttaaaacgatggcccccccgtcccagggtggtgtgaggattacccagtgtggtaggtgctcaataaatgttggtcattgttttca

SEQ ID NO: 522996 - DNA, 162 bp, Homo sapiens
tgctctgtaggtcatgcatacttaatattatcttgtaattcaatacgggtgccgatgtaatagcgaggtgccgaatgtaatagcgtatgtgccgatgtaatagcgaggtgccgatgaatagcgtaggtgccgatgtaatagcgaggtgccgatgtaatagcg

SEQ ID NO: 522997 - DNA, 872 bp, Homo sapiens
gcggagtacaggagtcagactgtaggacgagctcgggtcccatgtgtccccggtagctcgccggccggagcccccgtgttcccggtggcggtgggaccttagcggagccacacacagcctactttgcaacgcggagctcatgtctggtaagctggcatttgcggctgcaaacggtggaagaaaacagggcacaaaagatgaggatgtgattcggagtgggtatcccctgtcaaagatgctcgagttgtgctctgtgatataagactggacagttgtggtgtggaacattgaatcgcctcgtaaccctggcctgagtttgaaatcattgctatgttcatcagaggggataagattcttgatacgtggcactctctaatgattggagagaatagtctgtttacaccaatggagcttgagacatggcgcctgtgacgagagaagtgagcgtggagctgtgtggtgcactccttgaaggaccttgcccactgtgcttcctcctgggttcatcgatcggagggcatctcgcaagcgggagaaccctcatgatgctgttgtcgtttcacccaataggtttgttcgtggaagaccctagaaacctgccagagaagagtgtggtgggaacgcgaggtccctgcgaagatgcaggccagttgagagaaagttcccgcatctggagttgaggagtattcggggaaactcgaaacccggttctggaagctggaggagcagcaggagttcagtgccatcatcctggcaacagctggctggaggcaatgggtgggcacaccgcgtgggggagatcctggccctgaggaattgatggtttctgtggccagggctggggtgtaatgggagcccagggccggcgcttg

SEQ ID NO: 522998 - DNA, 131 bp, Homo sapiens
aaagcacgccagatgttcacttatagacactacataagagtgtttcaaacctgctctgtgaaagggaatgttcagcactgtgacttcaattgaaacatcccatagaagtttctgagaatgcttctgtctag

SEQ ID NO: 522999 - DNA, 203 bp, Homo sapiens
ggggggggggggggttttccccttttttaaaacccccctttttttccctttggggccccgggccttttttccaaggggttccccctaatgttgggccctttggggagggtttttgggggggggcccccctaccctcccccggggattttttttggggggttttccaaggttttttggaaaaaaccctttttggccccccccga

SEQ ID NO: 523000 - DNA, 185 bp, Homo sapiens
cacgcacacactgctcggctgtaagcctgcagaagctttaaggacagcctcttcacatggaggacgggagcctactgcgagaagactacatcaatctgttcagcaccagtccattgctgcgattacccgtgaagctgcgacaagttaatcgagccctggccacacttgcacgacacctccttaat

SEQ ID NO: 523001 - DNA, 346 bp, Homo sapiens
cgggcagatcacttgaggtcaggaggttgagaccagcctgaccaacatggtgaaaccccatctctactaaaaatgcaaaaattagaaaggtgtggtggtatgcacctgtaatcccacctactaaaggaggccgaggcaggagaattgcttgaacctgggagtcggaggttgcagtgagccaagattgcgccactgaactccagcctgggtgacagaatgagactctgtctcaaaaaacaaaaacaacaaaaaatcaaagcctgtgcttcaatctgagtcttcaggcttggtttctcccagtactgtcactgggtccttaggaactttactgctcatacttaatcct

SEQ ID NO: 523002 - DNA, 203 bp, Homo sapiens
agtcgactggtactaggaatcatgggggaagtatgtagagagttgaagcttagtccgccgtcgtcggtgtactcgtcgagtacagtaccattggtggccacttgctttgatggtaagggagggctcgttgccctcgtctgttctgtccaggctgcgtagggatgggcagggcgcatgcaggcactcggatgatagagggccgg

SEQ ID NO: 523003 - DNA, 543 bp, Homo sapiens
  misc_feature (6)..(6): n is a, c, g, or t
  misc_feature (69)..(69): n is a, c, g, or t
  misc_feature (75)..(75): n is a, c, g, or t
  misc_feature (79)..(79): n is a, c, g, or t
  misc_feature (112)..(112): n is a, c, g, or t
  misc_feature (122)..(122): n is a, c, g, or t
  misc_feature (141)..(141): n is a, c, g, or t
  misc_feature (151)..(151): n is a, c, g, or t
  misc_feature (160)..(160): n is a, c, g, or t
  misc_feature (169)..(170): n is a, c, g, or t
  misc_feature (197)..(197): n is a, c, g, or t
  misc_feature (199)..(200): n is a, c, g, or t
  misc_feature (208)..(211): n is a, c, g, or t
  misc_feature (220)..(220): n is a, c, g, or t
  misc_feature (254)..(255): n is a, c, g, or t
  misc_feature (257)..(257): n is a, c, g, or t
  misc_feature (270)..(270): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (292)..(292): n is a, c, g, or t
  misc_feature (307)..(307): n is a, c, g, or t
  misc_feature (309)..(309): n is a, c, g, or t
  misc_feature (316)..(316): n is a, c, g, or t
  misc_feature (323)..(323): n is a, c, g, or t
  misc_feature (334)..(334): n is a, c, g, or t
  misc_feature (338)..(338): n is a, c, g, or t
  misc_feature (415)..(415): n is a, c, g, or t
  misc_feature (458)..(458): n is a, c, g, or t
  misc_feature (467)..(467): n is a, c, g, or t
  misc_feature (537)..(537): n is a, c, g, or t
taattngcataagatgctatttattaagaggtatatggtctgggtgttaacagttgctgaggtttggtntttttntgcngcattttctttttgctttgataacactacagancccttatggnctctgatattttgtttgtnttgttccggncccttggcngctccctcnnatctcttcattatcactatagttattngnncgtttaannnnagtgttganatctgcccttgttttgtccgctcctgtttgggtnngngtgctttgggtcngacagggnaancncagctttgngtttctttgtgctgntnggggggnaggctgncttaccttgtngccnctccctgatggttggcggtcaggtaaatgccagaacatattccttctccccactctaggtcactttatggaggtggnagctgggttagttcatgctaggtggctgtagcactgacctcangtataaaangcaaaacacttaaatactgtgatctaggtcttaattgcaagctatactgaggaattttttttttttaagntttggc

SEQ ID NO: 523004 - DNA, 392 bp, Homo sapiens
  misc_feature (55)..(55): n is a, c, g, or t
atggaattattacaagcacaagacagttttacttcaaatttgccacaaagggaangcaatttcaatattctctcagtaaaggcataaataaagtgttccaactaagaaatatctattcataaggctcatcagtagcttcagggtcagctcagctgaatgagtagccagtcctaggagttcttaatcccaggttagtaagaaaattgctcaagcatttcagcagggatgctacttacttcccagagggggctataattacatcacaaaaagtcctgtcccagaccaaatttggaacactcttcctctctctctctttttctgggtattcaatcttctgggaagtcaaacgtagctgaaaagagtgttccttcacagcttactaggagtaaaac

SEQ ID NO: 523005 - DNA, 120 bp, Homo sapiens
  misc_feature (80)..(80): n is a, c, g, or t
acggggatgaccggggataaggaataaataagcacattgaatctaagctccacagtccatttttttaaaaaatatctcangggtcagtggtttctcgtcaaccccgtgcatcttttctga

SEQ ID NO: 523006 - DNA, 193 bp, Homo sapiens
  misc_feature (157)..(157): n is a, c, g, or t
  misc_feature (171)..(171): n is a, c, g, or t
  misc_feature (176)..(176): n is a, c, g, or t
cctgtgagccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatnctggccagaccccnccctnaggagcttcagagatat

SEQ ID NO: 523007 - DNA, 262 bp, Homo sapiens
  misc_feature (30)..(30): n is a, c, g, or t
acggtagatttgcccacatttactcttganttaaaagcaagaaataggcaggagtggtggctcatgtctgtaatcccagcactttgggaggctaggcgggcagatcatctgaggtcgggagttcgagaccatcctgaccaaaatggagaaacccccgtctttaaaaaaatacaaaattagccgggtttggtggcgcatgcctgtaatctcagctacttgggaggctgaagcaggagaatcacttgaacccgggaggcggagg

SEQ ID NO: 523008 - DNA, 100 bp, Homo sapiens
ataagtgtatgtgtagacttgggtctcctcctccggcggggtcgaagaaggtggtgtagaggaagaagcctgtgagtagtatagtgatgccagcagctag

SEQ ID NO: 523009 - DNA, 255 bp, Homo sapiens
  misc_feature (73)..(73): n is a, c, g, or t
  misc_feature (132)..(132): n is a, c, g, or t
  misc_feature (134)..(134): n is a, c, g, or t
  misc_feature (165)..(165): n is a, c, g, or t
  misc_feature (182)..(182): n is a, c, g, or t
  misc_feature (208)..(208): n is a, c, g, or t
  misc_feature (234)..(234): n is a, c, g, or t
cccgtcccgcctctcgtcgggcgctacccagatctgcttgagtctatggaggaaaaactccgcggggtccganttcccatggccgcagccgcctgcgcacaaaggccatggcctcttcaagcgcaccttggngngaagtcccgccgcggccccaggggccgggcnaggcaccgccccgcggnttgcttgcttgcctcctgccgcctgncctgcaaggactggcctcggggaganggcggcaggctgtggagccgc

SEQ ID NO: 523010 - DNA, 746 bp, Homo sapiens
ggagatgccaaatggtcaggcaaagcgagctttatgaagcctatcttcctgagacctttcggcgacctcagatagacccagctgttgacggattgtattcgagacaaatatgagaagaagaaatacatggaccgaagtctggacatcaatgcctttacggaaagaaaaagatgacaagtggaaaagagggagcgaagccagttccagaacaacgaaattggaacctgttgtctttgagaaggtgacaaatgccactagaacaaaagaagacccaccagctacctcggcaaacagctccccgaaatccacagcgcctgtcacggcatccgtcggggcctctgatgctcctgttggcctgctccattggcacatagtacagaccagcaatagcctacagaacgcatcagatctgtcggcctctgttccatccccttcttcttcgggtcccagcaaaggtcgaaggttccatgccaactgtcagggagtgccggctctgttcctgacaaatctgaacctgttcccgggagccagggcagccacacccgacgcaaatacggcaagaaaccagctctctacagactccacttctttcactggtatggatcccagacgcctcaaaatgcctaactcaaagcacatgtcccatcggcactcccggctcaagcatggcatattcccaaaggcataacccaagcttaccccggggataacacctcctaaccagcataactgcggacgcatgaatg

SEQ ID NO: 523011 - DNA, 144 bp, Homo sapiens
  misc_feature (115)..(115): n is a, c, g, or t
  misc_feature (139)..(139): n is a, c, g, or t
cagtaagccaattcattgagcccctggttttgagagcttgttatgttgaacactgggttaggctggaggacaggttcaaaaaaacaaaccatgtctgcccctgaggagctcacangtacagggtttctactgctgtcanttgtg

SEQ ID NO: 523012 - DNA, 132 bp, Homo sapiens
gtccatcccttcacagcccaaaaaaaaaccacaatttttactcttttctatgtaaaatatgggttttaagtcatgtatggtttatgaactaaacgttctgtactaaaaaatatttaacatagaaaaagagta

SEQ ID NO: 523013 - DNA, 102 bp, Homo sapiens
ttagaacgtaactgggattgtctccagtactgcagaatgtgagagtcagaaacatataatgcaagccaagctggatgcaatagagacccaggcctatcaact

SEQ ID NO: 523014 - DNA, 455 bp, Homo sapiens
ggtgcgggtgatctagaggatcccggtgtcatcgaggccacatgtggcattatctaaaatggatcacataacgggaagtaaaacactcctcagtaaatgtaaaagaagtaaaatcataacagtctatcagaccacagcacaatcaaattagaactcaagactaagacattcactcaaaaccacacaactacatggaaactgaacaaccggctcctgaatgactctggggtaaataacaaaattaaggcagaaatcaagaagttattggaaagtaatgagaacaaagagacaaggtaccacaatctcggggacacagctaaagtagtgttaagacagaaattcatagcactaaatgaacacatcagaaagctagaaagatttcaagttaaccacctaacatctcaatttaaaaaattagagaggttagggggcatcgataaacaccgggtaccgag

SEQ ID NO: 523015 - DNA, 165 bp, Homo sapiens
gacagccaatgtccggcgaatttctcggcatcacaggtaacacctcgacatccctgcggttccaagcctattcctcctggccatcacctaaactccctcgagggctggggcattcacaggtccctcataagtccacctccactcctcccctcctttgcccaccga

SEQ ID NO: 523016 - DNA, 120 bp, Homo sapiens
cttttacacatgaactctaaacaaccattgtctctgcagaagcatcaagatccaagcaagcaagctttagcagggaaggtcacttcaccatcaacattcatgcctcagatggctttgtga

SEQ ID NO: 523017 - DNA, 298 bp, Homo sapiens
gggttctctaccgtccagtatcactaatagtaacatggcggtacagggttggtagcctaggagcagtagaccggtatagagcctgggggttgtcataggctataccatctaggtttatggtaagtccagccaagggatgttcacacaagggatgaaatgggcctaacataacacggcatttgtcaggacataaccccatttttaagtgacacacgactctctatatgtatgctggtcctataatgggcggtacaaaaaatggaggtctatatacttccggagcgggtcagtcctaagg

SEQ ID NO: 523018 - DNA, 129 bp, Homo sapiens
tattaaatagcgatggatcaggctatccattgtagagaataatattggtaaataagataaattcaatttcttttctggaacaaaaattgaaagaagataagagaattaaaattataacaagtaaggcag

SEQ ID NO: 523019 - DNA, 122 bp, Homo sapiens
tctagaggatcccggtcaattgtctacactattcagcattggacagatatccggacagaaaatcaacaaagaaacatcagacttaatctgcactacagagatacaataagtgtttgtgatag

SEQ ID NO: 523020 - DNA, 828 bp, Homo sapiens
agaacttaaaaaggcagtcccttcctgggaaggtacttctgacttcagggacaaagcatcagtggaaccaatccagaaaagttttctcagtgtccaggccttcttatgtacaaccaaaagatggcagctggtgtttatcttttcccttcaaggccaggggttagcagctttatagataaggccagtcctgatcataaacccaatgcattgtacatagcagtccagttagcctgtcccttcctgccttaaatcctgatgcatgcttctcttccttactaatcaatgtccttgtagcttttttttcccagaagaggacactttcatctgcactgaaaacctgttcaggcaggtatcctttctcctcagtgattttcttaatggcatccgggaactcacctgctgcctcttggtcagcagaagctgcttctcctgttatcttgacagtttttaagccaaaccacttttaaaaattatcaaaccatcctttactggcattaaattctccagctttagatgcttcaccttcctttgctttaagtgtcatataatgacttgctttttctcaaatcatattagagtctacagatatgcctttcttacagcaatcctgcacccacataaaagctacattttcaatacaagattaaaaaggtattctgcaaaaatgtgcaaggttttcatgtctgctggtgtagctgtagtgatggcttcatgaatttctttcctttttgggactatggtccttacgctggattcatttatcttgaactggtgaacaatcaccagctgcagaccctcaattttatggtaccatatccaggcaattgg

SEQ ID NO: 523021 - DNA, 941 bp, Homo sapiens
  misc_feature (118)..(118): n is a, c, g, or t
  misc_feature (124)..(125): n is a, c, g, or t
  misc_feature (128)..(128): n is a, c, g, or t
  misc_feature (132)..(132): n is a, c, g, or t
  misc_feature (140)..(140): n is a, c, g, or t
  misc_feature (142)..(142): n is a, c, g, or t
  misc_feature (146)..(146): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (165)..(165): n is a, c, g, or t
  misc_feature (176)..(177): n is a, c, g, or t
  misc_feature (179)..(179): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (202)..(202): n is a, c, g, or t
  misc_feature (213)..(213): n is a, c, g, or t
  misc_feature (221)..(221): n is a, c, g, or t
  misc_feature (223)..(224): n is a, c, g, or t
  misc_feature (227)..(228): n is a, c, g, or t
  misc_feature (230)..(230): n is a, c, g, or t
  misc_feature (269)..(269): n is a, c, g, or t
  misc_feature (273)..(273): n is a, c, g, or t
  misc_feature (307)..(307): n is a, c, g, or t
  misc_feature (690)..(690): n is a, c, g, or t
cggcggatctaattttatttacaagtatacatttaacacaatgaagtaaacactgatatactgaagcctaattaggagtggggggacaatatacatcattttggggattacattattntaaacnncanactncactgaananttantgcngatnaanttcttggncataatattannanatacaatatatnantngagaatntgattgcttanaatttganannggnngngaactcatttggacagactcagagttaacataatctgangggnggggagctctgacccaaatgatatctttcaggtnaacagaagaaaaaagaagcatagtttatcttcaaggagaacgggcagtttgcttcttcaggtagaatatattcccagtgtcctcaggctttgcagcagaatcacatcaccgagcatgaagacttgccttgtgaagctgccccgtccattttttttgcctccaaaattatccttcgaaaaacatccacagcagtctgattttctttagcagaagattccaaaaaaagctgcattccaagattctgccaaagctttcccttcttcataactgatcacctgtggcggggggtaattaaagagagcactgggagctaaggtcgagaactgggggtcaaaggcctggcgggggtagcgatgaaactggagagggccctatgggaaaanaatggtgggggtccacggggggttgtcgggtgggggggaagacgttttagggatttagaggggggtctgggactaaggcagaccagggagggagggggggtgggggagggggaggtgggggggggtgggagagagaggggggagggtggagggggcggggggagggggagggggccggtgcacggtgggggagcgcgaaggggggggggaggggagggcgggggagggcgaggagggagggtggcggaagg

SEQ ID NO: 523022 - DNA, 944 bp, Homo sapiens
  misc_feature (121)..(121): n is a, c, g, or t
  misc_feature (127)..(128): n is a, c, g, or t
  misc_feature (131)..(131): n is a, c, g, or t
  misc_feature (135)..(135): n is a, c, g, or t
  misc_feature (143)..(143): n is a, c, g, or t
  misc_feature (145)..(145): n is a, c, g, or t
  misc_feature (149)..(149): n is a, c, g, or t
  misc_feature (153)..(153): n is a, c, g, or t
  misc_feature (157)..(157): n is a, c, g, or t
  misc_feature (160)..(160): n is a, c, g, or t
  misc_feature (168)..(168): n is a, c, g, or t
  misc_feature (179)..(180): n is a, c, g, or t
  misc_feature (182)..(182): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (216)..(216): n is a, c, g, or t
  misc_feature (224)..(224): n is a, c, g, or t
  misc_feature (226)..(227): n is a, c, g, or t
  misc_feature (230)..(231): n is a, c, g, or t
  misc_feature (233)..(233): n is a, c, g, or t
  misc_feature (272)..(272): n is a, c, g, or t
  misc_feature (276)..(276): n is a, c, g, or t
  misc_feature (310)..(310): n is a, c, g, or t
  misc_feature (693)..(693): n is a, c, g, or t
cggccgcatatctattctctttacaagcctacgttgcaccacaatgacatcaacgctgacgtagtgaagcctgatgcatacgatcgaaaccttatgcatcattgcgatgatggccttattntaaacnncanactncactgaananttantgcngatnaanttcttggncataatattannanatacaatatatnantngagaatntgattgcttanaatttganannggnngngaactcatttggacagactcagagttaacataatctgangggnggggagctctgacccaaatgatatctttcaggtnaacagaagaaaaaagaagcatagtttatcttcaaggagaacgggcagtttgcttcttcaggtagaatatattcccagtgtcctcaggctttgcagcagaatcacatcaccgagcatgaagacttgccttgtgaagctgccccgtccattttttttgcctccaaaattatccttcgaaaaacatccacagcagtctgattttctttagcagaagattccaaaaaaagctgcattccaagattctgccaaagctttcccttcttcataactgatcacctgtggcggggggtaattaaagagagcactgggagctaaggtcgagaactgggggtcaaaggcctggcgggggtagcgatgaaactggagagggccctatgggaaaanaatggtgggggtccacggggggttgtcgggtgggggggaagacgttttagggatttagaggggggtctgggactaaggcagaccagggagggagggggggtgggggagggggaggtgggggggggtgggagagagaggggggagggtggagggggcggggggagggggagggggccggtgcacggtgggggagcgcgaaggggggggggaggggagggcgggggagggcgaggagggagggtggcggaagg

SEQ ID NO: 523023 - DNA, 935 bp, Homo sapiens
ggcgtccgagggagcgcgcgacgggccacgccacgtcctggggcgtcaacatcttcggtggccagcttccgtccgagcgtgattgggtggtgtggggcagcctattcaggcagggtgtgcaaccaatctatatctgaggaccagaagccattgttgagggcaccagatgacttgtgagctctcccatctccatccagctgggtccagggtgccactctcatgcactcacctcgagcaggctgacatcatcaagcacgacttgggaacctggaagcaggtctggagaacctttccctgagtacatggagctgttggggccgaatgctggtggcgccctccttgtctggcccatgtggcaggatgtgggaatgtacccgcgaggctagtggccgttcagcgtcatgggcaatcccaaactacctctggcatgggttatccaagtgccatagaacatgggtcagacgcactggtacctgaggagctctttcgacgcaagaagggggctattcgcttgagggtcctcgggaaatccgagttgcagattaccattcagtggccgtcaatgtccctttgtcacgtcgcaacaccaccagttgtcaagaaggcctgaagggccccgcgcaactttgggaagccgcagacgccatggatcctctcttcaggctaaactaacagtgatggtattaccggggcacgcgtgagcgtaggccggatcgaagtgggccggacgcgaactgcccgacgttagcagcttaacaagtccccttttgggacacgacagctggcagaactttcgcagtgagggtcgctcaagcgcctaacggactgcgtgcacaccccaagtatgtactattccccggagagcccgtgaaatccaggacgcgaattgcgctcgagttgtgcgtgcctggacaagaccgtgtgggcccccaacg

SEQ ID NO: 523024 - DNA, 1319 bp, Homo sapiens
  misc_feature (1)..(1): n is a, c, g, or t
ngttatagatccttcttcatatctcgctgccttcccccctggtgaggaagatgataagtactcctgtgtggggagaggatgtcgctcaccaccccagcgagaagatgttgcgaattagtaaatttcttgatgaggagctcccctcaactctaaagattcccccaggacgaaaatgttgggggagcaaccccaggagattaaatggtgcatccaaccaggaaaataagtgggctgttaaataaggagttttggttctccgttctttgttgaaagttgcgcctccggaagttggaaattagccttgggggagattttctacgaagggaaaatgtgtttgtcacacctgtaagaacccttggggaaatgttgcccttcttcctgtgcccccacactttcgtggacagtctttggttaatatgacctcttccgcaatttttggcctgtcacccccgtatgtttccccccccctgtagtctttcgcgggaaagaatagaccacatttccccaaaggggccccccccccgctggaaactcccctcgtgaaacccctccccgaccacgttgtcgccaaaccctctttaaagccccctcgtttgttttttcccacataaataatagtattgaccctcatgtagttataagatatagaaaatggtaatataaatgtatgagccacataggccccacgaggagctttatattataagtaaaatggtaaatatggagacacaacatgagtgaacccactagcctatgtataatataaaaagtttaatgtgtgagaaatattgcgtttggggtactttcatccttggctttgccacacaaatatttctctcgctgtgtgtacacacgctatactccacacctcatcatggtttatgagagatgttgtggtgtgagacatacacacggtgataaccccacaagacgcaccaccgagataagcggagaacactcttggaatagaagcggggggcacactacctcgtatactctataggagaatatcacacctcaatattaccacataatgagattttatatttttatagaccccactatatttaataatttgggtattcttacctcaaatatatctttgtatataaagcccacttttttgtgtccacttaacctgagctcttttgttttattgtataagtaatttaacaccacccactataaagggtataaattgcttcccccaaccaccacctctttaatccaaaacctagaatcatctgccgtccttgttaaaaatgcaggtttttaggaccctctgaagttctgattaaataaatttattgccaacccca

SEQ ID NO: 523025 - DNA, 449 bp, Homo sapiens
taaagcagtcgtgagtggtaaaacctggcggggcatttggcgaaaccctgtcttacaaaaaaaatacaaaaattagccaggcatggtggtgcagcgctctgtagtcccagcctctagggaggctgaggcaggataattgcttgagcccacgaggtggatgttcgcagctgagttgagattgcttcactgcactccagcctgggtggcagagtgagactctgtctcgcaaaaaataaaatacacaagaaaataaaaaaaggccaggagtagtggctcacgcctgtcatcccggcaatttgggaggccgaggtggtggatcacttaaggtcaggcagtttgcgaccagtgaggccaacatggtgaaactccatctctgcaaaaaaatgcagaaaattagctgggcgtcgtgcctagttcctgggttgcttgcaactcaggatgcttcttga

SEQ ID NO: 523026 - DNA, 685 bp, Homo sapiens
  misc_feature (58)..(58): n is a, c, g, or t
  misc_feature (80)..(80): n is a, c, g, or t
  misc_feature (130)..(131): n is a, c, g, or t
  misc_feature (144)..(144): n is a, c, g, or t
  misc_feature (154)..(154): n is a, c, g, or t
  misc_feature (165)..(165): n is a, c, g, or t
  misc_feature (169)..(169): n is a, c, g, or t
  misc_feature (210)..(210): n is a, c, g, or t
  misc_feature (225)..(225): n is a, c, g, or t
  misc_feature (227)..(227): n is a, c, g, or t
  misc_feature (274)..(274): n is a, c, g, or t
  misc_feature (302)..(302): n is a, c, g, or t
  misc_feature (308)..(308): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (327)..(329): n is a, c, g, or t
  misc_feature (340)..(340): n is a, c, g, or t
  misc_feature (344)..(344): n is a, c, g, or t
  misc_feature (370)..(370): n is a, c, g, or t
  misc_feature (372)..(372): n is a, c, g, or t
  misc_feature (386)..(386): n is a, c, g, or t
  misc_feature (389)..(389): n is a, c, g, or t
  misc_feature (400)..(400): n is a, c, g, or t
  misc_feature (418)..(418): n is a, c, g, or t
  misc_feature (422)..(422): n is a, c, g, or t
  misc_feature (437)..(437): n is a, c, g, or t
  misc_feature (659)..(659): n is a, c, g, or t
gcttgtgaagagggaactaaaacatgagggcatctaaggggcattcatgggagaggcngctgacagcacaaacaaaaagnggatggtcagtatggatagagcaaggtgactaagagaaagagtaataaannacaaggccagagnggtttaagangtggtgtgggnaggnagatcattacagggtcttaaaaggccttataggtaattgcngaggtaaagattttnanacaaccattatcacatttctaacttcagttatcttaaaatgatggcngctgttcttgtctttgtttcccagtttnaactgngcncnctgttattntaagnnnacaaaaatttnaagnatcagatatatattctatcacccccncnggctccattttgcngcnttgtgtttggngggcattaggtaggtgtnaggnagtgggtataggggngggtcaagtaatagttatagtggtcattatatctcttaatgcactcatattcttttaacatttttaaatggccaaaacagctacttttaatttgctcagaatataaaccacaaatttttaaaaatgaagagcttccaaaataaaatacattttttcagaaaatagtattttcaaatttaaattagaataaagtacttcaaatgattcatattaatgtagganaaaatgtagaacttaataaagaaagc

SEQ ID NO: 523027 - DNA, 440 bp, Homo sapiens
gactccgacactctttccttatcatgcctcataggcccacacacattctaggctgagaccttgttagccaaagtcaaagcttctatcaccttttcttgcccccttcaagcagagtcccctcctgctcctctccgctagtccggcccctgagccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctggtcatgcagtcttcttagaccaacacactctccatataacacccctatcctccctgttaaaaagtctgatggctcataccgactcgttcacaaactccaagccatcagtcaagctgtcc

SEQ ID NO: 523028 - DNA, 1398 bp, Homo sapiens
  misc_feature (812)..(812): n is a, c, g, or t
  misc_feature (873)..(873): n is a, c, g, or t
  misc_feature (1103)..(1103): n is a, c, g, or t
atttctcctctctctacaggggggggctttcacataggtatatatccttttcgcgtcttgtttgtagagattttcctcgtgtggggggcttaacaacaaaatgcgtagcgtggggagagctcttatataaacacctgtgggtggctccaacgaccgcctttttttctcccccgcccaaacagaaagattattgtggggggagttttttagttcccacctgccgcctcctcggggggggtttttttgttcgtggctaggaagagtttttttggggggggacccacctcctcttcgcaaataattgttgggtgctccactcctcccccgccgcgtaaaagaacgcggtgtgttttctataaaaccccggggagcgtcctctaccccgcacagagagttgcgcgtttatcagcccacattgtgtgtcctcgtcgcacaaatcaggggggtgatattatatgttggaggagagaagattaattagaggaaaatatatttgtgcccggcccctcctcctcgggcccacaacatgggcgcgcaacccagctccctctacactgcgcgagctatagcggctctctctcgcggcgaacaactctcgtgagaaatatagagccccgcctcctctcgacgacgatagagagagaaaatagtggtgtctcctcctcagaagagagctcgtgagatgtgtctgctgagagattctcacgcggcaccctgctgcgagatgtgtgtggagagagacactctttgtgtgtgcctcgcgagagttgtgtgggagcaccctctgcgtgagtgttgaagagaggtttganacactctgtgtgctctccctctctgcgcgtgagttatacacgctgtgttcacacagcgcgnctgctgagagtagtgtgtttctactgggagtattatctctctcagcagagagagctctggggcacacagagaccacacactctggtgtgtgtgtgtgtgtctctgctcccggcgtgtctctctctcacaggcgtgtgtgagagataagtagtccacacacccgcctggagagagagacccacagctgtgtgtcctctcttctatatagagctgagagagatgtctcttgnggcgcacgagacacacccctgcgcgggtgtgtgatatactctcgtctgttggagagtttgggagaaccggtgtgtgcacatttatcgccccggaaaaggatattcactttttaaatttatatgtataaggtgttttttgtggaaccccacattttcgagattttttgaaagagagagatgaccacacccacaattttggttttttacctggttataggggggcaccctaggcccccccccaccccgcccttggtgtaagggaaaaaaaaaaggcctccccgaaccccaaaaaaaa

SEQ ID NO: 523029 - DNA, 317 bp, Homo sapiens
  misc_feature (116)..(116): n is a, c, g, or t
atgaggtgtggtgtggtgtggtgtggtgtgtggtgtggtgtggtgtgatgtggtgtggtgtggtatggtgtgtggtgtggtgtggtgtgtggtgtggtgtgctgtgctgatgatgntgaggtcatgagcatgggataggaaggatgttgtgctgatgatgctgaggtcctgagcatgggataggaatgatgctgtgctgatgatgctgaggtcctgagcatgggataggaaggatgttgtgctgatgatgctgaggtcctgagcatgggataggaatgatgctgtgctgatgatgctgaggtcctgagcgtcgacgc

SEQ ID NO: 523030 - DNA, 769 bp, Homo sapiens
atggcacatgcagcgcaagtaggtctacaagacgctacttcccctatcatagaagagcttatcacctttcatgatcacgccctcgataatcattttccttatctgcttcctagctcctgtatgcccttttcctaacactcacaacaaaactaatctaatactaatcatctcagtacgctcaggtaaatagaagaccgtctgaacctatcctgcccgccatcgatccgtaggtcctcatcgccctcccatccctacgcatcctttacataacagacgaggtcaatcgatcccttcccattgaccatcgaaatcatattgggtcatcggcaatgtgtactgaatcgctacgagtacaccgactacggtcggactaatcgttcaactcctacatacttcccccattatgcctagaaccaggcgacctgcgactccttgacgttgacaatcgagtagtactcccgattgaagcccccattcgtataataacttacatcacaagacgtcttgcatctgcatgagctgtcccctacattaggcttaatagatactagatgctatttcccggacgtctaaatcagaggcactttcaccgtgtacacgaccgggggtatactacgtgtcaagtgctctgaaatctgtggagcaaaccacagtttcatgcccatcgtgctagaattaattcccctaaaaatctttgaaataggggcccgtatttaccctatagcaccccatctagcccctctagagccaaaaaaacattgaatacgta

SEQ ID NO: 523031 - DNA, 423 bp, Homo sapiens
gaccaagctggcaggatactgtgtgggtatgtgtctgaatggagtgctgtgtgtgtgtgtgattccagctggctggggtacgagtgtgtgtgtatgtgtctggatagggaactagtgtgtgtgtgtgtccggacagctggggaactgtgtgtgtgtgtgtgcgctcagaaggcgagtggtgtgagtgtgtgtgtgggtgttcagtactgttatgtagtaccgtatgtatgtgtgtgaacaatatgattagattgtgtgtttgtagtgtgtagtgtaagtgtaaagggctggagaaatgtgagagatcagccccatgatctaagtcacaggtgtccactggctcatgaatcgactatattctaaccaaccactcaaatctgtctcatcgaaaagtagtctgggtccgggaggcttgggtgtgtc

SEQ ID NO: 523032 - DNA, 166 bp, Homo sapiens
tggggggccctgggcctttttcccccttttttttattttccaaatttaaattggggtttcccttgtggggaccaaaggttaagcccccccccctggtgggggggttggttttgggtgccatgtggccccccgaaactgccttttattaatggaagggccggcttga

SEQ ID NO: 523033 - DNA, 242 bp, Homo sapiens
tagtgctgggattccaggtgtgagccacagacccagacctggataacttttatcattggtctgaactttttccatagaagtaaaaggtttttaaagggctcacagtatttttgatggctccaaagctccatgttctaccacctgtgtttgggtctacagaactccacctcaaacccctggacagaaatctgtcttcagcagttggttacaaagctaataccctggtagcttagaaaatagat

SEQ ID NO: 523034 - DNA, 268 bp, Homo sapiens
  misc_feature (120)..(120): n is a, c, g, or t
cttcggcctgggtttaggtgtctctaatcgccctcacctgcacttgtgccatcgcacactcaaggcttaggggttgaggaaggagtgctggaagggcccagaaggcagagcactggtgtntgcactatcaggttcaaagcccagaaaggccaggcatggagtggctcacgcctgtaaatcccaacgctttggggtctggaggattgcttgaggccaagagtttgagaccagcctgggccaacatggtgagcccctacctctattaaaa

SEQ ID NO: 523035 - DNA, 415 bp, Homo sapiens
ctgttcatggtttgagacatctaaaacaaaatttaaaaagagaaaagcatacagatgtatttaatataggtatatacaagaacatgggaagtctatcataaggaaattaagatagtaaagaaatagttaaacctatagatattttatgcgaggtttgatgacaagtagacagggagaaattgacagggcgggaaacagtataatctaatggtaataaactagagaaaacttggcaaggcttgtttattcagattatatctactgtgacccttacatcttacagggataaggaatattccttatcctctcggtataagggagggcacctctcacatgagggtcttatgacttgtttcagggcaaggtcagaaaatccttcttaggttttatagatctgcttcaggggaagaagagt

SEQ ID NO: 523036 - DNA, 184 bp, Homo sapiens
ctttttgggggaaaatttttcgcccttgtggttggaggcccgaggccttttggaatttttgttaccctgttcaaagcccggaaggagactgccccgtttttaaagccccgcccgtcaggtccgggtttgggtttccctttttcccgcctgggtaagcttttataattaaaatggttttccggga

SEQ ID NO: 523037 - DNA, 1286 bp, Homo sapiens
gcgacggcgactacagctctccaggtcaagtggtcagcaaggaggggggtcctgtagaccggcggctggcaggatggtagtggttgcagcggtagagaaatggaaacctccacagggcacgagacatcctatctaagatgtgagaacgtgtgcatgagctaccagtacagcacaaaggcgtggcgagcgttgcactcccactggactgcccggaggcaagcacggagtggcccttctagaagtggcaacgaagtactgcacatggatgcgagtagctatcagagagtgtgcgtgggtgaagcgagagccatctgcgcagccaagtgagcacgaatggatcaacacatacccgtgcaagaatagtgcgtgactcatgcagagcgagtaggggctgctgagtcagtcatttgtagccgtgcggtctacctgtggagctcataattctactagtcgaaggcattgcgcggagaagagactaccgaatccaggcattgccttggatgcccgcgtatgtggacaccgcatatcaacggaggctatcggaacagtagtaccatgtgagcaccgtaccgatccaacgcagtgcaatgacagcaaaggtgcttaatggcacgtttcgtgtgagctaagtgaagagtacccccgaagaggcttgacgtagaagggatggtggcgcgtttgtggaaggcaggaacattgagaaactacggggaatggaattgccaatagggacgggggggccaccggggaaacaattcaaagtaggttggagggacaagaccgcccaaatagaaaggcaattcagggggaccacgggtgccgcaaggtgctaccaaatctattaaagaacccaaggttgtgggcacatagcacgaagaaaggtaccccatggggtgatcaccttgtccaagaacccggtgcacaattccttagacgataggggaccgttccattgtttgtacacaccacaaaggggaacccattccttccaaaggaaccagaaattggaaccaatttccaataagtgaaggcagattgtgatctatgggaacggggccacataaatggggacaaaaggaaaatcgaaaagttccgtaggcgaaagaaccatgagcagccccaggagaaacccaccagagaggaacttggggaaaaagacgacacacgggtggaataacagtaggatatcaaatatggcaagtaaacggaaccacgcgcgcccacgcgatcagtagcaagacaagagtggctaatacgaaatagcaccaaatggaacaccagcaata

SEQ ID NO: 523038 - DNA, 377 bp, Homo sapiens
agcatcctatcaccctaaatttattatggatgatataaaacttaactcacgaaagtaaggcaggtgcagtggctcatgcctgtaatcctagcactttgggaggtcaaggcgcgtggatcacctgaggtcaggagttcaagaccagcctagccaacatggtgaaaccctgtctctactaaaaatacaaaaattagccaggcatggtggtgcacgtctgtaatcccagctacttgggaagctgagggagaaaaagcacttgaacccaggagatggaggtttcagggagccgagattgtgccactgcactccagcccaggtaacagagcaagactctgtcttaaaaaacacaaaaacaaaaaaaaacaaaggttgaaaaa

SEQ ID NO: 523039 - DNA, 467 bp, Homo sapiens
  misc_feature (405)..(405): n is a, c, g, or t
  misc_feature (442)..(442): n is a, c, g, or t
  misc_feature (459)..(459): n is a, c, g, or t
aggtggacgggaaaatactggctggaggtctggcagtggtttcctggtagaagacacccttcaacttaaccaggtcaccagattggtaccgggctcttgtcacagttcaccttggggtgtgcattgaattctggtgcccgccaggcagacaggacaggtcacagagagggctaaggtatctcctggcgtattcctggtcagagggtgtcctgggtccaggggtccccttgggcctaagctagggaacagttgggtcacaaagaaatgtcagggagacgccagcattaaaaaaagagagatgtgtttattccatgatcagtacagaccaaatgcatattcaccgtatgaaagtcaaaccagtcagtgactccagagtttggccaacactgagcaccagcgtcgtgntgtagagtggttctcatgcacgcgtaacctcacctgngtctcattcggtaaganctcgatcc

SEQ ID NO: 523040 - DNA, 602 bp, Homo sapiens
ccccccataaaataacaccgcagggggggcgggaaacaaggcaattttttctttaaaaagcgggcacaaaaaccaaaaggccccccaaaagaaaacccagtgtttccaaacacccccggagaggagccccccccagggggggcaggaacccccccccaatatcacccccccggccaaacagggggggttcccacaccattttcccccttgggccccgggtttttttgtccaaaaacacagagtttttttttctttttaaacaaaacacccccccgtgggggaaagaaaaccccccttaatttctccccatcggggggcaaaaaccggcccctttaaaaaaagccccaccaccccaggcgcggggagcccccccctttgtaaaaaaaactcttttccccgggggtttcaaaaatttcccccggggaaaaaaaaaacccaaatttgagtgaaaaaataaaaaaggggttttttttcccccctggggttctttcggggaacaaaaaatcccccccccctggggggcaaacgggggttttttagaaacccaagccccccaaaaaagggtttttccccccggggaaaaaccaaaaaccaacaagaca

SEQ ID NO: 523041 - DNA, 131 bp, Homo sapiens
aggtctgtccgaaagaattgcaatcacagtagaacgcgtgtcttttcagtctattcgtgttgctataacagaatatcacagactggataattcataaagaaaacacatttatttctcacagttttgaaggt

SEQ ID NO: 523042 - DNA, 318 bp, Homo sapiens
gttgaactcttccctctgctgaagctcctaatggaaaaagcttttttttggctgtgacccttttgaactgaatcagaccaactggaatcccagaccgagtttgctttttgtgcctagttgaacggcaagctcggcatttgttggttacaagatccagacttggggtgagcggtccccagcccttttcatgttccgaagggtagttttgaggccctggggccgcccttttagcatgttggtttcctttagtgggggtatttttaatgaaaaaaaatttgttttttccagcatgaaaaacatttagtttcctcaaaggga

SEQ ID NO: 523043 - DNA, 112 bp, Homo sapiens
tctccacccacccctagggcatctgtgcatagaaaccaccactcttgagctggtatggagttggagggaggggtagctcacttaccgggtggggtttccagagccagaggag

SEQ ID NO: 523044 - DNA, 1935 bp, Homo sapiens
gaagctaccctgcacaccctgcacaagcaactagagcactcaggcgccatcacggacagaacccacaacgacaaaaggcacgaccacgcaccgcacgctgaaaacaagaccgcgacaaagaagccaagcaacaataaacacacaccacacacaccgccaccacaaaaccatacacaagaaaacgcacgcggaaccagagcaaccgccacagagccaaaatccacctcgccctaccaactaccacagcgcacaccgacacagaccaccacgaacaagaacatcaacccacaagcacaccaacaccagcagcgcaacagcacccacgcgacgcagcacgaccacatacaacaaattcctctaacacactcaccatccactcacccatcagccaccacctcccactaccacaacatcacattccaaaatcaccacaccatctactactttcaatactctccattcacccctcgacaccatcatccccacatcataattctaacttccatactccataacaatcctatcctcaaacctaacaccacaccctccaacccggctccgatagacacccacacacacgccgccaaccctacgaccgctaccgccgcacgacagccctcccaaccagcagcaaacgaagacacaccaccacaccacgccaagacacccaacgccgccaaagcccacatcacacacccaccaccacacaacctaacaaacatcgaccacagacgacacgtccacgacgcatccaccagcacaccataccacgcaactgggcaacactcgaaacccgacctgtcacccagcaggcacagccccaggtcagactaccaaccaacatgctccgcgacagcagcccagcgacagccacaggccagatcgctcgacccaacgatggaacgataaccctacagatcagcctatacctcagcaacagacagacaacgagccgcaccagtcagccgtacgcaacagcaaccacaccccactggccagcagacagcgagacatctagagccagcagatgaccacccacgcacacgctgagccctcacgagcacagcgaagccaacgcatagttagagccagagactaaccacaacacaaccgacgcgaccacagggagcgaataacaaaacgaacagcacgccgagtaggcgagctagcggccgcccgcgcacgcaccacacgacagcggacgatagccactaacgaactacgacgaacacagacctaacgacagccgcagagacagagacagacaccacagtccaacagagtacgccagacgtccccagcagaccaacagacggactacgaacgcaggtgcactacctcgccgcagcaagccacgaccgtcatggcaacagcaccacacacagctcacgccagcaccaacgacaacagcaagcaaccgacgcgaaaacgcccaagcgccggatcacacagacgccacactgaacagcaccgagggcgagtcagagacgaaacgacagacgcacctgatggacggtgaagagatcacagataccgagacgacaggagcgagcagacaggagacacatcaccactcacacacagaagacatcaagacttacgacgagcccgtgacctcacccactcgacgacagaacacacgcaagaccggctgtgagaccgccacgcgacgaaccgccccgaccagacacgatcgacctcaacacccagaccgcacgcatcacacgcaaaaatcacgaaaccggacgcgaaagaccgatcgcagacgaacagactcatctcgagagacaggagagcacgagcacgaatgacaaaacgagcacaccggacgcaacacaccgcagacgacagccgggcacgagaggactgaccaaacgacaggacacacacgtatcaacgtgaacaggcatcggaggcgcagaacgggacagaata

SEQ ID NO: 523045 - DNA, 923 bp, Homo sapiens
  misc_feature (124)..(124): n is a, c, g, or t
cacaagtggatcgatagctgtacatcccagcatttctgtcgaggccaaagtaagcgagagtcacttggagagtcagtgcagtttcaaaggaccaagctcttgtgtgcaaagctagtggctgtanaagcgccccatgcttcctagcttatgagatatgaccaataacaattagacttgtggtgatgggtgtgcatcagtgcctcagtctcagatccgcttagccttcacatcaggatgaagtgcccgtagagttaggtcataagatccattattgaaacgcgccttggaagagctgtgaagagtttccactggcgcaagcctgaaagatcaagttgcggctacttgcatactcgatgctcttaggtgcggactaagaagttgtagacttcccagtttcgtcaattgattaaagaagcccatatatataacaaaaaatggcttagtaattgataataaactgttaagccgagtagccaagagggccacgccaagaaaataccacgcaatgtagcaaattcccttctttctttattaagagttcagcgaaggcttacacacgctttgtgcgttggacggttgaccttggggagccatcacccaaggggtgcctccttccgtcgttaaaggaattccaagcggcgagcattaataaaaccttttccgcgcgcggttcgaaggcatttccttccttatccattgagggatattgaaaagggacaaccggcagggcgcgattcatattaaccattcccggagtttggtgtgcggaaaaaaaggaaccttttccgggatgacgtggtgacaaattggccttgttgacccctggaattgaacatggcggtggggacccattttttacaggaggtggaattgctcctaggtgtcataaatttaaccacactttgaattaatatttataagcc

SEQ ID NO: 523046 - DNA, 224 bp, Homo sapiens
gagtttttccccctcttttgccactgaaatatgatggatatgcttaaggaccactgatggcatgaaaaaaatccaatttttgatttattataaatgaatggtggccctgaacttagctaaatggggcaacttagtttctccctgctttcatattatcgaatttcctggcttataaacttttttaattacctttgaaatataaacccaatccaatatttttctga

SEQ ID NO: 523047 - DNA, 924 bp, Homo sapiens
actgcttatctcgaccagacagccccagacattatagcgtgaccggactagtgctagctagttagtcgcatttctcttctacgtctatcaagatctcccaggtaaataagggactctcagctggaactactacgacaggttgctggggatgagcagggggagaagaacaatacattagatttagaaaataaatcctgaagggatggagtaaccttcttcaagtctcaagaaaaaaaaaaaaaaaaaaaaaaaaaaaaaaaaaaaaaaaaaaaaaaaaaagagaaaaaaggggggggcgggcgagggagggcacagggggggggccaggggcacccggggaggacgagccacaaaagcgagcgacgaacaaatacaagtagacggaatataatagaaccggacgaagacaaagaggagacagataattaaaataaaacagcaaaacacagcgggcgagaaaaaaacacaacaaaccagaggagacacaagaggagcaagaacaaccacgcaaccaaagcgagggagggaagaaaccacaacacacgcgagacgacagacaacggaacaccgacacggacgacaataaagagaggaaaccccgacacagaagaaaagataaaaaaagaaaaaaaagataagaaagagcagaaaaaacgaaggagacaaaacaaacataaggccgggaaccagagtattgatggcaggaagcggactgttgtgcatacaaagacagaggtatcgagcgaacacacgagaggacacaatcagaatacagaaagacaaaaaacatagatgaaactcacgcagagagaggaggaaaacggcgaaaccagtaaaacaccacaacggcagagccacagaagcaaccaacaaagagacgaaagaagacacgcagagacaaagaaacaaaaaagagaaacacag

SEQ ID NO: 523048 - DNA, 365 bp, Homo sapiens
atataaataaaagcttccaactgtctcacttgaagaagctacagtctaaccagattataaactatagcaatggccaaccctctgaggcaggtgctgaggatacaagaaaacacatgtgctaaagatacattataacactgccaaggtaaataaaggtcagtgaaaatccatctatattattcctgtgataataagaagccctgacagaactaccccattcaaattagtcacagccaaaggacctatgcatataccaaagaaaaggatagaaagatgagagtaccttttgagaagttattcagaaaacagaaggaatttccaacaaaaattctcactttcaaaacataaatggtttttgaatcaag

SEQ ID NO: 523049 - DNA, 160 bp, Homo sapiens
tctagaggatgttatacccaccgcgctagtaactcggggtgatatccgcatctgcgtgaggccactagcgcacatggcatgcctggatggacaacatccgggagtggtgcatttccagcgcagctgtggtggggactatcgcaataccatgcctaacttt

SEQ ID NO: 523050 - DNA, 352 bp, Homo sapiens
attataccagaacaggcattatacggtaggaaaggcgcctccgttcggtggttcttgtaggtcgtgattctgactacatgccaggcggcagtgcatgtggcttccccagcacccagctcctgaagcaccaggcggtcagcagctgcccttggcaccctccagccctcagaagttgcgtaggagacacagcgcctccactgaggcacctctccgggaataacgttccccagcaccccaaatggatttccagtcaattcagaagcattttaccagtgaagccctcattattccagttcactgttaaagccagtaattctctatattaaactttccctgttcggtttatactccg

SEQ ID NO: 523051 - DNA, 359 bp, Homo sapiens
cgcggctgtgctgccaaaagtatatcgacgccgtttaggccgaacagcccctgatcggtgacgctgtgcatcacatctaatgaaccactttcctactcaccaacgcaccgaaatccttcgttgtggtgatgccaccataagtatttttaatatataaactacccgctccatcattggagatactcaggttgctcgtggactcctgcacgtatagcgtattattgcccgaatcaccgaaaataacatcataccctcccgcatcccgaaaattttcattgccatctcggcgttctagatagtcgttgctgatgcaccctgaaggttgtcactagtgtctgtaccgatgataaaagtactat

SEQ ID NO: 523052 - DNA, 229 bp, Homo sapiens
gtcgcaatctatacgaatccaggagaaattagatcaggctccgatctttccgacttctttttaagtaagcaggtggcatgacgtatcttatatattatgattagtaataagaggttaatgccaagaaacaaaacaaaaagaaaacaaagagacgatgtttggtcgtgaggctgtcagtgagctgaggctaaagaagttcggtagtgtggtccccatgacccacccaacc

SEQ ID NO: 523053 - DNA, 341 bp, Homo sapiens
aagggaatgacccttacttccaagttattccaaatctggggaaaagtgtgaatgccaaaattctgattattctcactcgggccaagttaaaatccattgataaaaccaccaacacttctacataaccactgtctaccatctgctgatatagtccagaaaccaaacctgcaaaccagtattccttaaagaaatccatagtctaaaccagaagattcgcttgaccttgggtattttttttagtagacacggggtttcttcacattggtcagtctggtctcgagctcacaacctcaggtgatccgcgcgcctcagcctcacagagtgctgggatcacaggtgcg

SEQ ID NO: 523054 - DNA, 427 bp, Homo sapiens
tataagcaaccaagagacaaaaaaaaaactgaccaaagagtttgcatgaaaagcactgcactcaggaggaaaatatcagcagcaaagtacttttgaagtgtggcctgctcagctcacgctctgccccctctgcacgcaagtaccggctgttgaggataacctctagccagcacgggcagctgctggatgaactggcgggtgtagcacaggccacagcccttcacaaagctgatctgcacggtaaagcccgtccacggctgctgcataaactcgtggtcatggggccgctgcaggctgtacgccttctcgtagtcgaaagccttgatggagaaaccggggaacaccttgtgtaccaacagcgtcctggagtccgggttgtccagtgtggcggacttgatgaagatggggtacctggtgtaacctgatt

SEQ ID NO: 523055 - DNA, 290 bp, Homo sapiens
  misc_feature (256)..(256): n is a, c, g, or t
taagatccagccgaagggaggcctgcttcgaatagtctagacacaggctcagctcaggttgatggggatattctccggctgctctgcacggctcacgagccagtccagacacgctactagtgctagggttgccgctgtgcctgctccagggagcaacagagaggcacaagcagaggccgtgtggctgaggatggagccgccccagccgactccaagccgcagaggcagacgccacctggattgtctcctgcccagntggcctctctggcctattcctaacccttttccca

SEQ ID NO: 523056 - DNA, 255 bp, Homo sapiens
ggcacgagagggcattcttggcacacagctcttcaacaagtttgcactgcccttacatccgctgatgtgtgcccaagcaagtgtaaggccagggtttgcgggaggcagggcctggcaccagtgcacatgatcatctttgttaaggatgggcatttgctggaggagtctggcccaagctggctatgaggtggttgggcttgactggacagtggccccaaagagagcccgggagtgtgtgggaagacggtgacattg

SEQ ID NO: 523057 - DNA, 235 bp, Homo sapiens
tgggagaccggagactctgtctcaaaggaaaaaaactcaggtgtgacataaggaacttctgagtaacagacatttctatgactcaggacattccaagtgtttgggaagctctatgccaggaaccggggacaaagaccagccaaattcttttcaaaattttatttatttggctgggcatagtggctcacaccggtaatcccagcactcggggaggccaagtcgggcagatcactag

SEQ ID NO: 523058 - DNA, 175 bp, Homo sapiens
ttagctctggaacagggggaggtcccccccaagagaccccaagaagaagaagaaattctctttcaagaagcctttcaaattgagcgggctgtcttcaagagaaatcggaaggagggtgggggtgattcttcttggctccttcacccaacagagggaagagcagtgagccaggggg

SEQ ID NO: 523059 - DNA, 1386 bp, Homo sapiens
atggtagctgcctccgggtttatacccgggatatcgtcgacccacgacgatacgacagcaacacctccttgttctaggccacctgtgggagcccaagccccccgcaggctgagtgccctggcgccagtggtagggggcagcttctgtggaacgctgccaggaactggatgcggagtgggccagacctccgacggccacccacaccagccccgatggcccatccagacggatctcggaactcccctcacaccatcccaagatgacgctcaatgaaacttccttttgaacaaagcagctgccatgatgccttggagcatgccactggtcctggcgggactcacgtgcctccctgactatcctgctggagaaccccgcggattcaccggccaggccctccttgccacaccatggtatatagtcactaaggtccccaacattaccctactttcactagcaaccccaaacatcaaccctaccccactaaaacgtcactcactcgccaaaaacaaaaacacacaactgagcgccaccacacccacagcgactacatcgaccacgtacggaggcaccaaggacgtcaaaagagatcaaccaagcgatctcacatgtgaccaaaaaggatgcaacccacgaactagatagggacacggcacaaacatacgcctacagcacacacagcaccgacaacgaacacaccaacacccaccccctcaccccttccccacactacccgtgcaactacacaccatctggcaccacccctatctccaacatactaacccactataaacacatctgacctgtctgcatgaccacctacccctgtgcaccccaaatataaacccataaccacatgatctcataaaacctatcctaccaccgcacacaactaatcccacttctattaacaccttccatccacaccaggcatcccatcacatcactctcttccacatcatcccatcccacgcaactagaaccattatcactgactaccttaccacccccaactcaccacaccaccatttccaacccaccaccacctcatcgacactcaacccgcaatagtcacctcaccaccacacaccccacacacaaaaatccataccagcaccacgacagattcgatcgagcgagaccgcaggcggaggctgagcgagcaagaagccaggcgaaaaagcatagacgcgagacgaagacgcgagaaaccaaaggcgcaacgagacatgaggcaacacagggcgcccgcgagcatcgaagccgagagggcgcaaccacccagacaagaagaccaggagcgacgacgggcaaacagacgaccaacgaacacacgaccgccaccgccgcggcgccaagcgccaagcaccccagccacgcaccactcgg

SEQ ID NO: 523060 - DNA, 111 bp, Homo sapiens
ccgtcgctattcatcggcactccacgtatgagggttggtgtaaaataagcgtaggtagaattagaggttaaggggggtgatggtggctatcattgtgccgtataatagcga

SEQ ID NO: 523061 - DNA, 155 bp, Homo sapiens
ctgcttagagcctcgtgttcgtgctaatctgtctctgtactggatactcgtcgtcaggtactcttccctggctgctgaatactctcgaagtgcttcagcctcagaactcctgtctgttagaataacccatacatgtttctcacattggtacgcca

SEQ ID NO: 523062 - DNA, 532 bp, Homo sapiens
accattaagtcagtcagcttttatacccggaaggatgggcagctaatctataccccattcacagaagataccgagactgtgggccagagagccctgcactcatttctgaatgctgccattatgaccccggtccttggtgtactgactaggcttgcggtggctctgggtgactactagaccaagtgtgtcaaatccctctgtctactcattcttgattatattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggcttatcttggctgtgatgtcagtatatgatctagtggctgttttgtgtccgaaaggtccacttcgtatgctggttgaaacagct

SEQ ID NO: 523063 - DNA, 435 bp, Homo sapiens
agacacaagacggaagttttttagctgatgagttttgccctctctgaatacagaatccgtggggacgatgatgagtggagtgaagctgagaacaaagctgggccgaacgcctcgatcatcatgcttaaaagtgacaagaaaaggaaattacaggccaaacaagaacccaaacagagcaagaatgtgaagaacagagagacggagaacacaaatgatatgaaactgagtcggaagaaatagtgaagagaaactcaggcatctgtgtctgatcatgggaagatacttgcactaacgtgaactctctctggctgtactgctgcaacgagaggacacggcacacctggaagctggccgagagttaaggctctgagcctgtgggtctgggagtctaaccttgttaaaggcagagatacttcctggtattgatagcttggg

SEQ ID NO: 523064 - DNA, 402 bp, Homo sapiens
ccaaatgcacacgtgacccaccatccctgtctctgacagtgaggccacccgtgaggtgctgggcctgggttctaccctacggagatcacactgacctggcaggggatggcgaggacaaactcaggacacccgagcttgtggagacccaggccagcaggagatggaaccttccagaagtgggcagctgtggtggtcgcttctggagaagagcagagatacacgtgccatgtgccagcacgaggggttgcggaagccccattcaccctagagaatgggcagccatcttcccgagcccggccatccccatcgtggggcatcgttgctgggcttggctgtcctagggctgtcctacagctgtcctaggagcttgttggtagggcaagtaggtgaatgtgtagggag

SEQ ID NO: 523065 - DNA, 949 bp, Homo sapiens
ggactcgggctcctgcagcttctgcggggcttggagccgccgtccgtgagcacccaggccggggaccccacatccccaggccagccctgaccccggagggccctccgccgggattcctttccgaggtactgtgtgccggcccaagacggttgcagcgcttatgtcgtgtccgcccctcagtgatcagctccgggtccccctgcctcggcccaggcgcccaagcgcagtccccgggaagtgcgcgccggggccccagcaaagagtctgagacagccaactgggccaaacaatgttttagaacctactactggctgatgccaacatcatcagagatgaactgttccttcaccaagaaacacttctcgtgctgccctgatcaaccccgaagcttctcactcaaggaacacattttggccagagcagatgcacgcacgaaggggggggcatttcagcgcaaccagggacagcaggtgtgacccagagaagcatgaagagaagagaaccgacggagcactggccgccgttggataccagcaaagacagccttccaggagggtccccatcctggattgtcccccgtgaagggctgccctcaggcaagaaggcacacagaccggtggagaaggcgcttgggcccagccaacaatcctaagagggcctatacctttgtatccgcaaaatcctggaagcgaacagcccgggcacatgacaggccgcgtgactagggcagggacgcgacctgggtggccggcgcaacggaaccctaggccagcacacaacgcagagggggcaccaggacgaagcccgcaggacggagcaccacgcacccgcagcgacacgacgcacgacgacaaccagcaagcaccagcgaacacgcggcagcacactcacacaagtacacccgaggagaagacagagacagcgcgaacacggaagtacaaaggcacac

SEQ ID NO: 523066 - DNA, 495 bp, Homo sapiens
acatagactccagtacctctgatactagaaaactagataccatccaacatgtgcaagataaacattttattgatagtatggtttactgaccaatagacttacttctattctaccttcctcttctcctctccgcgcctggcatctcacctcttcccacctctccttcctccatcccttctttcctttctacttctttactttctttccttttcttactttcttttccttttccttcttatttttcactttcccttccttctcttcccctaccctcatctcttctactctgtaatgtcctcattatgtaagcaaatgattaaaccgtggagacattcaaatcacagaagtgatcaaacagccacaaggatcttgatttcctccttagagttctggagaattggcttaatctcttgcagaagactcttttctgggttggatcagccttacataattgggtgcaacgtgagttctacttcaaataagaggaccctccgg

SEQ ID NO: 523067 - DNA, 222 bp, Homo sapiens
ggcgctctgaggattcccatcaaccctaaatttattatgttctcccagaataaaacatcttcaaacagactctccctgcttctagtatacccagtcccagtctaggcaaacaggacctttcaacagaagaaaagacatttgcacaccccttggtgaagacagtatcttctcttattagcgacacataataaatttagggtcataataaatttagggttgatg

SEQ ID NO: 523068 - DNA, 551 bp, Homo sapiens
  misc_feature (305)..(305): n is a, c, g, or t
  misc_feature (318)..(318): n is a, c, g, or t
  misc_feature (486)..(486): n is a, c, g, or t
  misc_feature (502)..(502): n is a, c, g, or t
  misc_feature (510)..(510): n is a, c, g, or t
  misc_feature (513)..(513): n is a, c, g, or t
ctttgggaggctgaggcaggaggattgcttgagtccaggagttccaaatcagcctgggcaatatagggagagtccatctctaccaaaaattttttcaaaaattagctgggcatggtggtacacaggtgtgacctcagctacttgagaggatgagagacaggaggatcacttgagcctaggaggtcatggctgcagtgagccttgatcacactactgtactccagcttgggtgacagagcaagatcccatctcaaaataaaagaaaacttggctgggcacggtggcttatgcctataatcccagcnctgtgggaggccnaggcgggtagatcacttgaggtcaggagtttgaaaccagcctggccaacatggtgaaaccctgtctctactaaaaatagaaaaagctagcttggtgtggtggcacatgcctgtaatcctggctacttgggaggctgaggcaggataatagcttgaatccgggaggcanaggttgcagtgagctnatgttgcnccnctgcactccagctgggcaatggaaacactgtcttcaaa

SEQ ID NO: 523069 - DNA, 241 bp, Homo sapiens
gcaccgggggtatggacgtgaggcagatcccggcagactccccacattgaggagatagagctacttctcaatgtctgcctacaacctcgtgttgtgttaacatctgccagtcattgacagacaaccactaactgatgaatcatttggacagcacgcttctttttactttctggggctgaatatctccattggcctgtggatgcatatgagagtaagaaatttcttctactagattcttctt

SEQ ID NO: 523070 - DNA, 376 bp, Homo sapiens
cggtattgagactttgcccttctcctccccccggtgggggtggccccctcaaggaggtgagggttagtgcccccctgccaaatttggagggatactccccgtgtgcactacccccagagtttgtaccccaaatctttcccatggggctgtcttccagtgaaggggacatcccataaatagttttgggagggtggatgggttacttgccccccagaaacagccatagtcccaactccttgcgttcctttggcccctccctgccaacctagaatttgcttgaaagggttggggagggccaatattgggggattttgttagctttacccccgcaggacatacacaggagcctttgatttcattaaagggttgtgaccca

SEQ ID NO: 523071 - DNA, 243 bp, Homo sapiens
cccccccccccccccggggggacccccggggcgcgggccttttttaaaaaaaaaccctttgggccccccttaattggggggaaacccccgggggcccccaccaaggccccccccccccagggagggggtttttattttttttttcttttttcctggccccccccttttttggggcccgggggtggggggggggggtgaaaaaaaaggttttttgggggaccccctccccgttgttttttttta

SEQ ID NO: 523072 - DNA, 273 bp, Homo sapiens
aactgcttctggggatttgactcttggtggtgatgtcacagccttttcagttaccctggacttttgaatagtcagagtgaactctgcttcttgtttcccttcactgttatctaccaccacgctgtaattggcctcaacggaagcctggactaaagagatctcaaaggtcgctttgtgctttgtgagggccaattggtgagcggggagaagcactcagcacttgtcctctacggaggcaggtcacagttggcaccggtcaccacggggtcacaa

SEQ ID NO: 523073 - DNA, 187 bp, Homo sapiens
gcggtcgttagaacagaaatcaaggactgggtatagacttgtggttgcaagggggagggagtaggatggctggggtcacttgggattaacagatgcagactcttgcctttggcatggatcagcagtgagatcctactctgtagcactgggaactctgtctagtcacttatgatggagcatgataatg

SEQ ID NO: 523074 - DNA, 922 bp, Homo sapiens
ccccgccggtttttatgagggcccgggcgcggtgatcttgattttctatcgaaggcgcgttggtgctgccgtggggcgtttcttgtggggtcgacacatgtgaagaaagtgtggttcgcagaaaacgaaggtgggttgtccggttgcggtgtttctcccggctaggttttgttgaccagccgaggcgcggcgacgatgtttgtgtctcatctactgcgcgcgcgtttctgtggggggttttttacacaccaaacccgcgtgtcccgcgaacattttggtgggtgtgattgtcggccgtcgttgcgcccaccacagtgggggtggatttttatcacggcgctttgttgcgtgcgcgacaaccccgcgggtgcataaccctctcttgttgtttgtgaagcactgttgtgtgtattgctgctcacttcttgcgccgcagttcttctgttggtttcgcttttgtttcgcccgcccccggccgccctccttttgtttttgtcgccccgcgcgatggcaacaggcattagactgggtggatcccccgcctcttttgtgctgtgcgccaccccgcctctcctctccttggagggggctcgccccgctaatagcggggttgttgttctgaacaaaggggggcaatttggtagggagatagtcgcacaaaacctaatacgtgcttttataccccgcctgctttgtaggccaccaatcagcacctcacgctataacttgttgtttcttacctgcgcggcgatgtgttgtgcccacccctccctcacctcttcgttccccccatgtttttccaaagcgagtaaaaaataagaagagcagtcgttaaaaaacaccccccccccttttcccccccccttttccccccccccccccccttttccctctttccccctttttttttaaaattttttta

SEQ ID NO: 523075 - DNA, 1711 bp, Homo sapiens
atgtcgtgggttggtgcatgttcgtgtttgttgccgtctgtcttcgtcggtgggttgaccgttcctattttagcctcgttgtgtgcgtactgcctcccgtgtgtattttggttcctccccgcgcccgtatgtgttgctgggtccgtgatgtgtctactggccggtcggttaagtgtccggttgtgttctactcccactactgttgtggagggccgttttgttagagtctctctctacgagtgtttttttcggcctcggcgtctctctctccttggtggatgcccgctacaccacggggggttcccccccagccgccgctcttttctgtggtgggagcccggcgggggttcctcccgtctagtgaaaggacagctgtgtgattctcaagacggcaatttttgttgtactggcagaatgcgtccccctgcgtgttgctcctcattgtttatacctctgctgggcccaagaagatgtttgtgatgggtagtggggtcatgtcacgggtttatgttcggcgaccgccccctggtgtcgttgtttccgcggggagaaccccccgcccgacttggaattgggtgcctctgaaaagacctttttctcgtgatgactattcgcctcctcgggaataatgggaatcctcctttgctcttgatagaacgctgcccccattcggggtgaaaggtctgatggaaagcgccaacaacaccccgctgtttgtgcccaagccgccccacaccacacgtttgggagagggccccccgcgaagaggtgatgcaaccacatttgttggaaaatatattaggcgcgccaatatataatagtattcccttggtttagatgagggataatggcgacgccccactatagtaggatatttctcgcgcggattcccccagattctctctcacaaaggagcggcccacatagccggttttttctcgtccacgagcgcccaacatttgtaaaaaaggccctttgtggacccacccgcgggcccccaaacaccaacaaagatgtattggcaaaccgtgttctttctcatactcgggaatttggcccccccccacgagaggactttgcacaccagacatttgggcgctccagaagaatcctcatacagcaagagagacttgtgggggcgcaccacaccggagcgacccacggtttagaaacacgtctcccccagagagttagaacatgggttaaaacacacccacagtgtgaaacacattgtagccccaaagatctcggacagaattttctcccggttccaaattagtctccccgaataaaatgatgcccacaccccaccagcctgcggcgctttctccccttatacacatctcttacactggagcctctcgcccatctcctgggagacgccctcggttgtacatcacccgaattctctttctcgccacgacccacttgacacacttctctatagggaagaggtgttgtggacccacgagacctttgacccttgtgaaatgccatgaatgttaagggaatgtggaatatgaaataaagccaaaattgcctgcctgtgtggcctgcccacgttcaaaggagatgcccctgtaatatcgccccggcctgttgggaaggaagggaggaaagatgtaaaaacccccttaaaagtgaagggaccaccacgcccccagacccgtatgatatacccaggtaataaatgctgtttatgacttccttt

SEQ ID NO: 523076 - DNA, 135 bp, Homo sapiens
ttcatgacctacctattcaaagccttcaacgtgtgcctactatttgacctaagtatctcatttactatttttccaaagcaactactttcagggtcaaatgttttacacctctttaccctatttactgcaacattc

SEQ ID NO: 523077 - DNA, 305 bp, Homo sapiens
  misc_feature (7)..(8): n is a, c, g, or t
  misc_feature (88)..(88): n is a, c, g, or t
  misc_feature (100)..(104): n is a, c, g, or t
  misc_feature (106)..(109): n is a, c, g, or t
  misc_feature (114)..(116): n is a, c, g, or t
  misc_feature (119)..(119): n is a, c, g, or t
  misc_feature (126)..(126): n is a, c, g, or t
  misc_feature (129)..(130): n is a, c, g, or t
  misc_feature (174)..(174): n is a, c, g, or t
  misc_feature (183)..(184): n is a, c, g, or t
attatcnntaaataacaaaatctttaaaaataattttctattttgaacttttagccataatgtaagaaaataaaattaactagcagantaatcaaagagnnnnncnnnnttccnnnatnttttttnttnnaattaacatggcacttttacagttatttattattcatatcagtncacttaccnncttcatattttcaaatcaaaatacagtgtttttctccagtgaaatccttattctcatgactgatagaaaacattgccaattttgatatttccagagttaatgttaaattatttgaagaaaa

SEQ ID NO: 523078 - DNA, 1213 bp, Homo sapiens
ttttttttttttggaaactttaaaatccctcaaaaacggtttattatacaagtgagtttggagtcacgaggggcttatcggtaggatttctgggtagcgagcgcgggcaccaggcctccaaacttttgggactcgcagcgacgagggtcagctaccagcagggtccggtcatacgggatgaggatgtcttggatctccttctgggaagcctcatccacatatttctgggtaataggccaccagggcttgggaggatggactggacggatagcataaatctggggccacgtgaccaccaccctttacacgggacacggtttgtctacaccaggcaaatcggctcccttggccggaaaacgcaagaactgggctccagcagtcttggtactggtgagcggtggcggcgggctcaatcattctccagggggccggcccggttcaccttggatggaggcaccattggccggcggtattggcgagtggcgcgccacagtgtgtgtcggctggtgcttctgggcggtccggaagacctggcgccagactggcgagcggggcccttgggacggcttgggttccgagcggtgggactagaaaacctcaccgggtaccagggcgggcggcggggtcataagccgagtgacagagacgctcaggcggggtccccaggatgacccgatgtgggagaccagagcaccaggggtgtgggccagagaacccacaggaatattcaagatccttgggggacactgtgtgggccccgattgattttgcgcgaattcaatggccttcttcccctggcggggattacctttggcgtgaacagggaaagtttttgcccagttacctggctcacagggcacagggggggagatgccgggcaaaaggcgtcccggaaaggctcaagggcccgcctggtggtaggggggcaaaaaacccccggatatatgacggggggggcaaaaaacgggggggaaacacctgtaagggggggcccgcctaaaagggccgtggagaaaaaaaccgcgcgccggggggaacccccctccgggcggtggaggcggggccaccacaagaggcgggggggggcacaacccgatgtggcgcgcgggggcaacaagagagccgaagagatgactcactgcccggcatccagccacatgttatggtgctgtagtgtgagggccggctgacaacacaaggcgaagatagcagc

SEQ ID NO: 523079 - DNA, 252 bp, Homo sapiens
gcaccttagcaacattaccaataagatagcgatagaattgaactgcgcaatagatatagtaccgcaaggaaagatgaaaattataccagcataatatagcaaggctaaccctataccttctgcatatgattactagaatactttgcaaggagagcaaagctaagaccccgaaaccagacgggctactaagacagctaaagacacacccatatgtgcaatagtggagatgtaggtagggcgacaactacggct

SEQ ID NO: 523080 - DNA, 191 bp, Homo sapiens
caactgtcgactaggttggagggaaagtggttggagtggtgacgggaacgccatgttggcgagtggagtgagcagtttacaggacacgcatacaggcgccaacgtcgagagccgatatttctggtctcggggcaccaacgatccaatgtgggccaccatcgaatgatgagtgcagcgcagggagtgtcttg

SEQ ID NO: 523081 - DNA, 137 bp, Homo sapiens
ggccagtgtcataggagccccaacacattcctggacagggacagacagggtggcaaggactcaggtctaggtcccttacccagaagccacccgagcctcattaagactgtataggctctattggcccctcaccctgt

SEQ ID NO: 523082 - DNA, 686 bp, Homo sapiens
gtgtccggctcgaatatcgtcgtgcacagtggccagcaggaccgcttctacgagcgcctgtccagcccgatcaagtagcgcgtgcatctgcagggcttcttccacgacacgctgagcgagcgcgatcgcgcaccagcactggcgcgcatccgcagcttcatgcaggcgcgttttgccgaaccgctgcgcgagctgtcacggcgcgacgcgcaccgccatggcccgacattcgaggaatcggagatcctggcctggccaccggagcgcaacagcctggccgacctgcgctggcgcgtggtacgtggcggcctgcgtttcggcggaacgttgtccgaaggcatcgcgctgggcctgcagaccggtttcgattccggcagcacgctggactacatctatcgcgacgaagcgcgtggcaagggcccgctgggtcgcatggtcgaccgcaactatctggatgcgatcggctggcgtggcatccgcgtgcgtggccagcacctgcaggaactgctgcgcgacgctgcccagcgcctgcgtgggcagggcacgccggtgcacgtgctggacgtagctgctggccatggtcgctacgtgctggaagcgctggggcagggcgaacagcgcgccgatcgcatcgtgctgcgtgatttcagcgatctgaacgtgacccagggccaagcattgattga

SEQ ID NO: 523083 - DNA, 831 bp, Homo sapiens
cggggccggggccccgtccacggcgcgacgcggccccggatgccactgcctgaaagctccgcggaagccaccgcaggattccccatcccaggtccaccagagcccccgggcccccccgctgacaccggctgtcatccgccattatgtcatcgtgcagcggttaacataaccgtaccagaccagcatgacctggcctcccatccatgatgtattcccagtggaccagatggccatgccccaatggggatcgccaccgtcctggcccccgttgtgcatacccagacagtccagatgcaacgtgctcctccatagcgtctgggttcattagatcttggttggagcgtttggttgttcgtccgtatagattgcagttatcctgaggtttttgtgatgatcaatggactttaatgacaaaccaacaagcaagaaaaagacacacacacacacagcaagcactcacccccatgatgcgcatcactgagcagctgacacacaaccaatcacacccccaaccactgcagcgcggcacacgaccatccgccacgagacccacaggccactgcggcaacgcaatgcggcaaccacacagcaacgcgcacagcagagaagagaccagagccagacatcagacccaacacaacaggggaataacacaagacccaagggcgaacacgggaagccgcaacatgcagaccacggaaacacctctcacagtgacgcccattcgcgagaacggacggaaccagcacacgggacgggcagacacccaggacacacaggcgccaggaggcaaacgcagcgagaaccacacggcaagacagtaccagcaac

SEQ ID NO: 523084 - DNA, 616 bp, Homo sapiens
  misc_feature (11)..(11): n is a, c, g, or t
  misc_feature (63)..(63): n is a, c, g, or t
  misc_feature (105)..(105): n is a, c, g, or t
  misc_feature (107)..(107): n is a, c, g, or t
  misc_feature (176)..(176): n is a, c, g, or t
  misc_feature (306)..(306): n is a, c, g, or t
  misc_feature (322)..(322): n is a, c, g, or t
  misc_feature (438)..(438): n is a, c, g, or t
  misc_feature (447)..(447): n is a, c, g, or t
  misc_feature (531)..(531): n is a, c, g, or t
  misc_feature (542)..(542): n is a, c, g, or t
  misc_feature (544)..(544): n is a, c, g, or t
  misc_feature (581)..(581): n is a, c, g, or t
aattgcttganggatgaaaacctgtaagaaatgatggagaacagggaacaggccaaggggaancaggagcgggggcacagtgagccggcgggcagccggggagananaagccacaaagcacagcaggggcacagtatctggcctccctacgccaccactcagtcctttcagccccngggtgacctgagcctcagtcgccagccaccctgctcttgtgccagcgccacctccagctccctccttggtttgctgcagcaagcgtctacgggctcgccgccgcccttgccacactcggtgccacaaggnacaagcgccacacgcngaggagggcagggatgcccccttccctgcctcaccctgaggccattcttgggctgcctcatgtccctagggcccccgccctgcaagggctgcgtggctgggctgcccctcttctcnaggggctcnatgcatcccagtggtcaggggcaggccccctggctgcccagggctctgcatggcccagtcctgcaccatctctccaacctctanaaccatctctncnaccctgtctcccccaccgtcccctgcaaaaccctgcngcccccctttcccctcctcacagcagtttttctgt

SEQ ID NO: 523085 - DNA, 215 bp, Homo sapiens
ggaccctgctacgcggccccgtctcggacttggactccttagcgatggcacccagcctgtggaccacgttgatgacgaagatcttctccgcgtgacgctgggtgcccactgctctcggagctgccgatgacgaagaccacgtccagggcgccacagcgctgctcacagtcgcagctcccgctgggctccctcacgaaggacatgacgacacactc

SEQ ID NO: 523086 - DNA, 1017 bp, Homo sapiens
  misc_feature (921)..(921): n is a, c, g, or t
  misc_feature (988)..(988): n is a, c, g, or t
  misc_feature (1008)..(1008): n is a, c, g, or t
  misc_feature (1015)..(1015): n is a, c, g, or t
tttaatttacagtttcttctgggcctttcaacattatcaatgtctccctttctggcggcacgaatgaagaaattttggaatccataagagccaaaaagggagacattgataatgttaaaagccccacgggggaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcacaaaaaggagtgatcatgaaaggaatatcacantatttaaatggtcagagggagatcggtctaccacatcatacttcaccaattcattgctttgaataancaccagcacagagaagaccntgattanga

SEQ ID NO: 523087 - DNA, 201 bp, Homo sapiens
gggtagtatgctctcctgaagaatatctccacagacacatagggttactacatatgtacctccagcaatgaggaggggactgtagttctgcaacatcacggtggccgtcagatctccctccatgaacgtggccctgtaatgtgggcatcgcgactgcgcgtagcgctgccgcccctcattatcatatgccatcactcactc

SEQ ID NO: 523088 - DNA, 229 bp, Homo sapiens
actcgccctccttatggccacgcgtggtctgatacgcaatgtcacgtccgccgctgggcaacaggctggcaccggccagggacaatgcggccaacaggcgcagaggggtcagcagtttcaaagggaagctcctcaatcaggcggccgagggtcggcgtgagaggagactaaatgatctaagaattcgaaaataaataactttttcgaattagcttatgaggggaaatgg

SEQ ID NO: 523089 - DNA, 489 bp, Homo sapiens
  misc_feature (38)..(38): n is a, c, g, or t
  misc_feature (105)..(105): n is a, c, g, or t
  misc_feature (163)..(163): n is a, c, g, or t
  misc_feature (199)..(199): n is a, c, g, or t
  misc_feature (212)..(212): n is a, c, g, or t
  misc_feature (255)..(255): n is a, c, g, or t
  misc_feature (271)..(271): n is a, c, g, or t
  misc_feature (296)..(296): n is a, c, g, or t
  misc_feature (374)..(375): n is a, c, g, or t
  misc_feature (384)..(385): n is a, c, g, or t
  misc_feature (395)..(396): n is a, c, g, or t
  misc_feature (398)..(398): n is a, c, g, or t
  misc_feature (406)..(406): n is a, c, g, or t
  misc_feature (410)..(410): n is a, c, g, or t
  misc_feature (422)..(422): n is a, c, g, or t
  misc_feature (427)..(427): n is a, c, g, or t
  misc_feature (473)..(473): n is a, c, g, or t
  misc_feature (475)..(475): n is a, c, g, or t
  misc_feature (477)..(477): n is a, c, g, or t
  misc_feature (482)..(482): n is a, c, g, or t
tgaagagatagtttcatgttgagtttctcagatttttngtgtatctaagaattaactgaagagtttgttaagaatgcaggcttaaaggccaatccacagattatnatttcatacaaacaggatggtgcctaagatcctgtaaattattaaacaactgattaanaatagagaggtttctatgaagttaggcttgtccttntttcttatttganctggacaagtagaaggataataggtaggaccaagtgagcattntcagaatcaaagtagnggcaataacaagccaaggtgttttngcctagctaaagaagctcagactagaaaagacctccaggatcaagctgaagaatctggggtttagcctcttgacactnnggtttccgnncgggggggtnntnatttggtnctgncttttaagttgntgggntgccttctacgctgggaagccggcgggggggttcgggatggggtgntnanggtgngccttag

SEQ ID NO: 523090 - DNA, 755 bp, Homo sapiens
  misc_feature (659)..(659): n is a, c, g, or t
  misc_feature (726)..(726): n is a, c, g, or t
  misc_feature (746)..(746): n is a, c, g, or t
  misc_feature (753)..(753): n is a, c, g, or t
ttcaaaaacttaaacctttttatacagaaatccatattgaatatataaggcaacgctttgttagtttgctttttgagttattattatgtttgttacttgtaagtttgtagcagctcttcctgttttcaaacagatgagtttttaaacagataacccagcatgtttcaattttttgtggaataatagatgactcacagtaaagttacaacatattttcttttaagtaaaaaacttaaggaataatgatacttgctttgccattcaagggcctttttttatctgtttactttgtggatcttacacatacaccagatacgagttttggtgagataaggtggttataattatttacttattgtcagcaattgctttgtggcctattcatttgacagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcacaaaaaggagtgatcatgaaaggaatatcacantatttaaatggtcagagggagatcggtctaccacatcatacttcaccaattcattgctttgaataancaccagcacagagaagaccntgattanga

SEQ ID NO: 523091 - DNA, 831 bp, Homo sapiens
  misc_feature (735)..(735): n is a, c, g, or t
  misc_feature (802)..(802): n is a, c, g, or t
  misc_feature (822)..(822): n is a, c, g, or t
  misc_feature (829)..(829): n is a, c, g, or t
tttaatttacagtttcttctgggcctttcaacattatcaatgtctccctttctggcggcacgaatgaagaaattttggaatccataagagccaaaaagggagacattgataatgttaaaagccccacgggggaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggaagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcacaaaaaggagtgatcatgaaaggaatatcacantatttaaatggtcagagggagatcggtctaccacatcatacttcaccaattcattgctttgaataancaccagcacagagaagaccntgattanga

SEQ ID NO: 523092 - DNA, 828 bp, Homo sapiens
  misc_feature (732)..(732): n is a, c, g, or t
  misc_feature (799)..(799): n is a, c, g, or t
  misc_feature (819)..(819): n is a, c, g, or t
  misc_feature (826)..(826): n is a, c, g, or t
tttaatttacagtttcttctgggcctttcaacattatcaatgtctccctttctggcggcacgaatgaagaaattttggaatccataagagccaaaaagggagacattgataatgttaaaagccccacgggggaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcacaaaaaggagtgatcatgaaaggaatatcacantatttaaatggtcagagggagatcggtctaccacatcatacttcaccaattcattgctttgaataancaccagcacagagaagaccntgattanga

SEQ ID NO: 523093 - DNA, 205 bp, Homo sapiens
tgagtatagggctgtgactagtatgttgagtctgaagtaggagagagatattaatcaggagaacgtgttactagcacagagagttctcccagtaggttaatagatggggggtaagcgcgagcgttagctgagagcttgctagacagtcatcaaaacagctattatgtgggagtagagtttgaagtacttgagagacggattatgt

SEQ ID NO: 523094 - DNA, 413 bp, Homo sapiens
caatagcaactgaaatgtttacgttttgggtgattatatcaacatcaaagaaatgcaaatcaaaaccacaataagatgccatctcacaccaatcagaatggctattattacaaagtcaaaaaataacggatgttggcaaggctgcagagaaaagggaatacttatatactgtttgtgggaatgtagactggttcggccactgtggaaagcagtttggagatttctcaaagaatttaaagtggagctaccatttgacccggcaatctcatgactgggtatatacccaaaggacaataaataattttacacaaaagagacatgcacttgtatgctaatcacagcactgttcacgatagcaaagacgtggaatcaacctgggtgtccatcaatggtggattggataaggaagatgt

SEQ ID NO: 523095 - DNA, 107 bp, Homo sapiens
tcgcagtgtatacaccagtgggtgcatgcctccctgtacaagttccgtacgacacgtgagcaccgtgctagacctaccaaatatcgtacaagctggagcctggtacg

SEQ ID NO: 523096 - DNA, 999 bp, Homo sapiens
ggtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgaagaaaagcctggaacctaatatatgggaatcctcggctatatgagtgtgagtccaccatcacatgggtctcataatagagaggtgatagcgctgtgtgacacttttgtgtacaaaagaagcagctcaggaggctgttaaacttgtattaattaatcattgacaattccggttcctgggaagaacccaattaatttgggtggttcttggcaattcttcagttggccaaacaattaggcttttggtggggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgacgtggtaaagtcaaggtctgggggaatgttggaactgttgaatgggctgatcctatagaagatcctgatcctgaggttatggcaaaggtaaaaggtgctgttgtacgcaaacttgccaatattgttagcagaagagatttagaaaagggcatttaggtccgcttgggaaacgtggaacgagtgaagaagttacagattatgggtgcatccattttgatgagcgagatggtgtgtcaaggtatggaagaaaggaatggcaacagattggaaggaaacattttgacatggttaggcaaggcacagatcggaaaaaa

SEQ ID NO: 523097 - DNA, 187 bp, Homo sapiens
tgacatttactgtgatcggctaaagagcacgatgtggaatgaatgcgcaccacacttagtcgttgaaggagaagaaacacacaagaaatcgagatcaagagataacgtgagaagtaggagagaatgaaagccaataaagaatttcaacaggcagaaaaccaacatcgaatgcccagagagatcaaat

SEQ ID NO: 523098 - DNA, 312 bp, Homo sapiens
ctctggatgcaaggcatatgttctgagacagaaggaaccatgatttgagccaatgggataaaatcctgccagaggatacgcggtcaagagagggttcctatttagcaaatcaaagggacggatttgaatgctccaattctctgtcctgttgtgtggccttcagaagtgtttcaaacaaaaaaccaccacatagtcgtgattgtctcatataagagtatactgccctacaagtttatgatgccacgattattcactaaacctgtgtgcatatttttttcaacagccctacattacattctttgcgtcttagaa

SEQ ID NO: 523099 - DNA, 108 bp, Homo sapiens
tcatcagaagatgtggaaatgaattatctgacagagggattgagattctaatgtattgccaactgtaccagccgacagaagctgctatatcacgtttgtgttctcttg

SEQ ID NO: 523100 - DNA, 124 bp, Homo sapiens
cttcagacggcttacagctcagcaaggaacagaaagccaatataaagtaggaacgggtaagcggttcaccgctgggcgcacgggctcatgcccataatctcagcaccgtaggaggctgaggaaa

SEQ ID NO: 523101 - DNA, 107 bp, Homo sapiens
tgactcatagtgatcacaagatacggagtgcagttcatgcttgtatagcaaaaagagagatgagaatcaggaagagctctttactttcacgatcccttttactttaa

SEQ ID NO: 523102 - DNA, 446 bp, Homo sapiens
  misc_feature (2)..(3): n is a, c, g, or t
  misc_feature (14)..(14): n is a, c, g, or t
  misc_feature (357)..(357): n is a, c, g, or t
  misc_feature (408)..(408): n is a, c, g, or t
  misc_feature (420)..(420): n is a, c, g, or t
anntcggcacaggnatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttggaaaatcagtaagttagctttatttattcccaggtggttttcnggaaaatacgttttttttttttccttaggcctttcctaagggccaggagcngtccttccattnccccctaatccttttcccccctcctt

SEQ ID NO: 523103 - DNA, 256 bp, Homo sapiens
ccatctcctctgtatactccacactgacctaagaaaagaacagggtagtcagccaactctgtcactcagtagctgtgacagcccttcttcagaggcaggaaaactatggctgcgctagtatttcagctgtgctgtggaatatcaaatccctacaacggatgacgcaggtcctaactgttgacttccaattatggcagcagacctcaaaggatttgccctgggccaggatgtgaacttgtcatgtgtcttctagctc

SEQ ID NO: 523104 - DNA, 828 bp, Homo sapiens
ctctagaggatctcagaagacgacgaagggcaaaatctttgacctgattgggctgctccagaggatgactggcctcgagatgtatccctgcccgtgagcctttccccccagagggcccgcccagtgcagtcggtggtacctgagatggaggagtcgggagcacagtgctgctggaaatgctgacttttaaacccagcagaagacgaatctctgccttgtcgagctctgcagcactcttatctacataaggatgaaggtaatccggagtgagcaatggagtggcgtgccgatggaaggaagaaaagctgccgatttcccttctggagcacgtgagagggcaatctttgcctttatctctgaggctatggagggtcctccgtccatctttctacagagattacttggctgcttgtaatgacagttccgcctcccacctctccgtgttggaggcttcgtccttgctccttcccatttctctacgactagcggggtatgtgccctcttgtccctttccctacctttatgattggggtcctgtttagtacaggaaaaacaagaataaagaaaaaaagcatgtcagatgacgaaacggcgggatttgcagacaggccaggagatatggaaggaggggggggcataccataatttggccatggggaccggacatttttgggaaacagattgttttaaaacggtgtcgtcctaatatgggggtgtcttgaagaagtgcgcgcgaagggattaacaaccgtggctgggaacacaccttcttggatcgttgggggaaaaacaccttggggggggggaactttggaaacacctagaggt

SEQ ID NO: 523105 - DNA, 144 bp, Homo sapiens
tgtttgtttcgtgtccagagtgtgatgatatactactcttctcaccgtgagattttctcagccacgtgatagtacattctgaagatgctggcacctaggagacggccacagacacacactgctattgaaacttctaaaactagg

SEQ ID NO: 523106 - DNA, 385 bp, Homo sapiens
cgcagagaggctggagtgcctacgcctgcgcaatgagatcattgtcgagtttgacgagctcctactgaagcccatgttcagagccgtggagaagatcaagaccattggcaggacgtacatggcagctgcagggctcacacgtcgccttagggcacgagaaccaggagctggagcggcagcatgcccacattggtgtcatggtggaggtcagcatcgacctgatgagttagctggacgcggtctacaggcacttcttcaactgcttccggctccgcgtcggcataaaccatgggcctcggaatgctgtagtgattggggcccgcctcagagtgacatatggggaaacactgtgaatgtggccagacgaatgggcactgggcttggg

SEQ ID NO: 523107 - DNA, 2026 bp, Homo sapiens
  misc_feature (1597)..(1597): n is a, c, g, or t
  misc_feature (1627)..(1627): n is a, c, g, or t
  misc_feature (1653)..(1653): n is a, c, g, or t
  misc_feature (1657)..(1657): n is a, c, g, or t
  misc_feature (1723)..(1723): n is a, c, g, or t
  misc_feature (1734)..(1734): n is a, c, g, or t
  misc_feature (1746)..(1746): n is a, c, g, or t
  misc_feature (1757)..(1757): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaggtacctgtgcgtgcacgcagacgggaagggctggggaagcgggaggactgagaaaagccaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523108 - DNA, 359 bp, Homo sapiens
tcaatcccctgagctccccaaagtttaaaaaaaaacacccgaaaccaaaaaattcaagccctggttattacaattttacgggggttttattttacccccccccaagcctcagaggactttgagtttcccttccccatttccggggggatttaggggtcaacattttttgtaaccacagggttccccgggatttacgtcattattgggtcaactttcctcccaatttggtttatcccccaaataaaatttccctttacatccaaacatccctttgggtttgaaacccccccctgaaaatggcattttgtaaaagtgggttgactatttttggaggtccccccccattgaagagggtttta

SEQ ID NO: 523109 - DNA, 1911 bp, Homo sapiens
  misc_feature (1482)..(1482): n is a, c, g, or t
  misc_feature (1512)..(1512): n is a, c, g, or t
  misc_feature (1538)..(1538): n is a, c, g, or t
  misc_feature (1542)..(1542): n is a, c, g, or t
  misc_feature (1608)..(1608): n is a, c, g, or t
  misc_feature (1619)..(1619): n is a, c, g, or t
  misc_feature (1631)..(1631): n is a, c, g, or t
  misc_feature (1642)..(1642): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523110 - DNA, 392 bp, Homo sapiens
gtgatctagaggatcccgttttgcggtgccttttcccgcaaatttcactagtcaataggtgttattattcttgtaattttgccagtctagtagatataaaatgttgcaggtaaccactaactggggccactggcgtgggcagtaaaggaatttaccaagacaattgtaggtaaggaaaggcagatttattagagaatgtaggaaaatacgttgcaagaatggaaagggcaggtcagcaagggaggagctggctgccaggagacaaaggcttgctggggattttataggatggtgcttgtgccggagagggttacatgcagtgctgataatgccaaggtttcagtgagctaacctgcattctcctgtcaactgaggtcataagttgagtgcag

SEQ ID NO: 523111 - DNA, 98 bp, Homo sapiens
gtttgaggaatccaatagacagaattagccaaaaaggtttacccaaaaagagccagaaagatcgagggggcaaacgagaaaaacccagtaggagaaaa

SEQ ID NO: 523112 - DNA, 1726 bp, Homo sapiens
  misc_feature (1297)..(1297): n is a, c, g, or t
  misc_feature (1327)..(1327): n is a, c, g, or t
  misc_feature (1353)..(1353): n is a, c, g, or t
  misc_feature (1357)..(1357): n is a, c, g, or t
  misc_feature (1423)..(1423): n is a, c, g, or t
  misc_feature (1434)..(1434): n is a, c, g, or t
  misc_feature (1446)..(1446): n is a, c, g, or t
  misc_feature (1457)..(1457): n is a, c, g, or t
gctgggtttagtttgcctccctgaaatcaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523113 - DNA, 889 bp, Homo sapiens
  misc_feature (283)..(283): n is a, c, g, or t
ttgggttgttcccgcttcctgcttggcctagactgtcagcgcggcgtccgttccggttcccccccgtccaggtgacccagcccaccggtgagcacaaccatcgattgaggaaagaagaacggacgggctcgcttgatcacaacagttttagacagcgtatttcacgctggagaaacctcaatactataatcttaaggacttggggacacaccaaaccacccgggggtacgccggagggaatcttaaaagaattgggtgttcagaatgtcaaagggatccccanacacatgggagctgaagccagagtcagacacttcccaggagaagcaagagtgctcagaagactcctacccgcatgctagtgaacgactagcagcgatgctatgccaaaggcgctgatactggaaggcttgaacacccgtatgttaataggggttaagtgaccgtactttgatttctctcggtaaattttttaaacccgtaattcttgtgaaagtgtttttaactgtttttttgaggagaaagaaccagatttatttatagacattaacttgtattaaacccgattattcaccgtaggaataggggttggaggattaagagggtttttctttaaataatagcttttaaagtgtaccaataggaaatttttttaagtgaggactctctaccccttgccgtatctaaggagctgaggtaataccagatcccaggagaattgtatagccagaaaaaaaccagtcaactaccgaacttctttaaagggattaaaaccccaagttccttattttggaattgtccaaggaccaagcggtgttttttttttaaacaggtgatcacgtttcgtgttcatactccacgtttattaaaggagagagtttgttagtga

SEQ ID NO: 523114 - DNA, 1796 bp, Homo sapiens
  misc_feature (1367)..(1367): n is a, c, g, or t
  misc_feature (1397)..(1397): n is a, c, g, or t
  misc_feature (1423)..(1423): n is a, c, g, or t
  misc_feature (1427)..(1427): n is a, c, g, or t
  misc_feature (1493)..(1493): n is a, c, g, or t
  misc_feature (1504)..(1504): n is a, c, g, or t
  misc_feature (1516)..(1516): n is a, c, g, or t
  misc_feature (1527)..(1527): n is a, c, g, or t
gctattctgctgttgggtcaccttctgcctacttgtgacattccttctgctcttccttgctccagggattgttccagggcccccagttattctaaatgaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523115 - DNA, 349 bp, Homo sapiens
  misc_feature (46)..(46): n is a, c, g, or t
  misc_feature (54)..(54): n is a, c, g, or t
  misc_feature (70)..(70): n is a, c, g, or t
  misc_feature (134)..(134): n is a, c, g, or t
  misc_feature (153)..(153): n is a, c, g, or t
  misc_feature (162)..(162): n is a, c, g, or t
  misc_feature (191)..(191): n is a, c, g, or t
  misc_feature (198)..(198): n is a, c, g, or t
  misc_feature (232)..(232): n is a, c, g, or t
  misc_feature (237)..(237): n is a, c, g, or t
  misc_feature (247)..(247): n is a, c, g, or t
  misc_feature (254)..(254): n is a, c, g, or t
  misc_feature (265)..(265): n is a, c, g, or t
  misc_feature (283)..(283): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (297)..(297): n is a, c, g, or t
  misc_feature (300)..(300): n is a, c, g, or t
  misc_feature (332)..(332): n is a, c, g, or t
ccagtagggataatggggaaaggaacccaaaattggttcaggttgngtttattnatacgggccccctaancaaaggttttggacctcgtgctacccctgctggggtttgactggttggttggtgagctacaacncagaccaaaaagtggcctncccaaagtnagggttaaatgccaggcctgcctctttgngtggcanaggatgggactcaaaggcttggggaggttggagngtcanagtggatttnttttttnagacctactcncccccccctggaaagganagaggncncncctnttnccccccccccgagaaataaatttgtgaggggnaccctcctccttcatga

SEQ ID NO: 523116 - DNA, 260 bp, Homo sapiens
ccgcgccttctacaataactccccccaccattgggtactgcatccagtaccggcgtctgtcacgatcttggccaaacatcactgaacgctatgagtgagacgcatcacagctgcttccttctgtactgagtctgttgtttactcagtttttcaatctgtttgtccagctcttcaacacttgagagactacttgccactcttaattcagagaccgtggtcacactttgaaagattgtttcaagtatcccagttcttccttt

SEQ ID NO: 523117 - DNA, 2020 bp, Homo sapiens
  misc_feature (1591)..(1591): n is a, c, g, or t
  misc_feature (1621)..(1621): n is a, c, g, or t
  misc_feature (1647)..(1647): n is a, c, g, or t
  misc_feature (1651)..(1651): n is a, c, g, or t
  misc_feature (1717)..(1717): n is a, c, g, or t
  misc_feature (1728)..(1728): n is a, c, g, or t
  misc_feature (1740)..(1740): n is a, c, g, or t
  misc_feature (1751)..(1751): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggagtctgcctctgaaacttagacctgtgttgacagagagcacatgcaatattaaataagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523118 - DNA, 627 bp, Homo sapiens
  misc_feature (4)..(4): n is a, c, g, or t
  misc_feature (7)..(7): n is a, c, g, or t
  misc_feature (30)..(30): n is a, c, g, or t
  misc_feature (126)..(126): n is a, c, g, or t
  misc_feature (163)..(163): n is a, c, g, or t
  misc_feature (176)..(176): n is a, c, g, or t
gcanttnaattgaataaaggtatttcaagnctgtgcagcttcaaatgccggttgtggttcacccgatcctatagacgcacaggacactacagctagcatggccaagaacatggagtcaggggtttntgcctgaccctggcgctccagtagtttctcagcttcntgtgtcgttttcntgatctgtccccatgttatggggttggatgtcattgtgactccggtcggcccttgttctgtctttgcattcagattccgctggctcatggctcgtactggaggtaacaggcccacggttgaataccatggatccctccggtctcccgttccatggtcacacacacctggagggcacccacacggtttgtccatctcctgtaaaaacacaagcataccctcgtccccacgtcagcaaatccaccggacctttccattgtccttcttctggggatttccataacacttttggataaacttgcctcttttcctctagcagttgccagtgtcgttctgctggggtcttgccatccgtaccaggagtcaaacaatttaaagtaaacaaggctaaatgtaattttgtttgaagtggtaattggtcccctattctccctttttgttttttcagcatgc

SEQ ID NO: 523119 - DNA, 2079 bp, Homo sapiens
  misc_feature (1650)..(1650): n is a, c, g, or t
  misc_feature (1680)..(1680): n is a, c, g, or t
  misc_feature (1706)..(1706): n is a, c, g, or t
  misc_feature (1710)..(1710): n is a, c, g, or t
  misc_feature (1776)..(1776): n is a, c, g, or t
  misc_feature (1787)..(1787): n is a, c, g, or t
  misc_feature (1799)..(1799): n is a, c, g, or t
  misc_feature (1810)..(1810): n is a, c, g, or t
gatcatcgtacaaaggccggctagccgaagcataaagtctagtctgacacacgtaagcagtggaagtcttggctaaattggaaccagaagatggcaggcagccctatgcccttctccttttaaaatgaaaacgtcgatacagggaagtagaggcaccttggaattgccaatacctctcaaggggttcttgtttagtggagaatatgaaactggagtgaaacgagtcctaactagttgacaccactgaattactgccacaggataaagggaccttgggattgagcccttttcatttgctgaataccagaaatcagttatagcttaccagctgtttgaatggcttcctggagttttcagttggtggttttatgtttttgttttaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523120 - DNA, 486 bp, Homo sapiens
agaaaggctgggacccccgcggttagatcccacagtctttggatgtggctgaaggcaaatacaccattgaaggaccttttgttttgaagggctttcccctttgaatttggtttgaaacaagcagcttttgtttttagcccaaggaaagacccaaacatagggaaataaaagcctttatttttgttttggaagtaattgttgaagttgggcagttgatcagggcccagttaaaagcaatgtttataaaaattgattgttaaacccaatttaccctggcatgtgtggggtagtttttaaaaggcccttcccctttgaaattttttttcccctaaaaaggttttagggatttaaaagtctagttttggatttttttgggggggttccccgtttttcaggattaccccctgaataattttctggacagggggggttgtgctaaaccctgggatgtttaattgcaccaataaaaccctttttttaaaagga

SEQ ID NO: 523121 - DNA, 1992 bp, Homo sapiens
  misc_feature (1563)..(1563): n is a, c, g, or t
  misc_feature (1593)..(1593): n is a, c, g, or t
  misc_feature (1619)..(1619): n is a, c, g, or t
  misc_feature (1623)..(1623): n is a, c, g, or t
  misc_feature (1689)..(1689): n is a, c, g, or t
  misc_feature (1700)..(1700): n is a, c, g, or t
  misc_feature (1712)..(1712): n is a, c, g, or t
  misc_feature (1723)..(1723): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523122 - DNA, 1987 bp, Homo sapiens
  misc_feature (1558)..(1558): n is a, c, g, or t
  misc_feature (1588)..(1588): n is a, c, g, or t
  misc_feature (1614)..(1614): n is a, c, g, or t
  misc_feature (1618)..(1618): n is a, c, g, or t
  misc_feature (1684)..(1684): n is a, c, g, or t
  misc_feature (1695)..(1695): n is a, c, g, or t
  misc_feature (1707)..(1707): n is a, c, g, or t
  misc_feature (1718)..(1718): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523123 - DNA, 512 bp, Homo sapiens
acatggagtagcacagctcagtctctttgggtagcagtacatgctaccaattctccaggactccttccagtgttgctactggagcctatattttaatgtattagcttgtagtagcagaaatatttctctgtgctcatgaatctacaaacatgtgagaaaacaaaacatataccctgcaggactgtgtgttttaccagcaagtagcagaaagcgcctttgtggaagcaaggaatagtgctaatatttactatgtcaacccccggcatgcaccactcattctcattacctgcctggctcttaagggtattttattttgtagcctctgcctaggaagacttggaagacggaaatctgtagatagtctgcaactatttatccacccatttctgcttacataggtcatggcagaattaccgtggcacgctactttggccagagttctgctgtctttagcccttgcatagttaatcacctgcagcaaacttaaagaatcttatccatcggtcttccca

SEQ ID NO: 523124 - DNA, 2216 bp, Homo sapiens
  misc_feature (1787)..(1787): n is a, c, g, or t
  misc_feature (1817)..(1817): n is a, c, g, or t
  misc_feature (1843)..(1843): n is a, c, g, or t
  misc_feature (1847)..(1847): n is a, c, g, or t
  misc_feature (1913)..(1913): n is a, c, g, or t
  misc_feature (1924)..(1924): n is a, c, g, or t
  misc_feature (1936)..(1936): n is a, c, g, or t
  misc_feature (1947)..(1947): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523125 - DNA, 1063 bp, Homo sapiens
agttttctagcaacaatgctgtcagcatggctgttcacgctctgtctaatggtaaagcttaatgggccgagtatggtctatgcttatccatgaagcgccatggcgtccattgcctgtaagataagactttggggtctccgacaatcgctaagaatagattaaatcgcactcgaggagagcaagaggccgtatcgggttcgtagagaggacacatttgccaagcatcggagaggtgcgtggagagtcggtccaactgcccatctcataccgatgcaggtgacgatgcatacagcggagttccgatccttcaagttatcgcgcagaaggtggccaccagaaagtatgtccggacaaggcctggccagaagggcagacattcaatacaaaatgggcagccacagcgatggggccaagaacgattgacagccaggagacaaggcaaaaagtcccaaaggattggacccagcaatctttggacttccgatgtttctaaccggctttacatgagcagcaaccacaaacaacaacagagcgacgaaacacacacagaaagagacagaccacagacacactgtctttgtgagcggccgtgccactgtgcgagcccgcatcgagggggaagacgcacgtctggcgcggacacacaccgtccacggcggggaccggcccgcggggcgcccccacaagaaaggaagcagatgaaacacccgcacattggcacaaatctacgcacggtggccaaccaaggaaggagcaagaaaaccagcgggggtgaaacagaagacccccaaatacacacggagccgaggaaactgaacattaccaccgcaccgacacgacaaaaacgaaacaacaaacacacgccaggcggctgcgaggccgaaccgagcgggacgagcacgctgatcgaggaagcaaaacagcatcgccgaagacatgagagaatgtatcaagcgaggggaaagaaaaagagactgagcagacagtacaaaacaaacacaacgaggagactacccgcagagaagaagagacgaccgcaaaacgcaaaagtaaaacgccccgg

SEQ ID NO: 523126 - DNA, 2135 bp, Homo sapiens
  misc_feature (1706)..(1706): n is a, c, g, or t
  misc_feature (1736)..(1736): n is a, c, g, or t
  misc_feature (1762)..(1762): n is a, c, g, or t
  misc_feature (1766)..(1766): n is a, c, g, or t
  misc_feature (1832)..(1832): n is a, c, g, or t
  misc_feature (1843)..(1843): n is a, c, g, or t
  misc_feature (1855)..(1855): n is a, c, g, or t
  misc_feature (1866)..(1866): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagatcttagcaaagcaatgtctcaagatggtgcttctcagttccaagaagtcattcggcaagagctagaattatctgtgaagaaggaactagaaaaaatactcaccacagcatcatcacatgaatttgagcacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523127 - DNA, 163 bp, Homo sapiens
tgactcgtccctcctctcactctgccatactcctcacactaccgctcctctctctacccctcctgtctctcctcccctcctctctcttcctctcctcactctcttcctctcctctctctacccttcctgactcacttcccctacggggtcatacgactaaacg

SEQ ID NO: 523128 - DNA, 214 bp, Homo sapiens
tgtgtcatgcaccgtcctgatgtatatagtccatatactacaggaggctgggacaggaggatcgcttgtgctggggaggtcgaggctgcagtgagccatgatcacaccagtgactccagccctgggtgacagagtaagacccttctttttttaggcagacaagaaaagaagcgagacacacttagggtgctacaaaacatatctcgcaatagtt

SEQ ID NO: 523129 - DNA, 719 bp, Homo sapiens
tgctgcagccccggtcccagcggctaaatggacccccgatgctcggggagtggggaggccgctccggcccagctgctctgctgccctccggctccccctcccgcctccttccctgcgtccttcggctcttgcatggcccggattcatccggcttgccagcaggccccatattgcggcggcctgtttgcctccgagggccatcccccggttccggtgcgaggcaatgccgcggtaggcggcgacggtgggcagagggccaaggtcatcatgccttaggcggcgaacacaaaacactctgcccagcagtatacgcaaacagcaaagagagcgcaccacaaacgcgcatatagagcacgcaccgtcgaagtcgcaagcgataggtagaaggagtacacagccgcgaaagcgtgaaacacagaaaagcgtagtctgtatacacacacaaagaagtacaaaaacatacataaaagacaccaaagccacgatcgcgcgacaccgcttgctgacgcacccaaccacagatgcaatatgagcgaggaccgcaactgcgacagaggaggaaatcaacgcggcgaaaaaagtgcactgctgatgctgccgaccgcgcgccgagggtgccaacgaggagatccgagtagaccggcgtcgtgattagaacacgcaaggacccagacgtgcggatgacaccgggaacctgtcccgacacacattagagccca

SEQ ID NO: 523130 - DNA, 151 bp, Homo sapiens
gttttggttattacaaaacagaaaagaacaacagcaacaaaacattgtgtgaatatatgtttgtatgtgtgtatgtatatcatgaattttttttttttaaggtctgaaaaggacttgttctctccttaaaggtgtaaggaatgttaattgc

SEQ ID NO: 523131 - DNA, 434 bp, Homo sapiens
  misc_feature (2)..(2): n is a, c, g, or t
  misc_feature (32)..(32): n is a, c, g, or t
  misc_feature (56)..(56): n is a, c, g, or t
  misc_feature (60)..(60): n is a, c, g, or t
  misc_feature (92)..(92): n is a, c, g, or t
  misc_feature (101)..(101): n is a, c, g, or t
  misc_feature (117)..(117): n is a, c, g, or t
  misc_feature (119)..(120): n is a, c, g, or t
  misc_feature (125)..(125): n is a, c, g, or t
  misc_feature (159)..(159): n is a, c, g, or t
  misc_feature (392)..(392): n is a, c, g, or t
  misc_feature (405)..(405): n is a, c, g, or t
tnttgttgagatggagtcttgctctgtcaccnaggctgggataggaagcaggcccnctcngtattcgtttgctggggctgccataacaaagnctcacacanggagtgccttaaacancnncaatntcatatcttacagttctggaggccagaaggcacngatcaaggtgcgggtggggttggtttcttctgagggtcataagggagggatctgtctcaagcctctctccctgggtttatagacggccatcttctccccatgtctttacatgggtctccatttctgtgtgtgtctatgtcctaatctcttctttttttgttgttgagatgggagtcttgctctgtcacaaataaataaataaataaataaataactaaataaataaatagatnaagaatgtagggnatggggtgaagcccaacagggtcagggaa

SEQ ID NO: 523132 - DNA, 520 bp, Homo sapiens
aatttagaaatgtccactgtaggacatggaatatggtaagaaaactgaaaatcatggaaaatgagaaacatccactagacaacttgaaacacacgaaatcacagaaaagcgtgaaaatgagaaatgcacactctagaacctggaatatggcgaggacactggaaatcacggaaaatgagaaatacacactttaggacataaaatatggcgaggaaaactgaaaaaggtggaaaatttcgaattgtccactgtaggacatggatatggcaagaaaactgaaaatcatggaaaatgagaaacatccacttgacaacatgaaaaatgacgaaatcaatgaaaaacttgaaaaatgagaaatgaacactgtaggacctggaatatggcgagaaaactgaaaatcacaaaaaatgagaaatacacactttaggatgtggaatatggcgaagaaaactgaaaaaggtggaaaatttagaattgtccagtcgacgcggccgcgaatttagtagtagtaggcggccgc

SEQ ID NO: 523133 - DNA, 96 bp, Homo sapiens
atagatagatagatagatagatagatagatagatagatagccagccaagatagatagactctgtctcaaaaggaagggagggagggaaaggagaga

SEQ ID NO: 523134 - DNA, 852 bp, Homo sapiens
  misc_feature (63)..(63): n is a, c, g, or t
ggacccactccatacggaaagtctttgtaaagaacatacttgtttcagcttggaatacacgangactctcaaaatcggaagaagctttcagagctgttaaggtactacacatctgcctctggtgatgagatggtttctctcaaggactactcgcaccatgaatgataggagaaccatgaaacatactctattatactcacaaggtagagaccataggacctaggtaggctaacttcagcgtttgtgtggaactgtctctcgggaaacatcggctgtacgatagtgactctattatgattagtagcccatttgatagagtacctgtcgtccagacagcatgaaggaatttggagagggaaagactttcactgtcagttcaccaaagtaaggcctgggactttccagaggatgaagaagagaaaaagatgcttgaagagaaaaaaacaaagtttgagaacctctgcaaaatcctgaaagacatattggataaaaaagttgaaaaggtggttgagtcaaaccgattggtgacatgtccatgcttgtttgccaccagcacatatggctgcgcagcaaacatggagagaatcatgaaagctcaagccctaagagaccactttaacattggggtacatggcaacagaaaaacacctggaaattaaccctgaccattcattacttgaaacctttatgcaaaggcaagagctgataaaaccacaggtctggaaagatccggaatctggattaagaacctcgctcctgtttccgcttccggttgtaaataccaaaaatgccgacatatcatagatgccaacttgtttgggtataagaacatacccactggtatagtcctgt

SEQ ID NO: 523135 - DNA, 86 bp, Homo sapiens
tgcggaccctctcaacatgcactctcaaaatcaacacacctaccccaacccaattctcatcgcttcacagtcatccagtaaagtac

SEQ ID NO: 523136 - DNA, 781 bp, Homo sapiens
  misc_feature (364)..(364): n is a, c, g, or t
tttttaaaaaccccaaacattatattggcttgactaatcgtggacattcttaaaaaaaacgggatgctgcaacagctgccccctggggttaaggggtggtgcccttcacgaaactccattgccgtgaagtctcggcggctaataaaaaattttaagggtgccttcattttcagaccaagtctccggggggtattttcggtcttaatagccttgggcacactccagtataatactttactcattgccgctgggcagggataccccacattttgccacagggtcagactctcattgaaggtggtagcgcctataagacgccccagcgggcgggccacacactgtgtgtggcgtgttcttaaattgngcgagaccgtctatccacaacagcagataagactgttccctctatacagtctatatctcacgcttatctggcggcgcctgggtgagacgccgccctgtttggagagggctaggacgctttccgggcgccctggagaaaagggggtgtcccccagtgccgccccggggattgagagcgcaagacccctggtggtcttggcggcgagcactgtggcgcattggggggcggccatagaaccacaaagaccttctgggatatgacgcgtgccccgattcaaagcaccaggtggactcctggagggttgacctattgcgtgttgcaacgagtgcccttggcaggggggagccttgcccccagagagacaaacataacaggcacgaatatgaaccccccgccaaaatagaccgcgccacacat

SEQ ID NO: 523137 - DNA, 1168 bp, Homo sapiens
cccataactgctacgcacgaggcctgcggttttacatcggcactgaggacctgcatggcccttgtggtacagcatgcagcctggatgcttggagctgtggagcgtgctgcgtgcgggaaatccgcaaggagctgaagctgaatggagggtgctatgagaacctgcgtgctgtgtgccaccactgaccttgtgtgcctgcatgcctgtgtgcccctgtagatgctgctgctgctgtgtgtgctcctctgctgcctgcctcgacctgctgcaccatgcagctgcatgtgatgctgcactgcccactgtggtgcttccctgaccctgtgctggccacccactgatggcccctcagtcccctgtgtgctgtggtgtgccccagcctgcctctgtgcctaccaagcctgagccgctgtggctggtgcctgtgacgaatgcccagtttgtgccagtttgatggcctgacacggtgttgacacgccacgtgggcgtgctgtgcatggacaccattgagtccaggaaccttatcatgccaacttgtgcaggacaactcaaaggtggacctgggcaatggcttggcttgcttgcacaaggcaccaaggccacgaattgttctgccacgtgaccacagtaaggaacgccaacgatctggaccattcaatacctgcaacttgcgaagctcccgccctgggtgccgctttgcacagcggcctggtggtcaacgctttggaagaaccctatgggcaatggcgcccggcgtattcgaacaacacccagaatgtggcgcacgttcccttggaccatttggggcgcgacttttgttggcgacggcatggctggacatatacggaaacgcaaggccttgctgtggccacgcagcttttcacccgcatgattgggaaggccaccgccgggatgggcccatgaaggtgcgattgaccacaaagtgaaaacccggtttacgtttggtcggccacatttgccttccatggtcctgactttgtgcccagatgtgtgaccgccccgttggaagcacggccaaacgctgacatggacacatgatgcaatgtgcaccccaacgctgaaagcaacgcttttggaaccaatgaacattcccaagagcagagcaaaagggcctgcgtggctggcattagactagtgtgtgcggaaa

SEQ ID NO: 523138 - DNA, 460 bp, Homo sapiens
  misc_feature (1)..(2): n is a, c, g, or t
  misc_feature (4)..(5): n is a, c, g, or t
  misc_feature (8)..(8): n is a, c, g, or t
  misc_feature (14)..(14): n is a, c, g, or t
  misc_feature (42)..(42): n is a, c, g, or t
  misc_feature (44)..(45): n is a, c, g, or t
  misc_feature (351)..(351): n is a, c, g, or t
  misc_feature (360)..(360): n is a, c, g, or t
  misc_feature (411)..(411): n is a, c, g, or t
nntnnctnagactnccgattagctgggactacaggcgcccgncnncccgcccggctaattttttgtatttttagtagagacggggtttcaccctgttagccaggatggtctcgatctcctgacctcatgatccacctgcctcggcctcccaaagtgctgggattacaggcgtgagccaccgcgcccggccactctcagtagaaatattactgatgttagcataagttttttgttttaaaaaataagatgtcctattacttaaaccaatcccaaaaggtattagcatgtataagaaaaagttctggccaggtgtgatggctcatccctgtaatcccagcactttgctgctgntattttggnaaactgaagaaattattaaagaaagaaccgttggcattattaaaatctagncaattttattactaattgctatggaactctaggggagtccctcatcata

SEQ ID NO: 523139 - DNA, 408 bp, Homo sapiens
cggtgagttgataactgatctcgggattgtaactggctcgtgagttgtacatgcctgggactctgttactgggtcccctgattcttagtgtacctcggttcagataggcatcccccgacataagaaggcagagaccctccttcgtgacgagcacaaaatgctatgacaggtaatagcagagagaaacatcagtcacccaactctgtatagccaagtccagtcacccattcacaagagtccaaaatccttcaaatctctagggatcagaagacaaccgtgctgcccagaatgagctgagacacaaggacaaacccttgtgacatgacacatggatagaggaggctgtggttgtccctccttattcctgctggattagcagccacggctcttgtactgggccagaaagga

SEQ ID NO: 523140 - DNA, 928 bp, Homo sapiens
gtgcctccgggaagatggcggcgtgcagagcggcgcaggtgagagtgtatggtagtgagccgaaactgagcaagaaatagtgatcatcattagttccacggttgctctgcacatgttgactctatctgctgttaggcttgttgtcggggtccctgagcaaatgctccatgggcatatgtggggatcacagggtacacgtgcgagctgggatcaacattgcatccgtttcacacgtcgtcgctcacaagtgatcaatgtcagtatatgtctgatcgaccaggaaagtgcagactgatatgaagacgccatgagataggactgagaatgagaagtaagcacgagtaagcgaggtgcaaagcagcaaagagcgtcagtgaggaaacgagctacagtccaaggcgcactgcttgctgccactcaaggcaggactactgatacatggtgtgggtcctgatgatgaggagcggtggatctcaaaagtcattactagcaaagattcgcgcagtcaagctattcagtcagctgaaggtcagatggggaagatccatacccacacaagttccatgtatacattctctacgtcactgacttcagtctcgaaagaatatagtcacctgtcagcctggggatctagcctgactgatcatcaccgttacaggtggcaggctaggatccatgtccagaatagagcttctggggggaaagctcatcttctatgatcttcgaggagagggggtgaacgttgcaacgttcatgagcccaagttgcccgaaccattgattacattcagtaagaaagaatttatttcatagttaattagacagcctgcgtcgggagagacataagttggagttccaggcggatcctggtaaaccgaagacaagggtgagctgagcctcttccgtatgagatcacctggtgtctcctg

SEQ ID NO: 523141 - DNA, 968 bp, Homo sapiens
tggggaaaaattttgggtttgaaaaaacccccttaaaggggttcacccaaaaatttgggagggtttaaaaatttagaaatttttttaaaaattgggaaaaaaatttgggattattcaaaaagaacttagtggttaaaaatttggagaatatgctttcataaaatatccgtacatatctagaagtaaggaggcctctccttcaaaagaatcgggttggatagggggacgtgggtgggcaactaagttgaattataaattgtgggcccttcggctaacatctcacatttattggaagtctatcagaggatacgactctattgtgggattatattatccaaatagtatcacaccaggcttatcagtattaaaacataaagggctccatccaaaagagagctctcaacaacttgccttacgtcggatatatccattacagaaaatcccacaagttgtttcaccacacacagcgaaatcatcaccactggcacattaccacaagcggcgtaaagctgggcagacggctaatcatctactcataaccccaacaaccttagcacacaggggacaaccccaattcccaacccagccagacatactccggaaaacagcacaaacagatgcatgcctcctataggagggacaccaaataagcaaatcctgagcgaactggtcctgcgcaccacaggacttggactacctcacggaccaccagggtccaacaaggagggggccctcacaaaaaaagagaaccccatacaacaagccttcatacttattgttcgcccaccacacacacatgtccgcaatctcacacgcagcgaagccctacacacactacacaagcgtcccgcacaactcgcacagaacaactccgcgcacgctctaagggcccacgcgaccaccaccaccagagccgggataaaccagagcgagccatcacacctccgacactacaagaagtgccccac

SEQ ID NO: 523142 - DNA, 253 bp, Homo sapiens
ctgataagacataggagatctgcttattgatcggcttgtgcctgtctgctctgcgaggacaggaaattttgtctgtttttgttcatgcaatatccctagcacctcaacagtgcctggcacatagtaggtgctcaagaaatatttgggttcctttctttctttttatttgtttagtttgttttttgagacagggtctcaccttgtgacctaggctggagtcagtggcaggatcatggctcactacagccttgac

SEQ ID NO: 523143 - DNA, 1599 bp, Homo sapiens
aaaagcacagtgactgtcagcagattcctttactatttgtctcgctgcgcgcagcgctagcgcaacttgctctctcaactgcacttctctaaacagctgctttctgcacaacttgcgccactggcctgcgccctaactacgacacctgcacactcacccccgcgcagctgccctctactcctctacacacacttgacacgcacttctagcgcgcacgcccctgcccaaacctttacaccaagctcctcaactccacgcgctgcaattctccttctctctccatacccacgctaaaacctgcctcctcgcacccaacacttaaccatgcgggcctttaaacactttggactgagcgcaccaccgcggggattcccaacggcaaagtctcatctaacaaacggcgcttgcccttctctcaacacggggcttaggcccccaattcaattgggaccccgcaccttaaccattggcctctactagcgctcccattatatctccaattaacccattggtcctcttcatccaacaattactccccccccctttaacacacccttcatcccctcacaaccaaatatactccgtcaattcccaaaacgaacttcttcaacacaaaaactccttttaacaacacacccatttacactatcacccaaccattcccccagatcctaaactttcccaacaccctgtgcctaaccctccccacccccttgcacaaacttcaaacttcctctcggcacccttcccatcacacttcctaacccccctcttaacgattgccctttacaccaccgacggggagcaagcatgggcccacactttcatagggccccccatataaagcccgggcaaccaccaacgggcccctaaataaagcgtcttacccgcaacgcttacactttggcggacccaccccgaagaaatcgtggggccaaactataacggcatttgatctccctttcccaaactttggcttttaaaaaactttttataacggggattctatctcttctggggccccctttccccaaaactcccccgaataccagattttaacagctccttataacccccaagggcgacaacttttgggaaaaacccccccccccgggcgcttttcctcgataagcaccaaccccgggaatttgagcggacccccacttgattgtccacccctcaccatttgccgacgagcaacaaacggggcagtcacccaccgcccattgccccccacttttgcccacacaaccacaaacagcgcccctcaacacgggcccatccggccgacgactcaggcttggcaaacaccaacccgcgcaaaaccccacctaacccaccaccgacttccccaacacgccacacaaccgcaacacccccctacaccagggggacaacccgaccacaaatacgacgcccactcccctcaacaacttacacaacccccccccacccaacccatacgacacatctgccctaccaccaacatccttcccacttaaccgcccccctaaacttctagcacccactcacaccatctccacacaccacccacaacacccgcccccactttaccaccatcaccgacacctacggccc

SEQ ID NO: 523144 - DNA, 1124 bp, Homo sapiens
  misc_feature (284)..(284): n is a, c, g, or t
  misc_feature (330)..(330): n is a, c, g, or t
  misc_feature (419)..(419): n is a, c, g, or t
  misc_feature (478)..(478): n is a, c, g, or t
  misc_feature (482)..(482): n is a, c, g, or t
  misc_feature (488)..(489): n is a, c, g, or t
  misc_feature (505)..(505): n is a, c, g, or t
  misc_feature (526)..(526): n is a, c, g, or t
  misc_feature (528)..(528): n is a, c, g, or t
  misc_feature (530)..(530): n is a, c, g, or t
  misc_feature (532)..(532): n is a, c, g, or t
  misc_feature (540)..(540): n is a, c, g, or t
  misc_feature (543)..(543): n is a, c, g, or t
  misc_feature (557)..(557): n is a, c, g, or t
  misc_feature (567)..(567): n is a, c, g, or t
  misc_feature (572)..(572): n is a, c, g, or t
  misc_feature (576)..(577): n is a, c, g, or t
  misc_feature (585)..(586): n is a, c, g, or t
agcggatatatacagtccatccgggttctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccggccccgccaggcccggcccggactccgcgagccccggcctcctcgntcctcggtcgccgctgccgccgggcttaacagccccgtccgccgcnttctcttcctagtttgagaagccaaggaaggaaacagggaaaaaatgtcgccatgaaggccgagaaccgctgccgccgccgacccccgnacggccctgaacgccatgaggcctgggtccccgccagcgcccgctcgcgctccgactgncgtncgacgnncgaggacccacgatgnatgccgctgagctcccccaangncngncgacaccngcntccgacatggacangaaccagggntccancagnntcctccgnnctctacgggcagcagaaaagggcaacagcacgaccccgctccgcctcaggcggggcagccggcgacgtctaaaacccacgacgcgatggcacgaacccagggcaccaagcgtcaacaacgaacccgtgaaccatcctagccaaaaatgacagtagcaccaccagcaccccgcggcaccagacccacgcaaaagccagacattgaccccagcaagcaccccgccaagaggacgccggcgcacaaccatagcacacaacgcaaggcgggagcacgcacggaggacagaccgcacaggacgagaaccacaccaagcaacagcaccgcgcacacacgagacaaagaaaagagagacaccgccagcccaccggaccaacagacggaagacacagcaacacaaccgcgccaaacaagccagacaacaaagacgcagcaggaacacaccaacaaagggccacgcagcgacaggacacagcaaccaggacaagcgagggcaggcgagcgagcgccagaacgaacaacctgcatgtaagccagaaaa

SEQ ID NO: 523145 - DNA, 112 bp, Homo sapiens
ggacctcctcctgtctaagctctaaaggctctctctgtggtgacattcccagtctccaacctgggccacgccggtgactcgctcatccaatcgcccaccagcgtttccatga

SEQ ID NO: 523146 - DNA, 503 bp, Homo sapiens
ggtgatggtgttctagaggatccctcaataggtgcgcacggcaggtaaggagagtagtgggtctggcttaggggtatagcctcctcagggagtcacccagcagcagtcacctggtaggtccagagagtgagatggtatcacggaactggcattgacctcagttcatgggtcctcatgctgtggggtggaacatgtagctgggcagggcccgggcctcccgaggtgcccatgtcccactgacccaaggacaagatggccagtggagaaaggtgcagattaagatgttggtttgggtaacagccgaatgatgctcgctggaaggaaagccgccctattccttcagcgcttcgactccatcgacaccactggccctgcgtgttggcctcactttttcacccatcagtgctctacctccccttcccccatgttttagaattccttttccttaggactcctgagtcccagacagaaggtcctgggggagatggtttcctggactgggg

SEQ ID NO: 523147 - DNA, 299 bp, Homo sapiens
agatccgctgtactatcatacaataatttctacaactcatctcatacttatcttagaatatccatccttttctaattgtatttctgtattacgttagatttctcttcaaactaatgtaacccaaaatacactgtaacagtatactagctgtcttctgttatgctagatgttcaaagatgtttgcaaaatatgtaaacagtgcctgacgacttctcattataaaaaaaaattggggaagacggattataggctcacacctacaatcccagcactttgggaggccgaggcgggcggatcac

SEQ ID NO: 523148 - DNA, 1992 bp, Homo sapiens
  misc_feature (1563)..(1563): n is a, c, g, or t
  misc_feature (1593)..(1593): n is a, c, g, or t
  misc_feature (1619)..(1619): n is a, c, g, or t
  misc_feature (1623)..(1623): n is a, c, g, or t
  misc_feature (1689)..(1689): n is a, c, g, or t
  misc_feature (1700)..(1700): n is a, c, g, or t
  misc_feature (1712)..(1712): n is a, c, g, or t
  misc_feature (1723)..(1723): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgtagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523149 - DNA, 117 bp, Homo sapiens
tcgatgctaatactggagaagatgtggggcaatagaggatcatctagtgctgggaagaatgaaaaaagataaagccacttcgggctggcacggtggctcacgcctataatcccagca

SEQ ID NO: 523150 - DNA, 2106 bp, Homo sapiens
  misc_feature (1677)..(1677): n is a, c, g, or t
  misc_feature (1707)..(1707): n is a, c, g, or t
  misc_feature (1733)..(1733): n is a, c, g, or t
  misc_feature (1737)..(1737): n is a, c, g, or t
  misc_feature (1803)..(1803): n is a, c, g, or t
  misc_feature (1814)..(1814): n is a, c, g, or t
  misc_feature (1826)..(1826): n is a, c, g, or t
  misc_feature (1837)..(1837): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaggtacctgtgcgtgcacgcagacgggaagggctggggaagcgggaggactgagaaaagccaagatcttagcaaagcaatgtctcaagatggtgcttctcagttccaagaagtcattcggcaagagctagaattatctgtgaagaaggaactagaaaaaatactcaccaaagatcatcacttgaattggagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523151 - DNA, 214 bp, Homo sapiens
  misc_feature (12)..(12): n is a, c, g, or t
  misc_feature (40)..(40): n is a, c, g, or t
aacatggctganttgagattacactgccatgatacattgnctgacagcacttcacattttccctgagttggggacagaaatcacactgcccaaatacattatctgatggctcctcatgtttcccaaaagttaggaaaggaggttctatatacatacatgcacaagtgcatacacacacacacacatacacacacacacagtgctagatgagatg

SEQ ID NO: 523152 - DNA, 1992 bp, Homo sapiens
  misc_feature (1563)..(1563): n is a, c, g, or t
  misc_feature (1593)..(1593): n is a, c, g, or t
  misc_feature (1619)..(1619): n is a, c, g, or t
  misc_feature (1623)..(1623): n is a, c, g, or t
  misc_feature (1689)..(1689): n is a, c, g, or t
  misc_feature (1700)..(1700): n is a, c, g, or t
  misc_feature (1712)..(1712): n is a, c, g, or t
  misc_feature (1723)..(1723): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523153 - DNA, 116 bp, Homo sapiens
tctgaggatccccactgcgattcggttcttaaacaccaaaagaacaatcaagattagaaaatatagacaaactatattgatacgatggggtcaaatatttaatgtcacatttgtgt

SEQ ID NO: 523154 - DNA, 287 bp, Homo sapiens
gcccccggactatatagagctaaacagttgctaatttcatccatgcaaacaaaattgttcattcctgtctgatttgggttttaaggaaccatgctgcatcatcagagaaaccaggcaattctattctgaagcccagggtaagaaatggtggggatttctgagttacagattgtgcaggtgttaacactatctgccactatcaagggaacaatctatcttggtacaactttggtcttccactagtgacctgtatccagagtagcaagatcagggcctgcgtgaccgat

SEQ ID NO: 523155 - DNA, 1736 bp, Homo sapiens
  misc_feature (1307)..(1307): n is a, c, g, or t
  misc_feature (1337)..(1337): n is a, c, g, or t
  misc_feature (1363)..(1363): n is a, c, g, or t
  misc_feature (1367)..(1367): n is a, c, g, or t
  misc_feature (1433)..(1433): n is a, c, g, or t
  misc_feature (1444)..(1444): n is a, c, g, or t
  misc_feature (1456)..(1456): n is a, c, g, or t
  misc_feature (1467)..(1467): n is a, c, g, or t
atttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggcaggcatggcactccatatgaacaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523156 - DNA, 933 bp, Homo sapiens
  misc_feature (161)..(161): n is a, c, g, or t
  misc_feature (350)..(350): n is a, c, g, or t
agcgggtggcagggctagcagggcgcgcaggagtcccggcgggattgacgggcgcagggtggctgcccgcgggtaggcggcggtcatgaacgttctccgaggtatgcaagtctcttcgcagcttactcggtcaagtgctccccggatccggacaagtaccntggcgttactctgtgttccaggatccgtgtataagaagtgtcctgggatgtagaactaacctcttgcatgattcgcttgcaggatgttagcactgtgtcgctatgactcaagataccagtcagcatcagatgtggatctgcggcgagaactctgcttctatgcatccatgtgacaccaagaggttagcnaagtcggaagggctaggttgcgagggtactggcgtctgggttaaacgccaggcgcctggaagtggcgatcttgcgaatagatgagtacgaaggtgctctagtccggaggctaggtgtgcctgcgtgcctgtagcccaggatacgggcgccaccaattcgtcatatagtcacaggaattgccattgctgctggataaccagacgtggtcctttgtgcatcacaatattgctgggtccttacagtgcaaatatgcgcgaaaaggcttgtccgtggcagggggatactcacccgtattgaccaggggggacgagacgagttacagtggggcagctgggtatgaaacggggtcagaatctggcacaagaattaaggttgaggcaatctttcggtctgcaagttggaatttgggcagcttactcgtggcggacatttttgggaatactggaatacctcaagggaatcctcagagggggatatgaaagtgggggcacgtgaaacgggctggtgtggcttggacaggttgtgtgtgacacactagtttgggaagatacaagaattctggttgtgacttcaattggatagg

SEQ ID NO: 523157 - DNA, 123 bp, Homo sapiens
gtgcatacccagcagtccagtgcaatgtctcctccatagctctgggttcttagatcttggtggacgtttgttttctccttagttgcatttcctggcgtttgtgatgatcaatggactttaatg

SEQ ID NO: 523158 - DNA, 1974 bp, Homo sapiens
  misc_feature (1545)..(1545): n is a, c, g, or t
  misc_feature (1575)..(1575): n is a, c, g, or t
  misc_feature (1601)..(1601): n is a, c, g, or t
  misc_feature (1605)..(1605): n is a, c, g, or t
  misc_feature (1671)..(1671): n is a, c, g, or t
  misc_feature (1682)..(1682): n is a, c, g, or t
  misc_feature (1694)..(1694): n is a, c, g, or t
  misc_feature (1705)..(1705): n is a, c, g, or t
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacaggtgccntggttaaattaggcagttctttacgaaggntccacgattatctaagaagatttganagtntaccagatatgcttgaattgggatcacctcacagttcaggaagatgtgaattgggacacaatggtncattaaaggangggtataacatngcaatctgggncgaatgatatccacctggagcaggaatgagacgaggatgggtctgggagctcgcatctggacactggattgaaaatctgggaccttaatagggagtccttacaggagccctaggatccaaaaggggcattatatgtagaccgcgggttaaaaagagtcgcggcattgctaaacagggacatctcgagaacaagactagagagcacggggggatcaaccatctggccacggccaaaaacgggctggcgggtgttcatcagccacacgggc

SEQ ID NO: 523159 - DNA, 692 bp, Homo sapiens
  misc_feature (10)..(10): n is a, c, g, or t
  misc_feature (15)..(15): n is a, c, g, or t
  misc_feature (40)..(40): n is a, c, g, or t
  misc_feature (54)..(54): n is a, c, g, or t
  misc_feature (63)..(63): n is a, c, g, or t
  misc_feature (178)..(178): n is a, c, g, or t
  misc_feature (190)..(190): n is a, c, g, or t
  misc_feature (195)..(195): n is a, c, g, or t
  misc_feature (211)..(211): n is a, c, g, or t
  misc_feature (219)..(219): n is a, c, g, or t
  misc_feature (248)..(248): n is a, c, g, or t
  misc_feature (263)..(263): n is a, c, g, or t
  misc_feature (285)..(285): n is a, c, g, or t
  misc_feature (317)..(317): n is a, c, g, or t
  misc_feature (323)..(323): n is a, c, g, or t
  misc_feature (387)..(387): n is a, c, g, or t
  misc_feature (405)..(405): n is a, c, g, or t
  misc_feature (409)..(409): n is a, c, g, or t
  misc_feature (415)..(415): n is a, c, g, or t
  misc_feature (447)..(447): n is a, c, g, or t
  misc_feature (464)..(465): n is a, c, g, or t
  misc_feature (494)..(494): n is a, c, g, or t
  misc_feature (498)..(498): n is a, c, g, or t
  misc_feature (543)..(543): n is a, c, g, or t
  misc_feature (566)..(566): n is a, c, g, or t
  misc_feature (572)..(572): n is a, c, g, or t
  misc_feature (595)..(595): n is a, c, g, or t
  misc_feature (612)..(612): n is a, c, g, or t
  misc_feature (615)..(615): n is a, c, g, or t
  misc_feature (618)..(618): n is a, c, g, or t
  misc_feature (621)..(621): n is a, c, g, or t
  misc_feature (624)..(624): n is a, c, g, or t
  misc_feature (627)..(627): n is a, c, g, or t
  misc_feature (635)..(635): n is a, c, g, or t
  misc_feature (637)..(637): n is a, c, g, or t
  misc_feature (640)..(640): n is a, c, g, or t
  misc_feature (665)..(665): n is a, c, g, or t
  misc_feature (692)..(692): n is a, c, g, or t
tgcaagaggnaagtnaaagattcaatttgattcttctagnggggggaaaaaggngtggaaagnggggcttcattttgcagtaatcatctgtccgaattcttcatagtggacttgtccgtctccatcaatatctgcttctctgaccatttcatctacttcttcatctgtgagtttttcncctaagtttgtnatgangggacggagtcctgcngccctganataaccattgccatccttgtgaaagactnggaatgcctcagggntttcttcttcactatctgtttntttcatttttctagccatcaaagtaaaaaatncggggnagtcaatggggccattcccatcagcatccacttcattgagcaaatccggcaattcagcttctgngggcgttctgacccagtnaccncagganagtcccaagtccctttgtggtgagggggccancgccatctttatcaaanngggagagggcttccttgaattcagcaatntgtncttcggtcagctgaacagccatggggcgagccaagggaggaagancagagggagcgagggtggctgcnccagcncgggggctgcgacggcgggggtncctccgatgctgccgcngcngcngcngcngcnaaggcgcncngtncctaatgccgccgccgccgcctgcnccgccgccttatttcgagttagggcan

SEQ ID NO: 523160 - DNA, 1027 bp, Homo sapiens
agcggatggagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactacaccaaaaaagacctggatggatttcggaagctatttcatagatttttgcaagaaaaggggccttctgtggattggggaaaaatccagagaccccctgaagattcgattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatacttccgagggccatcatttgcgtgggaaaaatacacttttaataaaggagggccccggggatataaagaattctactttctgtagcaaagacgtgcttactaagggagaatcacgaagctggtcccttcaggcatggggataattagccaggtctacaaccttgggtggtggaaccttttagagaagcggggattttgggtc

SEQ ID NO: 523161 - DNA, 375 bp, Homo sapiens
taccatgactcaagcgatcttccacctggcctcaaagtgctgagatgacaggcatgagccactgtgcctggccccattttaaccatttttaagaacacattccattgacattaagtacattcacattgttgctcaataatcaacgtcatacatttccagaactattttcatcttcccatactgaaactctggacccaagcataatatttttaaggttcatccatgttgtatcatgtatcactactttattcctttttatagctgagtaagattgccttgtttgggtatattgccattttgttcgtcagttgatggacatgagttgtttccacttttagttattatgagcattcatgtacaaggattggtttgaac

SEQ ID NO: 523162 - DNA, 214 bp, Homo sapiens
cttttcgcactttggtgatctcattctcatgggcacgcagctctctgaagagtttgggcattttttctggcaagtctccttcagctggattcttgagacagataagacgtcgttccaaccttcaccaataggtgtacaatgctccaaggactaactgttgctacatttgatctgttagaccagcaagtcagatgcgttgcacaggatcattcag

SEQ ID NO: 523163 - DNA, 682 bp, Homo sapiens
aatacgacgatacgcgacgccgcatatctgcgctcgaagggcgatgagaatccagatctcaaatatgcacccatgcgcatatccgccgagcacacacgctctacaccggctgcggtgtatgccatgcgctctaaccattccttccttggcagcaagggaatcggcggcaacgaaatcgcgaactgaatcgcgggcattggctgggcccaacggtgaagctggtgcaacgcctggtctgacttttcattccaatcctttgaggtggcttcaagcttttcggcttggttgcgcacgtgttccttctggggtttataacgcttgagctcgtcggcgtagagcttggcgtgaacccccggaatatgggtcgccaggttcgcaagggtctgtcggctgtgatatggcctcggagtaggtccacaggttggcggcttcggtcttgaagaaggcggcgttggttttgtgcataggcgcttcgctttcgggggagacgcgctggagctgagcatgtggccgacagtggccatgataggggtcataacggcgatacggctggcgagattatctccgctgtggtgggcatgttcgcggggcgtgtttgacatgtttttcgcggggggctgtggactttgaagggtttgacatgggagcgtgtatggggattagggttgatacttacccccgg

SEQ ID NO: 523164 - DNA, 1572 bp, Homo sapiens
gtgaaatctttcagtaaagttgtccaaacctttaatactcttctagtttggcatttaaatgttatttcattgtcccttttatgaaaatttactctgtttctacataatgtatttatatattttttgtataatcactatctttgtatttacaaaaaaatgcacttgagactgatgtggaggcactcactattttctgcctttctagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcatggtacgtgtggcttgccattcatcgaggtttgtgacgacattcttctcatggtattagatgttgccagacggtaggccgctttctcttgtcgcttgctctggagaccctgcgattcacgatttctcttttgccttggtgttgagtggttcgtgttgccttcgtactacgtgcttatcttgccctttgacttcttcttgatcaactcgtactttgcatctgtcgctgctggatatctttctcttgatcttgttgcgctccttgccgtcttctcccgtctatgccgccttgttctcctgtgttcttctgggatctgtgtcctcgtcttgccatttctctcttcccaggcacagcgatccgtcgaccatgtttcctcctctctcgcatcgttcgccttctgccacctgccgggccttcctccctcctccactcacgccctccccccacgcgccaccacctgctcgccacccctccctcgcccacgccccaccctcggttctcctctcatccgcgcccacccccgcgcccctcctcccctcctgtctgcccacaatcccctgcgctccaccccgccaccctctgccccacctcccccccccctgcgccacgcccccccctccctgaccccccccccccccccacctctgctcgcctcccctcgccccaccccccctcctccgcgcctctctcgcgcacccccccttgcccccttcgcccccctccctgctgccgccccctccccccccctccctgccgccccctcccctccgccctctcccccctgcaccccctggctcctccccccgccactcccctcctctccctcccgcccgcgcccccccctcccccacccccccccctctcccccctcccgccccccccccccttccccctcccctccccccccctcactcccatacccagtatcctcgtcctctccacctctcccctctccccactacctccccccaccttacccgcctcctccccctcctcacccctccacctcaccctcaccccccacaccacctccctccactcccccccccctcacccccccactctctcccccccctccaccctctctctcctcctcctctccctctccctccatccctcctctccttc

SEQ ID NO: 523165 - DNA, 701 bp, Homo sapiens
  misc_feature (36)..(36): n is a, c, g, or t
ccccaatggatcccccaaatatccccccaaatggantcactcaacaatgaaatctttcgctagaatcatcgcctcaaaaaaaccagagaatggaactctcaaagtcgcgctacttaagtcagcaaagatctccacctctaaagcgtccacccctttatcctgattaacttgagcaattggttcgcctttatattgaatctccgcagtcagccttttatagcgattatcactaaagcccagaacttcaaaatccgaattactttcaagtttcatggtttcgccttagggtccaaaaacccagaaaatgagccatcattattgtagcgcagacctcttccatcgggagcccggacctctagcccaccgcgactcaaatttgagaatgttgaatttgaattcttgagaacgtcatcaataataccgagtgcagttgcattttgcttttcaattccacctgtgagttttgggaacgttccagtagctcgctggccagaagcatgctttgtgagcgccctagcagcctctgtcagaccttccttattgataggatttgaagctgcggaagatagatcatcgaaagtgcggccgccgaaattttgcagggcggaaggcaatccttttgcacctcccatcacaagccgaactaatatgccgccagcccatgcactgtgagtcaccggccataaatagcccaagcttga

SEQ ID NO: 523166 - DNA, 292 bp, Homo sapiens
gtatttgtacatgataaacgactgcttctttagagttacagacaaatagtttactatatcaagatcacgatatgttagatactgttgtcaattacagaggttttcgatgaggctttctggaatgatttagtttccctgtaagggagcctgtctattggaatagacaggttcacttctcccagtctttcaagttgcagtgcttattatatctgattccactggctgagctgattgtgaatgtcctaaccctgttgattgtgtctggccactcatgggcaaagaacagattatc

SEQ ID NO: 523167 - DNA, 159 bp, Homo sapiens
gtggatcctcatatgtcgacctgctggcttgttggcttgagcatggggctgcgtcataacaccggtcggtgactgagagaccccccgcagcttccgaccggagccccgcgcagcttctgattgaccggagccacccacagcttccaaccgcatcacccg

SEQ ID NO: 523168 - DNA, 489 bp, Homo sapiens
ttgaaaccctccggcatccatgattctagtatactcttctctgactgctgtttgtctgatgtgattgcgttcacggatgacagatcgagcaggtgctttgattgggatcacgattctgattactcacgagtggtcttcttgctcacttgtccctaggccagaggacacagggcacccacacaggaaaaggattaccaggacagagttccatggagttttggcttataccacaaaaggagtttaaggcagtttaattcaaggatgcgaaaactacttctatgacattaacattgactttcaaaaattaactcagcctttaaaatgtccccaataccaacaattcaccaaagtattcaagatgacagccattgtcagggccagttgaccagtcacaaaagcgatccaacatgacaccgttatagcaggtgctatgcagagcctccctatgcagttaacacagattgacggatgctatttgcaggccaccag

SEQ ID NO: 523169 - DNA, 748 bp, Homo sapiens
  misc_feature (1)..(1): n is a, c, g, or t
  misc_feature (87)..(87): n is a, c, g, or t
  misc_feature (102)..(102): n is a, c, g, or t
  misc_feature (106)..(106): n is a, c, g, or t
  misc_feature (116)..(117): n is a, c, g, or t
  misc_feature (128)..(128): n is a, c, g, or t
  misc_feature (134)..(134): n is a, c, g, or t
  misc_feature (153)..(153): n is a, c, g, or t
  misc_feature (156)..(156): n is a, c, g, or t
  misc_feature (158)..(159): n is a, c, g, or t
  misc_feature (168)..(168): n is a, c, g, or t
  misc_feature (210)..(210): n is a, c, g, or t
  misc_feature (236)..(236): n is a, c, g, or t
  misc_feature (248)..(248): n is a, c, g, or t
  misc_feature (316)..(316): n is a, c, g, or t
  misc_feature (319)..(319): n is a, c, g, or t
  misc_feature (374)..(374): n is a, c, g, or t
  misc_feature (406)..(406): n is a, c, g, or t
  misc_feature (426)..(426): n is a, c, g, or t
  misc_feature (438)..(438): n is a, c, g, or t
  misc_feature (470)..(470): n is a, c, g, or t
  misc_feature (477)..(477): n is a, c, g, or t
  misc_feature (479)..(479): n is a, c, g, or t
  misc_feature (483)..(483): n is a, c, g, or t
  misc_feature (486)..(487): n is a, c, g, or t
  misc_feature (499)..(499): n is a, c, g, or t
  misc_feature (509)..(509): n is a, c, g, or t
  misc_feature (512)..(512): n is a, c, g, or t
  misc_feature (553)..(553): n is a, c, g, or t
  misc_feature (574)..(574): n is a, c, g, or t
  misc_feature (582)..(582): n is a, c, g, or t
  misc_feature (595)..(595): n is a, c, g, or t
  misc_feature (609)..(609): n is a, c, g, or t
  misc_feature (611)..(611): n is a, c, g, or t
  misc_feature (633)..(633): n is a, c, g, or t
  misc_feature (636)..(636): n is a, c, g, or t
  misc_feature (645)..(645): n is a, c, g, or t
  misc_feature (668)..(668): n is a, c, g, or t
  misc_feature (726)..(726): n is a, c, g, or t
ngggttgtacaataggataaccagattcatgtccatgcctggaggttagtctggggggtcggcgggatggacacacatacagacacntagatctggcatctnatancagggcatanngtctcatgtangggcantctgggtacaggtagtcangangnncttcctagngaagtcctcacagggggtggcctgtactttgccttctgccanatgggccctttcctggcatccacctncgtggttttcantgcttccctgagacaatccacgtggaccagtgtgctctacccagtgcctggtacctcatcatcacccnatnaatgcacattcttgtcctaagtgctatctacggactatctagatcttggttccanctctgattggtgtcatcggtcatgacactccnaggtcatggcccctatcaancgcagagctccnaagagccctagtgtaccttcacttgcactgtnaaggcanancttngtnncatccttcctcntgttctggcnatntctgcactgccttcctctcactgctcagtggccccatgganacccacttcccttccagttgnatgtgggnatccacttctcanatatgcagccctgnangaagagaccctacagctcttanggncaacactanccagcactgtaagcacgagcagnaaccagcctcagcccgtagcccagggaccccctttctttcactagtaaaaaatttctntggttggggaacagcttcatgt

SEQ ID NO: 523170 - DNA, 531 bp, Homo sapiens
ggcacagaagggccaaggagctgcggtcctcgagcagcaggaggtgagctcctcagcccacgcgctgcatccagatcagatcacccctctcccttccctgcccaccaggactctgatagcccgcttgtgcaggcacagcccattttgcctaagatgtctagagtagccaaatatcgccggcaggtgagtgaagaccccgatcgatcgtagcagcctgctggtaggaccctgtctctcgcgatggagatggaggagctggtaggaatggagctggacgtggtcgtgtagccctagagcgtgcgtatgatgtctcccgtggaggctgtcggtcagatggagaaaccatacggatgaaacagtccacgggtgtgtacaaccgggaggccatgctcaacttctgtgaaacaggagaccagagaaacttatgcacgagggagatgtccactggatgtgagtgagcacaggccctgggaggggcaggagggagacaggggagggctgggagaccccgtggccttcatgatctcggca

SEQ ID NO: 523171 - DNA, 439 bp, Homo sapiens
gaagttcaagtatagtcaaaaatatcctcgaaaaatctcttgtaaaaaaatgtaccaaagctatgtctcaaaacaaaaatcactgatacttcaggtaaaggctaaatgcttccttgtactatggggccatagcatataaacaatacttatacatttacagcatagcaagatgcccactcactaagaggcacgtaggaatagaaactgagaagagctcattcatgtttcccatctcacaaacataccaggactaactcacttagcagaatgaggtgctaaatcacccacactgcaacatttcattctttctacctgaagtcacatttatccattatccattatcccctagtatgcccctcctctgaattagtttgctcagtgccaagtcaatcttttacattactgtctcccattcctgtctcccctcatttgctcttgc

SEQ ID NO: 523172 - DNA, 154 bp, Homo sapiens
agggggtgagaaattgactaacatgcagtttactcagaaatataaagctatgaaaaatttcttataaggtaagtagtatcaaataatgttatgcatatcaggatttttggtaaagtattcattaaaatagtatatacttggaatccccggtcga

SEQ ID NO: 523173 - DNA, 331 bp, Homo sapiens
gctcggtaccccagtttacacagctgctgctagttaagtgatttttttttttatttgaccaaaaaaaaaaagggcccaagaaagaaaaaaatgaaaaatttgaaaaattggagagcatgaagattttcatgctttggaactcaaaatattgaaaatactctcaagcctgtatccctgccccacgggggagcaatgactttcaaagcactgtgttttaaacattctagtttttagaggggaaaccagttgaaacgtgtttaaaaattagattgtgcctttatttattggcagggcttttctttccctcccatttctcccgtgcatctccttt

SEQ ID NO: 523174 - DNA, 255 bp, Homo sapiens
ctccttctcactaaggacacacacatttttctcattaaaatgtgcatggccacatcgggtactagcaagatcatggctcatggcagccttgacctcccaggcgaagtgattgtcctaccttagccttcccagtaactggcactatatgcgcacgtacccacacgaggctaattttaaaaatatgtattttttagagacaggatttcactctgttgcccaggctggaatgcagtggcacaatcatggctcactgca

SEQ ID NO: 523175 - DNA, 1027 bp, Homo sapiens
ggaccactgtggtgtccgagaagtcaggcacgtagctcagcggcggcgggcggttgcgttgtgcctctgagcgggtctcctggtccttctgccaatcatgccgatgttcatcgtaaacaccaatgtgcccggcggctcggtgcggagagggggtcctcttcggaggctcaacccaagcagctggcggcaggccaccgcggaaaagccccccccagtaccatccgcggtgagacggttggtccccgggacccaagctcaatgggcctccgggggagctacaaggcaagagccggggcacagctccgggaagacctgggaacagaggaattcgggacaaaaatccggggggacggcgaagaaaaccgggttcacttacgaggaaagtggtttgcatgtgtagagaccctttggtttggaccgacagcgcctgtggagcaattcaaagcgcggagcgggggttctcacttgtccaacgtattaacgagacgttggacagcgcggccaattggtgcgggctggcacccagtttccagacttgtggctaaagaacaccaggaggggaaccccaacggtatggtgtcggggtgggcgtcccaccagtggaaaacccggacggacacgatggggtactcaagggacggccaagaccacaacccattcggggtggcggcagacacacaccggggttagcaggcatacaacagcacggactagcgaagagagaaacaatgttgtgtgggagggcacagcccacgaagacaacgatattaaaaacacaactctagtgtggtgacgagtgcgccacgtgaggtatatgcaacctgtgacggcagtatgcaacgacagaaacgtagggccatgacatcgggggtgtgcctccacccaataaacacgccgaggcacgagtttttcgaccacctcagtggcctcgaggcacacgcggatacacgagggcaagcgagtattgtcgccagcgagtgaagagcaagaagcgagcaacagcagaacagcagcactaaagacagcg

SEQ ID NO: 523176 - DNA, 137 bp, Homo sapiens
cgacagacaggttcagctgtgcgacactcacccacacggtatgcatatttttacacacacatgcataccatttagtaggaccccatgtacaagcatctgagtgctttacaaattcaaatgtatttaatcaccccatc

SEQ ID NO: 523177 - DNA, 878 bp, Homo sapiens
  misc_feature (1)..(1): n is a, c, g, or t
ngtctttcctccgttccttctttccttccttccttcctttctttccttcttttcagtgagtgccctgcggcccgcccccccctcacgtccgtccgtgtcggttgttgtgttctgcaactatcaactgtgtggtggttcttcgtcgtcatgggtgttaggtttattctgtctgctcctttcttgttgggtgcgctggcgttgtagtggtggggcaacacccctctccatccgtgatgtattttttgttgtcgcgcccaccccccgcaccgacttttctctcgccgtgcgcgcctgctgcttttattttggtgtgttggttctgtcgtgtcggtttcgtgtgttgtgaatattattccctcctcttgtctcctccgggggcccacaccttttggcaccaatgggtgtgtctctgttctgtctctccccacgcgccgtgtggtctctctattttgtgttcgctctgctggtcttgcgtgaccagcccctgctccttctggttctttttttctcatccacgtcgcgcgcgcgtcgtgctgccgcggctaggtagtagtaccaccacgcctcctcttctcgtctctctctctcttgtcttcttgctgggagattttattgtgttgttccgttggcgccgccttctcgacaccgtgtcgtgccgttatttagggccccccccgtgttgcccccccccccaccccccccctctgccgcggtggcgcccccctttaagggccttagcccggaagtctgttgctctctctctctctcaccctacgggtggtttctccccccgagagttcccccccccccccccaccccccttttcccctttttttcccccccctatttgggaaccccaaaaaatttttttccccaca

SEQ ID NO: 523178 - DNA, 400 bp, Homo sapiens
ctggaacttagtacccttaggcctctttgggcagtatgtaagaactttttgtgggctcccccagagaaaccaaaggaagcctgcccccttggagccctgaactcttttttggggccctgaatccccggaaccctcaatgaggttttcaagatgaaaagactgctgccagctaccagcctgggtgggcctgtcctgtccaccctcattgccccaactcccatggtgttttgtgaagataaaagctggggtcttttttttttttttaagtctccccagacatgggggatttcccccaatttaaggtcctggccctttgggaatttggttttatgtggacagtttggcagagaaaaacaaaggttttggatgaatacagaatgtggttttcgccagaattgga

SEQ ID NO: 523179 - DNA, 855 bp, Homo sapiens
  misc_feature (2)..(2): n is a, c, g, or t
  misc_feature (171)..(171): n is a, c, g, or t
  misc_feature (180)..(180): n is a, c, g, or t
  misc_feature (182)..(182): n is a, c, g, or t
  misc_feature (267)..(267): n is a, c, g, or t
  misc_feature (272)..(274): n is a, c, g, or t
  misc_feature (285)..(285): n is a, c, g, or t
  misc_feature (299)..(299): n is a, c, g, or t
  misc_feature (330)..(330): n is a, c, g, or t
  misc_feature (332)..(332): n is a, c, g, or t
  misc_feature (343)..(343): n is a, c, g, or t
  misc_feature (370)..(370): n is a, c, g, or t
  misc_feature (372)..(372): n is a, c, g, or t
  misc_feature (445)..(445): n is a, c, g, or t
  misc_feature (465)..(465): n is a, c, g, or t
  misc_feature (480)..(480): n is a, c, g, or t
  misc_feature (541)..(541): n is a, c, g, or t
  misc_feature (579)..(579): n is a, c, g, or t
  misc_feature (595)..(595): n is a, c, g, or t
tnccttatggagaagtaccccaccctctatgaagacagaatcactctctgccattcattctgcctgatgctaacaacacgcagctgatttagggagtgtcccagcctagctggatcaagggaaattccaggcgccctggggcaggccctggccccagtgccaagcctcagngttagccgncnttgggaaagttgccaaccacttggtagaccactaggttctctgttttcccttccctttccttttcaaatcccacagtttcctgtnggggnnnagctgtttttngccttgtccaggtnccagatcccagctaggggcgcactgcttggntnactccaagaanacctgggcaccagtttttttccaattntnaggactgtggcataaatttttaaatgagttatattgtaaccagttttctccagctgccaagtggaagttggtngggctggtctccctgctgtngcccagcccttgttnggggttggtctctcactgcagccagtcaggttgttcctgggttctggggagggtaagctgncccttgccgtgttctgttccgttttttttttcctaacncgctgcttccgtgttntgagagatgggtaaatgggagatggatggagcagactgaagagacagcagatgactcagtggtggaagaaggggggaagatgctgggctggctagctaatgttcccccctttcagcgatttacaggaaatggagcccagcttggtcatgaagttggtttgcttccactgtgcgatgcactcctcagaaattttgaagtcagcctgcaacttctcgaagactttcttcttgggcttgagctcctcatctggttggcctttt

SEQ ID NO: 523180 - DNA, 290 bp, Homo sapiens
  misc_feature (226)..(226): n is a, c, g, or t
  misc_feature (242)..(242): n is a, c, g, or t
atagataggtaattatcactttattcttttacctgttttctaaatgtaacagaaggaacacatactacttttagtcgcatgaggaatttcataaaaaaattacataaatagatggatttacaaaatatgctaagaaacaaatataaaacaccactctttagcttggtaatattttttaaagtgacaaatataggatcctttctcctgaacatctctagacccccanaaccacagtcacattncagacaatacagaactacactggcatactacactacactgatatcagc

SEQ ID NO: 523181 - DNA, 1094 bp, Homo sapiens
gggagagagagagagaactagtctcgaggtatattgttttttttttagggctataaaagtcctaaggtagcagcaaaggatggtttatagaaaaaatatacttttaaaaaaaatagctgaaaaaatctaaagagataaggtataaaaagtttaaaaaatatatcttaagaacaaaatacgtgcccaaaacagtgtaaaacgtgaatggtaaaaattcacctatctaagaggtaaagagggaggttgatgcagcgtgcggctcacgcgtcctctacgggtgggggcacacaaagaagacacgaggggcccagggcgtggtggggacgtcagaagcacaagaaagccttccagaaacagcctcgtgccgggccctccacaggggggaggtgaggtgggacgggccaagggcgtgcagccccacgggataaggggacgtggtccgtgggaattatcctcaaaactcagcagaacagggcagcaaggcgtgggccgacagggcggaaggcgcaccctcgcgggggaacccagggccacaacggtgctcaaggcgatcaaaaggcgggctgttgaagcacctcagggcctccggccacaggacatccaccaggactctccacacacgtgggtccagaatcagcccagagccggacatggacgcatggagcatagggccaggaggatggccggagccaaacagccctcagaggcccctatcgcagggaccccgagccttgagaacccccacataaactgccgagacaaagaactggtggcacacgggccgaaggcaagggggctgaccaaggtctagagaacacagtcataccatgaagaaagagagaaaaagacacccaagcggttacaaactcaccggaccccacgagataggtagaaagcatcccctcggtgtgcaccgaggcgcaacaactaccccaagaggcagtccatgaaagatcctagagacgccagagcaaaagacgacgggcaacagcgccgaaacagcccctggggtgggcgccacccaaaaagggagcaagatgagccctattagcgcacagcgacagcgcaaacccagaaacacaacgcgaaggcct

SEQ ID NO: 523182 - DNA, 349 bp, Homo sapiens
  misc_feature (283)..(283): n is a, c, g, or t
  misc_feature (304)..(304): n is a, c, g, or t
  misc_feature (338)..(338): n is a, c, g, or t
ctgaagtgggagaatcactaagtcaggagattgagaccttcctggccagtatggtgaaaccccatctctactaaaaatacaaaaattagctgggcatggtggcatgcacctgttgacctagccattcaggaggctgaggcaggagaatcgcttgaacccaggaggcggaggttgcggtgagctgagatcgcaccactgcattccagcctgatgacagagcgagacttcatctcaaaaaaaaacaaaattaacacaatgtgtggaaaatataaaattagttagnaagatatgtcctagaaatttnacccttttgaagagttaatgggtaagttggggantgttttaaatt

SEQ ID NO: 523183 - DNA, 761 bp, Homo sapiens
ggccgggcccggcggacgcttgttgttgtccggccggggtgaggcggaggtcgctcgctcgctcgctcggctcgctgactcgccggagcgctctgtggcgtgtcggcgtgcaggtcggtcgcgagagcgggctctgtggaagggggcgatggctatgtcgcggtggcagccctggattggccggcagggccgggagtaacgggacgtcgcctgcggagcttcttcccccggatacatgtgcggcccgagcggagtgccgcggctgcctgcctccgatcttgaagagcccgcgctgcgctggagccctgaccccgacttgcgcaccggaacctgacgcggagcgaccagcccagcctagaccctggcctggcgcggcctgatctaacccagccaggcaggcaatacttagccccttctggagcacggagctccttccccaatagacatgaagctattggagaactcgagcttttgaagccatcaacctcgacagctgactgtggagaccggagatgcccaacatcattggcaggattgagaagctactcattgttcagcatggcaggagacgacaaaacacagtgtccaagcaagttctgccaggtagggccagacccgagttgctggagggcactattacatcaaggcccgatgacgttcaggacgttgagccccaggcagacttcagcaaataagtccaagggcgggtgagtggatgaagggcccccgtcaagtgaacaaggtgcagcccgggaaggaaa

SEQ ID NO: 523184 - DNA, 419 bp, Homo sapiens
ccttccctgttttattaagttcaaacctgtctcaaataatatggggttcaaacctctgtctatcaatatggggggggtaaatgttaccctgaactaaattctggacacaaatttcaattgctgacacacgcatgggctcatgctaacaatcccaacactatgttaggccaatgcaatgtaagatcacctatggaactgaattcgagactaatcttgcccacatgctgcgctatctctacttaattgccgttcaggcacaacaattgcctacacctgtaacctcttgactaccccaagatgatacgtctactgtactccagcttagacgacacacctacacttctcctgtggccaccattctctgctttttccgagtggccttattccgcctttgccccatgtctctatactcggccccc

SEQ ID NO: 523185 - DNA, 220 bp, Homo sapiens
aagagggacccaatatgaaagaaactcagacggattccatttctagatatgagaccagttctacatcagctggtgatcgatatgattcctctgctgtgtcgctctggatcatacacttacttagaagaaagaaaaccttacagcagccggctctaaaaggatgactcaactgactttaaaaagctttatgaacaaattctagctgaaaatgaaaagctga

SEQ ID NO: 523186 - DNA, 339 bp, Homo sapiens
  misc_feature (40)..(40): n is a, c, g, or t
tatttccttcattctaaagttgttccctggccgggagcgnttgctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagaaaaaaaa

SEQ ID NO: 523187 - DNA, 731 bp, Homo sapiens
ttctccaaggttatgtgtcaacgtctgcggtgtttgagggcgccttcgtgctggtctgtacgacgagctcagggaaggtaatctaagggccgcggcctcctccatacacacaacacacaccaggcgaaccaagagaaccatgtaaaatcctcaagcgtgcgtaccatcaaccttcgagaaattccagttgtctttttcccagtccgtatcctgctctgtagtatggccggtggaaggctctagcataacaggggctgctattggtgatctcgaacccatcgagcagcctgattcccgtgtcttgatcactgggtgtgggcaggggaaccgtggcgtcctgctgtggtggccccgatggtgtgagaccactccagtactgatacctatacgtccagatgcttgtaggaagctacactccgtgttctaaagtatttatttaacaagaaaagaatcacgtttcccatttgtacttcgagcggctagccgcctgttttggcagcaggccgagttactggtcgactatgtttctactgtggggcctccctgggttggaactaccaactaaatcatgatgagcgcaggagtgtcctccatgacgctgggccgcaacaagcgatgaaagaaaacaaggacctggcggtgctatcatcagcttggcgtatgagcacatatggtatccaaatatggggacaccgggcaacatgaaggataggaaagcgcaattattggct

SEQ ID NO: 523188 - DNA, 432 bp, Homo sapiens
acctcggttggtgcagacctcctgcagcaaatgcaaaataaatttcagcccatgtctgcccagatcattgggagaattgatgatatgagtagtcccattgatgatctggaaaaaaatatcccggccctcattacccaggctggggtggaaaaactggaaagtgaaaacaaaatccctgccccccaaaaaagttgaaggttgctaataatttatcctggaatctggcctttttccaagccaaaagaagatcgaatggctttttgcacctaacccctatgggtagccaggttttatattataaaggatgccttcttatcccctaggaaaaagttagtttgtaaagggatttccccccagttttttgaacatgggattttcccatcttggcccttgggcagttgggctattcattattaacccctaaacctttta

SEQ ID NO: 523189 - DNA, 445 bp, Homo sapiens
ccactactatactaacaaagaactcgctattcttagttttgataatgagctattcatgtacaattcttgcaaacatgtcatgtgtactgtccccattaggagattacgtgcaacgttgtgagtttgtttgaaacaggtgctgtttgccatatcaccaccgcagtcattacaagtctcctgctcttactcgctccacactgggaactcctctatgaatcgatcactgcattgcttcctggcattgagtaactgtgccccttcaccaaccccgtctttcatcctctatccctgtcggttaatacaaaatgctgcctaactctccccatcaaatacctaagttggtggacaatattaatgatgcctactctatgctgggcagtgccagggaataaaggggaatatgaacaggagtggcccagccccttaagggtttacagtgaaggtg

SEQ ID NO: 523190 - DNA, 81 bp, Homo sapiens
  misc_feature (41)..(41): n is a, c, g, or t
aatgaactgtctccctgtgccttaaaaaaaaaagtgtttcnccaacttttaatgatcttaaaaagaaactttaagaaccca

SEQ ID NO: 523191 - DNA, 827 bp, Homo sapiens
agcggggttaccttaagtagtccgccaggggaacggcccgtggcgtaagagaaactgtgggtacactcccacacactggtgggatagacagaaattacgcgggtgcccactcgctgtgagagggggtgacaacaccgtcgcccaaagagcatgtgggcacttccatgagggtgagcggcctgaccgcgagggaagccactctctggctatggggggagacatatgttaggcgagggcacagaaagaaacacaaagactagggaggggcaagagatccgtgcaggatgggaacacaaggggctaattccaggttagaggccccccagttaataatacgagggatgcttagcttgctgttagagccccgcataggtacgagatataacgcgagagacagattcgctcgcgactactatgcttactatagaagtgtcgagtgagatctaatctaatgcgtggtgctctcgctttacacccgatcgttctttaaagagtgtaggaggctccctgtctctcatagtgcactttttttttctggtagccaaagactcctcctcttatgtggccacaatgctataaattggcgcgcaaggtgatgtaacatcagcaacactcgttatgtgggtgtcgaaacaggacgcgcctatgagagttattgggtacgagtgtagtaatctttactcgcggattgtgtgtttaagtctttgggacacaccacctttatgacggtcgatggaacagtattacaggacaatattcctccgaggttaaaagtaagattattattattgcaaaaaagtttttgtttctccccccaacaaagacgc

SEQ ID NO: 523192 - DNA, 837 bp, Homo sapiens
  misc_feature (837)..(837): n is a, c, g, or t
gcaatgaacaccactgaacccctgcagaactgacgcatgcacatggcgtgggtgatgctggctgtgatgtgtgcatgccaccatagctcagtggtgatgatggtgcatgcaccatgatgaccccaatgcctagtggtctcatccagccagccctgtgtgccccacagctgcagggtggaagtgaagtgggcgctggagcatcaggaggcccggcagcaggcactggtgacgcgtgtgtgagtggccatctcacctgtgggccccatcctgtgagcagagcagaacccctgatcgctgggcctgcctgagcctcacccccgtgtcttcagtggcaaccctggtgccgcgcagctgcagggagcccgagaggaggccagggcacgccgggcagcgactggccacacaggctgtggtgaggctctgccctgactgcttgcgagacctgcagggtgggcgcgccccacgacaagctcagacggaggtccactctcagggcacagcgctggacgggctgcttccacacccaggtgctgtgacaagctgccaaggacagctccgaccacgccacgaggctggaacacgcccggcactgcacgctgccgctccagacccactggaagcgatgacggtacgctacctacgggatgcaaccaccagcgccccgggcacagcacacggggcaagcccaagagcagggacccaacacatgaagagcccaacgcgacgcccaaaagccacggcccacggcaccgtccgtaggactagccactcgagggacaaccccaaagggaaccagacgcacgagcgacagagctggatggacgtagaaaggagaan

SEQ ID NO: 523193 - DNA, 276 bp, Homo sapiens
gttgctcggtgcttcaggatccccctggtgctcggtctggagcaggtcttgttctgtccccaggtgggagtgcagtggcgccatcatggctcattgctgctgtatctcctgggcttaagcgatcctcccacctcatttttaaatttttttggtaaagatgaggtctgattgtgttgcccagggtggtctcgggcttctgggttcaagcagtcctcccgcctcgacctcccgagtagctgggattacaggactaagccatcgcgcctagccctcgag

SEQ ID NO: 523194 - DNA, 298 bp, Homo sapiens
ttggacccccttacacctagaagttgtggtttataatgcaagtgccaacagacatgtttttatagcagttcttccataatactttgagagatgtaattcacattaacctgaatgagcttttcctggttataacatgtttctccctacagcattcattttgaaaatgggaacattatattactctgtgcttcgatgttgacggcgcagcagaaaagacgagaagggagggtaattccagaaactccttgctctttcctgatgggaggtatcactatttcccacaacttctaaggttaag

SEQ ID NO: 523195 - DNA, 284 bp, Homo sapiens
ctacttgggattacctttgactaatgtcctctttgtagaacggacagataaagtgggagttaacattggtcaagccctttcgtatgagtctttattctattatagagaattcctgacaaacaatttaacgaaatggacatgcaagccagaggcaacaaaccaaaaatgaaatgcttctagctctcaaggcaacatttcttaggtgcaagcaaataaatgtattttctaatgcctatattctggggtcagagtgttgcacggggcatccttctatgagtcgaccg

SEQ ID NO: 523196 - DNA, 423 bp, Homo sapiens
caacgatggtcctcagctgctcaggagatcaaggtacaaaaatcagttgaacccaggaagtgcaagttgcagtgagatgagattgcgccactgcactcctgcctgggtgacagagtgagaccctgtctcaagaaaaaagaaaaaaaaaccacccaaatgtctttcatgatatgttagccagaggcagaggataccaaaggatgcctgaaatccctcctgttcaggccaggcgtggtggctcacgcctgtaataccaacactttgggagagcgaggcgggcagatcacctgaggtcagaagttcgagaccatcctagccaacatggtgaaaacccatatatactaaaaatacaaaaattagctgggcgtggtggtatgtgactgtaatcccagatactcaggaggctgaggccggagaattgct

SEQ ID NO: 523197 - DNA, 126 bp, Homo sapiens
cttaatatggccagtgagtggacgaggcggagaactagggggtctagggcactcatcttctacctctacagtattccagaatcaggttcaaagtccaaggctgagggcaggtgctgttgctgcatg

SEQ ID NO: 523198 - DNA, 841 bp, Homo sapiens
  misc_feature (703)..(703): n is a, c, g, or t
  misc_feature (731)..(731): n is a, c, g, or t
  misc_feature (774)..(774): n is a, c, g, or t
  misc_feature (812)..(812): n is a, c, g, or t
  misc_feature (835)..(835): n is a, c, g, or t
catcgagtcggccttgttggcctactggaacccgcttgggtccccttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacactcaccgcgaaggtctgcagtttcactcctaagccagcgagaccacgaacccaccagaaggaagaaactccaaacacatctgaacattagaaggaacaaactccagatgcgccaccttaagagctgtaacactcaccgcgagggtccacggcttcattcttgaagtcagtgagagaccaagaacccaccaattccggacacattttggcgaccatgaagggactttcgcctattgccaagcggtgagacaatcgctgagcagtgagaccatcacctattgccgagcggtgagaccattgcctatcgccaagcaaatcgaggccatcaagctacagatggtcttacaaatggaaccccaaatgagttcaactaacaacttctaccgaggacccctggactgaccagctggcacttccctggcctagagagttccctctgaangacactacaactgcaaagccccttcttnggccctattcagcaggaagtactagagcagtcatcgggcaaanttccaacagcagttggggtgtcctggtgattgaggggngacagatgctgcagtcttacagncttact

SEQ ID NO: 523199 - DNA, 81 bp, Homo sapiens
tggctagggcagggttcagaaaggaactttatgtagtagtgtttaacagcacaacaaggggggaaataatcccaattctag

SEQ ID NO: 523200 - DNA, 1079 bp, Homo sapiens
gcaactgactagttcccgctaataatcggtgcccccgatatggcgtttccccgcataaacaacataagcttctgactcttacctccctcgtctcctacatccgtgctcgcatctgctatagtggaggccggagcaggaacaggttgaacagtctaccctcccttagcagggaactactcccaccctggagcctccgtagaccgtaaccagtcttctccttacaccatagcaggtgatctccgtctagtcttaggggccatcaagttgtcatcacaacaagttatcaagtataaaagccacccatgaccataagccacaagtaccaaagcgaccccgtcgttcgtcttgatccgtccgtaaatcacagacagatcctacgttctccgtagtctctcccagatcctagactgctggcgatcagctatactactaagcagaccgacaaacctcaacaccacccttcattcgaccccgccggaggaggagagcccagtgtctgtaccaagcaccatattctgagtttttcggtcacccatgaagatttatattcttcatcctaccaggcttcggacataatctcccatatggtaacttactactccggaaaccaagaaccatttggatacataggtatggtctgagctatgatatcaatcggatacctagggacacatcaggaggaacacagcatactatgagaggcaggcaatagacgtagaacacagaagcatatgcaacctacggatgacccaaaacatcgcaatcacaacagggacaaggaatacgctgacccgaccacgcagggacgcaacacgcacggacctgcgcacacgcatgacccccaaggaacaccaacataacacgaagtgcctacagggcaggatagaaaacatacctagaactcagaaagcgacggaaaacgagaacacacacacaatggcccaaagcgacacaatgacaaaaaaggaaacagaaaccaaaagacaacaaaaaagccacaaaaacagcaccacgagaaaagaccacacacagacgacgcacaacgagaacgaaaagcggcataacaaaaggagacacag

SEQ ID NO: 523201 - DNA, 844 bp, Homo sapiens
ttcggacgaggaaagggctatctgctccttcgcaaatatccacaacaatgtcatgctctggagagccccgcgcgaactcttttttggtcgactcgctcatcagctcgtggcagagtgcgaggcaggctggcggtgtgtggtggctgcgtgtggtggctgtgctgtgctgtgtgtgctgtgttactactgcccacgtgctgtgtgagtctaccttgcctgccctgcctgcctgaccttgccactactgtgtgcttgcatgatgcttgcgtgtgctctttccccactgcttgggctgtgcaatgctgcagattgatgtgcagctgtctgcctgtgtgcatgctgtgttggcgtgttgtgctgtggggtgtactatgtgtccctgtgtgtgctggcactgtgctactgtgtgcccttctgctccattatgactcttgttgtgcttatggactgctggcccctggtgttctatgccctgtgctgtgcagctggcaatgcaaactctgtgggtgcttgtgccctgtttcccccgctgcatgccccctgtggtgctgctgggtttcgagtctccctgccctgcgctagcctcctggctctgtgccgatgctggccctggaatggatgctggagccctcgattctgcctgccgccccccactgcttgtgctttgcgtgcaagcaggcgggggtgctcgacagggcgacgaggagggcgcacagcgtcgtacctcgtgccggcggagtgagctcttccccggccccctttcctgagatgcagcaaagcctcgccggaagaatgattccctgggcaattccacaggttgaaacgcagcaactggctcacggca

SEQ ID NO: 523202 - DNA, 952 bp, Homo sapiens
aaatgtaaacggtgactgggatatttcgcttatcttaaagaattactattcttaaggtatcatcatggtagcgtgactacttagtagaaataagaagttgtggcccgtcgattgtgggtctgacgcgtgtaatcgcctcgcagagatcgttagaaaggtcgagatgcggtagatcaccgcgaggttagggattccaagaccagcctggtgcaacagtgtgtgaaaccccatctctacgaagaatatatcaaaaagattagccagggatgggtggatcacgcggtgtgatctcacgtcaccttgggaggctgagacacgagattcacgtttgagcccaggatggtctgacggttgcaggtcgaaggccaggagaccgagccagtttgctactcaacaagtcgcaatggctcgcatggaaggagttgcagaatctctgctgtcacagaggtgaataactccacgccacgaaaactcgtgcttgtttctcgccaaggaaaatgtctgggcgaagtttccggaatggcagtgagggttcttggaacctgccctacccccgggtatgtctctatacaacggggggggccacgtagattatgcgctcaaagactggggtggccattggagcccggaggagttctgtgacccccagaggaaacgtacagtgcgctgcactcacatgctattccaggacgggggggcgcaatattcctgagaaaggtgagctaagaacagcgggggcaggggctgaccgtgcggcaaatggcatctgtcacgggcacgcgcagaaccggggtgcggaagggggggccccagctggacaacaagtccagagacccaggcagagtaggggaatccggtacccctggaggaataagcccgacaatggagccggaaaacgagaagatggcgcccagaaactgagcgcaggagggcaaacaaaccgggggggacg

SEQ ID NO: 523203 - DNA, 576 bp, Homo sapiens
  misc_feature (8)..(8): n is a, c, g, or t
  misc_feature (110)..(110): n is a, c, g, or t
  misc_feature (129)..(130): n is a, c, g, or t
  misc_feature (194)..(194): n is a, c, g, or t
  misc_feature (255)..(255): n is a, c, g, or t
  misc_feature (262)..(262): n is a, c, g, or t
  misc_feature (272)..(272): n is a, c, g, or t
  misc_feature (274)..(274): n is a, c, g, or t
  misc_feature (284)..(284): n is a, c, g, or t
  misc_feature (289)..(289): n is a, c, g, or t
  misc_feature (316)..(316): n is a, c, g, or t
  misc_feature (327)..(327): n is a, c, g, or t
  misc_feature (334)..(334): n is a, c, g, or t
  misc_feature (340)..(341): n is a, c, g, or t
  misc_feature (357)..(357): n is a, c, g, or t
  misc_feature (370)..(370): n is a, c, g, or t
  misc_feature (394)..(394): n is a, c, g, or t
  misc_feature (398)..(398): n is a, c, g, or t
  misc_feature (414)..(414): n is a, c, g, or t
  misc_feature (446)..(446): n is a, c, g, or t
  misc_feature (459)..(459): n is a, c, g, or t
  misc_feature (527)..(527): n is a, c, g, or t
  misc_feature (545)..(545): n is a, c, g, or t
  misc_feature (563)..(563): n is a, c, g, or t
  misc_feature (567)..(568): n is a, c, g, or t
cttcaagnttaggaacaaccaacatgcctatccaggtgctgaagggcctgaccatcactcattaagaacagaggaggctgcctgttactcatggtgttgcatccctccanaaactctgctgtttcctgnntaggtgtggctgcagcatggctaggaaagcgctgccacccacccacctgggccaaagctggttntgctcctgctgcagggaaactgagctggctatctcggcgcttcgggcaagaactgcaacangctctcntgggtcctgnangtgtaaagcngggcncctgccttgtgcctcagctctcgaaanctgctgctgcngggtganctgatnnaacctgataaggtgcnatcttcagctacnaatgcaaggccctgagggcaaaancagnaaggcactgcccaacnggctgctgatggactggtgccagctgggagtnctcccggcacttngaggccactgagccacccttccagcaccagcccaccatggacaggggtatccagcttcctcctcaacntcgtcctctgcccctganccagtgaagcacaagganatgnntgttacac

SEQ ID NO: 523204 - DNA, 975 bp, Homo sapiens
taggctataaaacaaaaaaaggttgctgttttctatttttaaataaacccacaaaaaaccacagcacaacagcatgtgcaattttcccccagttatgtgggcaacaggtcacaagcaacacccaaatcaaaagcccacgagcagcttctatctttcacgcatcacactccagtgcatatgtgaaagagacatgcattgccattccacactgcaacatcacctccattgcaatcattcatcactcactcactggatcacaacatgcagcacagcaccagtagttcacatgtgtttaggctttagggtcactaggttggttatcacaacatgcgacatattattatatatatcaaaaatctcacacgccatgtatacaatatacatggtagtatactacacaaagatgagtccaggatgcaatcacacatagcacacacgccaaatccgtccacatatatcaagcagcgtcatgggcatcgcatagcaccaggcacacagcgcgcaaatcagcacagctttcaatagcatgcttactagttatagaaaggccccagccaagccaccacatcacaattaactaggcatgcacacatcgcacaattaggttacacatatgaagggcattaagtcaaaaccatcatggagaggagacagttagctcacatgtcaaaatacaggacatgcaacggtcctagactgataagaccttattcactcattggctaacagacaagccaccagggtagagtgaccagttcctcctaatccaaaacatacatgcgaaccatgcattacataaactgtggatgaggagcaatatagaacatcaatgggactccaaaggaaccatgatattgtaaatatactggtcaccattaaactactcactcagcatgcctaaattaacccagaacgaagagacaataccaaagacaacagggtaacaaaagcacaaaaaaatgcgagatcagaaac

SEQ ID NO: 523205 - DNA, 236 bp, Homo sapiens
ccgcacagggtgcggaaattcccccttttggcaggacatatatggctggcgtgatcttggctcactgcaaactccacctcccgggtttaagcgattcccccgccccagcctttcgagtagccgggactacaggcatgcgccaccatgcccggccaattttgtattttcagtagagacaaggcttccccatgttggtcaggctggtcttgaactcccgacctcaggtgatctgcccg

SEQ ID NO: 523206 - DNA, 191 bp, Homo sapiens
tagtgggctgttgcagtgagcctgagatcatgccactgactccagacctgggcggcagagaaaaactgtacgacctgtagtcccacctactcaggagaggttgaggcatgagaattgcttgaacccaggaagtggacggttgcagcgagccaggatcgtgccattgccttgacaaacggggtaccgagctc

SEQ ID NO: 523207 - DNA, 486 bp, Homo sapiens
  misc_feature (3)..(3): n is a, c, g, or t
  misc_feature (32)..(32): n is a, c, g, or t
  misc_feature (74)..(74): n is a, c, g, or t
  misc_feature (126)..(126): n is a, c, g, or t
  misc_feature (209)..(209): n is a, c, g, or t
ggnccttatgaaaactgtgccttccatgaaanaaaaccagaaatcccaaaattccaaaactgttgggaagtgancccaagtggaacaaaacccctcccatgagtgccactttccttcccaagaaanccccagatttaccccatagaggtcctgggattaccctggaatataatatgaaaaacattttttaggctgggtgtggggctcanacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcgggaggcggaggcgggggaatcacttgaacccgggaggcgggttgcggtgagacgagatcacgccattgcactccagcctgggcaaaaagagctaaaaactccatctcaaaaaaaaaaaa

SEQ ID NO: 523208 - DNA, 608 bp, Homo sapiens
aaaagcgttgcaggtcgcccccggcccgttggtctgcaggccccccgccccaagagaaacgggtggtgagccccccagacacggtcccaagcgcggcgtagcacaaggaaaggttgcgcacccgaatctgtctcaggaggtattgatacccatacgagggttctgcgcaggtgccgttctttaggcctagacaatacataccgaagcagttggcgggtgaaaatcctaagagcgccctccttggcgatagcgctcaccataaaaggctttagttcttggcaccacactgaagatcatattttccccctcatagacttcgcctactttgtcccatcctctacacgcatcgttcttaggttttttcacgcaaccaccttatgtccccactatgtttatatatcgctaacagccgcttccagccacacgattaaattacatcactattttttcctacccacctgccattgttcacacactgtcaaggcgattctaaggccctcactaacaacaatagtgttaatatcctcggaacccccctacaagttcccaccacattgtttttcaccaagagccccaacaaccccctagaaataaaaacccacatgcag

SEQ ID NO: 523209 - DNA, 105 bp, Homo sapiens
gctcttgaacgacgccagcattgagcttcttcttccaccaccaccgtgagctttcctcctttgactgcattcagctctaggtcagaccagagctatccatgtaca

SEQ ID NO: 523210 - DNA, 427 bp, Homo sapiens
gatcacttgagcacgggagttcaagaccagcttggccaactggtgaaaccttgtctctataaaaaattaaagtttaaaaaattacccaggtgtggtgtcgtgcacctgtagtcccagctactactgaggctgaggtgggaggattgctcgagcccaggactttgaggctacagtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatctta

SEQ ID NO: 523211 - DNA, 245 bp, Homo sapiens
ggtcctcgatgagctgaaccttgtccatgagccgacctgtagatgcagattgagaacctcaaggaggagtttggccataccgaagaagaaccacgaggaggagatgaacggcaggtgaggccaggtcggtggtgagatcaaatgtggagatggactctgcccacaggacgtggacctgagcgggcatcctcaacgagactgcgtgaccagtatgagaagatggcagagaagaaccgcaaggatga

SEQ ID NO: 523212 - DNA, 1126 bp, Homo sapiens
  misc_feature (450)..(450): n is a, c, g, or t
ggtgtatgcccaagcatgggtgcattactcagtagatgcaggagctatggagaaagactgagtcgtgatgtcatgcgctctcattctgagggtctcagttgcgtggcagttaccgtcaagctcttctgctcgtctcacaagggctcaccgcccctagcgcggactgataatgcgcagctcagactgggcttacatagggccaaaggacaacatgggtttaacagttccttatagtacgagactatcgttggttcagcgcagtgagtgtgacgaaaacagcctctagtaatcacgtaaagggatgcacatctttacaggcgaacgtcctgtccatcatggctcgtaaagccacgactgatcagatatggcttccgatacgctggcagtctccgatgtgacatagcgcagcgagatgcctacgccactgggggggctctgatatatctctgnacacttcttactcggtgtctgcgatagacacgattgccaaatacaaatatgtctagacgcgtttatctctgctatctgatcccattatccatgcatgacttatctaagacagagaatccattgatgccccaaggggatcaaccaactccaagatccgctcagtccagaagtggcatgcattgcagtgcgaggtcgacatactgccatgcgctcaagaaaagaaggccgattgtgctcctatggcaaagggcccatgaagtttctaaccagactaatgggtggctcatcgctcgggccagcttggtatgacatgcggcaattaaatcatctcatggtctcagcgtatatcgtctatcataacgtcacgctcccggtcgcattcatacttcatctctccaatgtatgacaggtcctgtcgcttaaggcgttttggtccgttctagctagctgcagaagttggttgatgcccgtataatcagaagggggaactgtctgggcgggtttggacacgtcccggggggagtttgggtcctattagaggattcaggtagggagcctataaccggtgaattgcgaaaaatggggtcgggcccgggttaattcccgtcgaaaaaccctgttttttccggtcctaccaccggatccgggttccaaaaaaggaaggccaaggttttgg

SEQ ID NO: 523213 - DNA, 314 bp, Homo sapiens
cctttcccccttttgggggaaacttaacagagcgtggaaggggggcattttttgtcaataatgccctaacctcccaccctgatttccccgaattttagggaaggttagggattgggaagggggatggaaagctccaggggccagtgtgttttagctggagtcctgcggccaccctttttcatggaaagacatgaatcaacttttttttttgtttcatcttttaagtggacgggcttgcctgttggggcatgtgttcataaactcaaccctttaatcatggtttcatgagccttaaaaaccaaagggaaaaagga

SEQ ID NO: 523214 - DNA, 514 bp, Homo sapiens
  misc_feature (28)..(28): n is a, c, g, or t
  misc_feature (52)..(52): n is a, c, g, or t
ctggctctgaacttaggaggcagaggtngtagtgagctgagatcacaccatngcacttcaacctgggtggacagagtgagactctgtctcaaaaaaaaaaaaaaaattggaaaactttttatttttatgcaaaccatctccaactttggagagaaacattagggtaacattaaaatataacttggaaaggattggggccagacatggtgggctcatgccggtaatccagcacttggggaggccgaggcgggcggatcacagggtcaggagatcgaaaccatccgggctaacagggtgaaaccccgtctctactaaaaatctaaaaaattagccaggccggggggcgggcgccggtagtcccagttattcgggaggcggagacaggagaaggatgtgaacccgggagggggagctggcagtgagccgagatcgcgccacggcactccacccggggcgacaaagagagactcggtctcaaaaaaaaaaaagggagaaaaaggaaccaaaggtttta

SEQ ID NO: 523215 - DNA, 184 bp, Homo sapiens
tatagatcgagctcggtaccgaattcgacagttgtgcaggcgcaccgacagctgactcctacaagaatggttcctcaacttggccggcctttcttgggtttctctgaaccccttgccgcacctagtatgatggaaatgctcaaaaatagactgtagtgatggcgcacaagcttgttcgagattc

SEQ ID NO: 523216 - DNA, 485 bp, Homo sapiens
  misc_feature (74)..(74): n is a, c, g, or t
  misc_feature (182)..(182): n is a, c, g, or t
  misc_feature (199)..(199): n is a, c, g, or t
  misc_feature (251)..(251): n is a, c, g, or t
gacctgtgctagggagtaaggtggatctcagtcagtgcactccgcaccggttcaggcaattctcatgcatcagnctcccgagtagttggaattataggcatgtggcacacaaccagtgattttgcatttttagtagagacaggttttcaccatgttggcgaggctggtatccaactcttganctcaggtgatccactcngcccttagctcccaaagtgctggaattacaggcgttagccaccatgcctggnctattctggtctctttaactctctcctctttatttctcttctctctctgtacacttttcctgggtggtctcatccattccttggctttttcataccatttattcgttaatgattcccacatttatttatgcacttggagagctcacaggaatctcagaaactgatgaggtacaattctgaaccctcagtctcttccctttaaacctttctttttctctactttaatttttctaa

SEQ ID NO: 523217 - DNA, 198 bp, Homo sapiens
ctgaagcactgggtattaaatcagcagaagcctgggtgtggtgtgctacctgttaatcccggcactttgtgaagctgacgtgagcggatcacctgtagactcaggacttcaagaccagcctgggcaacactgggaaacctcgtctctactaaaaatacaaaaattagccaggcatagtggcgtgcacctgtaatccca

SEQ ID NO: 523218 - DNA, 253 bp, Homo sapiens
gcagagaaacacagaaacgactcagcaggcgacagcgaacaccaagacgacacaagagagcgcagacagcgaagaagacaaaacaacatacacatgagacaggagcggcagaaactgaacacagacaaagacacaagagcaagaagaagagcagaagaaagaaaacgacgccaaaaccagaaaaggcaaaagaacgaaagaagcgagaacagacacaacaacaaaacgcctcacagaacgacggacaaaaaaa

SEQ ID NO: 523219 - DNA, 312 bp, Homo sapiens
gcgtgtttcactctgtggccacttccctctggatgaagccctcagccatggtctcctcttcacgaggttataaggaaagataattcagatggaaatcttttttacccagcctgctggaaatgcaatgattgttgctacaaggattgaaggcaatgggctggaaacacgcacccagctcagaccctgccttcagtcggtgccggaatccttccttgaccccagcctcaccgtgagacaccgggcccttcactcagaaagggctccgtcagtcagcaccttggcgggcactatccccgccgtcccaaagcacag

SEQ ID NO: 523220 - DNA, 355 bp, Homo sapiens
  misc_feature (335)..(335): n is a, c, g, or t
  misc_feature (337)..(337): n is a, c, g, or t
atattagagagcaatcaaatcacacagcatgtgggtgattttataactgagctagaagacaatgattaaaagctaattcaaaattattatgtgcttggaaattcaaagagcccttataagacataaacatatgaacgaatccaaagtgaatcaggattgcctatcatctcaaagacgagatcataacatggcaataaaatgtctccctctggcctgagaattcctctttgtggcacaaggttgtgtgatctcaaatcaccgctaacccacctagacattttaacatccgaaaccgagtgatgacgttcttatctatatcatcatactgcctgcgngngtggactttaaattctga

SEQ ID NO: 523221 - DNA, 187 bp, Homo sapiens
tccagattccagtagaagccaaatgctttttcttttacagctaggtgcctgtaatcccagttacttgggaggctgaggcgggagaattgcttgaacccaggaggcggaggttgcagtgagccgagcttgctccattgcactccagcctgggcgacaagagtgagactccatctcaaaaggaaaaaaa

SEQ ID NO: 523222 - DNA, 207 bp, Homo sapiens
ttttttttgagatagagtcttgctctgtcacctgggttggagcgcgaggcgaatcatggctcactgaagcctcaatgtctggacccacaggatcctcccacctcagcctccgaacagctgggactacaggtgcagccccatcatgcccagctgatttttgtatttttggcagaggtgggatttcgccatgttgcccagtcaggtctc

SEQ ID NO: 523223 - DNA, 681 bp, Homo sapiens
ggtcaaagatgggctcgtgatcacagagtagcatgtgcagcgggtggaagtacaaagcattggatgcatggataaattgaccggtgtgtatgtcctcgatccatccaccggtccccacaagtggagagagtgtctcccacctcatcatcttacctgaggaacagacttaagtatgccctgagacggagatgaagtaaagaagatttgcatgcagcggttcattacagctcgatggcaacggtccgaactgatataacctaccctgctggattcatggatgtcatacagcattgacaagacgggagagactttccgtctgatctatgacaccaacgggtcgctttgctgtacatcgtattacacctgagagaggccacagtacaacgttgtgcaaccgtgacgaacagatctttgtgggcacaaaaggaactccctcatactggtgactcatgatgcccgaaccatcacgataacccgatcaccctcatcaaggtgaatgatacccattcaagactcgattcagagactggcaacgattacgtgactttcatcaaagttcgacactggtacacctgtgtatggtgactgagaggtgctaacctcaggacagcaattggtgtgatcaccaaccagacagacagcgacacctggcatcattaacgaagtggtacacgttgcacg

SEQ ID NO: 523224 - DNA, 180 bp, Homo sapiens
caccagaaaagatgtcttgagacaatttctagccctgttttcccacctggtgtaatgatggatactgtttaatgtgagcaacacgtgctgctcccattttcagtgttcctagatttttatctgcctccttattttcagaggaactggcctaacatctcatgagtgtggggataacatggg

SEQ ID NO: 523225 - DNA, 464 bp, Homo sapiens
  misc_feature (26)..(26): n is a, c, g, or t
tccctctcccccccttctctctctcnccgagggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgc

SEQ ID NO: 523226 - DNA, 350 bp, Homo sapiens
tccggcgcggtatctctgctttgacagctgagttaggcttgtggtcgccaatggtgtacaactgctgttcgcggtaggcgcctggggctgatgaattaggttcgattggtagcaaaagagatggcgtcaagcccatggctaattggattctggagaacgctgcatagagctcgtctataccattacccttgctgttgaggctactgaatgctcgatcctgctgaatgttgaaatggccgatggcttggattgaaggaggtactgatgctgtgaatgccgggaaaagattgaccgaaatgagataagaagagcccggtgattacacccagtcttgggggtcgaggcccaat

SEQ ID NO: 523227 - DNA, 1094 bp, Homo sapiens
ggcggcgctctgtgagtacgacatggtgcgcgactctgcggtgcgctgtctgctgtaggggccgacgtctgcggactttgctgtcgggcagtccggcgcgtggctggccgtgccagggaggaagaaccatagttcatgatgatcctctgtgaggaaccgaacagcccagtttgggcccgcaaggcgatagacccagcgctggatgcttgcgatggcgaggacggactgttcagcacagcagaccagcgatgacaaggaggaacccctgtacatcgagttatcagcaggcagcgagagagcggtgcgagggattccgagcttccaaacgatgagattccagtggccgagtcacaaagtaaggctgtttggaacattggcttgcgcgcggttcccattgctgactcaaggaaaatagaggacggtagtcttatactgcgtgaggccttgaatcttcctacattgccgaagttgcaatgcactttgcgcaaagaaaacgtgcagtacacaatacctggtagtcttgacgagccataggtcagcttgtccacggaagatgggaagaattccactttggcaggatccaaagtggcacggagtaaaagggcaacacagtctagcctattccaaaggtactatcctagggttactctgcgcgatttaatcgacctagcgaaaacggaggcatgtgattgatcccgaatcgctttgggtgggcatcgggaatttaggcgcgaaggaatttccgcgagggattccaacaaagcgcgcccttttctctttgggaaataggcctcctttgtcaacggaaaaccccaagggcctttgaaggcgcccccaaggctacgtccacacgaagttccaatcggggtcccaaggttttttgggcaccgttggggtgctttttccttaccgttacaagttcgtttttccatttggcgttggggccgttgaccctacgcacgttggggacacggtggttcttacttttccccccggccttcgcgtgcagcccccccctggggggggaacgcccttggggtggttaacccaacggttgggagcctttcaagaattgggcttccttgggaagctcg

SEQ ID NO: 523228 - DNA, 348 bp, Homo sapiens
  misc_feature (23)..(23): n is a, c, g, or t
  misc_feature (85)..(85): n is a, c, g, or t
  misc_feature (93)..(93): n is a, c, g, or t
  misc_feature (96)..(96): n is a, c, g, or t
  misc_feature (113)..(113): n is a, c, g, or t
  misc_feature (117)..(117): n is a, c, g, or t
  misc_feature (146)..(146): n is a, c, g, or t
  misc_feature (216)..(216): n is a, c, g, or t
  misc_feature (228)..(228): n is a, c, g, or t
  misc_feature (235)..(235): n is a, c, g, or t
  misc_feature (244)..(244): n is a, c, g, or t
  misc_feature (248)..(248): n is a, c, g, or t
  misc_feature (261)..(261): n is a, c, g, or t
  misc_feature (265)..(265): n is a, c, g, or t
  misc_feature (276)..(276): n is a, c, g, or t
  misc_feature (287)..(287): n is a, c, g, or t
  misc_feature (337)..(337): n is a, c, g, or t
gtgagctttgaacatgctaatcngcctggcaccaccccattttagagactgtcacttggaggccctgaatgcccctcccattccncacatgcnggnggccccagggggcgggntggnttagagttaaggggtcagcggggaatcgngttactctttggcatctggcattttaaacaccattcaccacgtccattctgcgcagggtccttcccttcnggggggcctgcntcttccntggacattntttnagctgggtgtggngtgngttcagctgtntactctttganagaaattgtaaaaactgaccaaattccccaccagtaccaaggtttaagtncacaagcaact

SEQ ID NO: 523229 - DNA, 527 bp, Homo sapiens
agataatttaaaaattagctgggattacaggcatacaccaccacacccagctcatttttgtatttttagtagagatggggtttcgccatgttggccaggctggtcccgaactcctgggcttaagtgatctgcccaattcggcctcctaaagtgctgggattacagacgtgaaccactgtacatggcctgttaggcctattctttttcgtggccatcttaccttgggccagagttagtactcgtgggataactccacatccatatgatagtgttggctgtgggaatgggtctgttcattgtgacctccagagtgggcacaatcagggtccaactttgtatgttatgtatattttaagttcatgtgaattgaccctgggagttcaaaggagctgtgccagtttcagcaacgtttggtgactcagtcacagacattaaaatagatcttacaagatgcagttcctccaaaacatatttttataagcatttaaaaataaacctaggagtctaggagtgatttgctcttaaca

SEQ ID NO: 523230 - DNA, 145 bp, Homo sapiens
cacggatcccagactgtcgacaggttgggaggattacaacggaagtgtgtcgagttgtctatatatcttcttttcttcattagacagagggtcgtactctgttacccatattgaaacctagtgggacaatcgtggttcactggag

SEQ ID NO: 523231 - DNA, 171 bp, Homo sapiens
  misc_feature (27)..(27): n is a, c, g, or t
  misc_feature (152)..(152): n is a, c, g, or t
gcgcctaccatcccggaagcctgagcngcctgcgggaaaggactggctcgccgtcatatttgtgacccaggcaggatggagaagatcactaagctgctttggtaatagtttccgggaattcgggagtcaagaataaagcacttcgacctaanaatagagatccagagtcta

SEQ ID NO: 523232 - DNA, 237 bp, Homo sapiens
  misc_feature (42)..(42): n is a, c, g, or t
  misc_feature (137)..(137): n is a, c, g, or t
  misc_feature (155)..(155): n is a, c, g, or t
  misc_feature (208)..(208): n is a, c, g, or t
  misc_feature (221)..(221): n is a, c, g, or t
aaggactgaaagagacagttgatttgcactcctagagctaanagacttggcaccactttgttcaactgtaaaaatagcaatttgccctactcgctcagagtgggacagtagtgacagagctgggattccatgcgcanttgaatgctgccttcagncatgagacatagggtttggaggcccttagaatgggtagatggtgttatgtccnttctggcatagcntcactggtgctttgga

SEQ ID NO: 523233 - DNA, 396 bp, Homo sapiens
  misc_feature (396)..(396): n is a, c, g, or t
aatctagctcggtgactctcgatgaagggccatatgctgggctctccgattgatcctgtgaggattaatttgcatctcacagaaatcccttgagcaatggatataatgtttcctgggaaggtgccttgagttccattatgtgcaagctacatgattgtcacatttttcttagctttccctgggaagacttttcttgactcacagtccaggttcttctgcgctacacaaagggagtgagttggggtctttagatctcttcttattggttagctcttgctttattattctgtctggtgagtgtaagggattctgctagggaccgggtgcctgactacccagtctttgtcttgtatcctctcccctcttcataccctcctgtttttgtttgtttttccn

SEQ ID NO: 523234 - DNA, 228 bp, Homo sapiens
gtgcgattcttgatattcctagctactggaaagactgaggcagaaggattgcttgagcccgggaagtcaaggctgcagtgaactatgatcgtcccactgcactccaccctgagtgacagaatgagaccctgtctcttagagaaacaaaacaaaacaaaaatcactgaaattaccactgtcacccaaccttcagcaaccaccaccctaagcagtcagcagccatcaatg

SEQ ID NO: 523235 - DNA, 493 bp, Homo sapiens
gagacgagaaggtgtaatagacatcccaaacaaatctcaaagtacgcacaaacggaatgatccagacatttccatagtgtccttattatcacattcagcttataaaaataatgccaagtgcagtgaaaagttacaggatgttccatccactgggtgatgttggatgggagagtttcttccagataccggatcatgtgacacattgtggcactttcctactagactggcagtccagattggcgctttttccatgcaaaaatggtaaaccagggcaaggtctcacgttcctgcaagacgaatcacacattagagacatgcgcagacgtctgcatttactcttctagtatacattgacactttccatgagctcaacacagtggtcctacaatcttactgcttggcaacgtctctactcccagctgtctccaagagcatccagacagtggtgtggacagcaggcatctcgcaccggtttatgttgacccatctttat

SEQ ID NO: 523236 - DNA, 401 bp, Homo sapiens
cccggccgccccgttttaaaagtgaaaagcccctccgcccggcagccgccccgtttgggaagtgaggagggtttccgcccggcagctgccctgtcagggagggaggtgggggagcagcccccgcccggccaaccgccccgtccgggaggtgaggggcccctccgcccggcagccccgattgggaagtgaggagcccctttgcccagcagccaccccgtttgggaggtgtaccccacagctcatttagaacgggccatgatgacgatggcggttttgtcgaataaaaagggggaaatgtggggaaaaaataaagaaatcaaattgttgctgggtttgtgtaaagggaagtaaacgtaggagactccattttgttttgtactaagaatgatcaataaatacta

SEQ ID NO: 523237 - DNA, 267 bp, Homo sapiens
ttgcacttatgaattgttatcagttcaaatagttttggttggagtatttaggatctccaaatataagatcatattatctgatcagctggggcctcacattcacagcgatagagctactccagcctgggtataagagctactccgaggcatgggcaattaaaagctatccaccgctgggcaattaagagctggccttcagcgcccggcaagatgatggctgacgaggcccggggcagtgcaggccagttcttattgcccaggctgcat

SEQ ID NO: 523238 - DNA, 401 bp, Homo sapiens
ggcggccgggaagaggtgctcctcacttcctagatgggatggcggccaggcagagacgctcctcactttccagactcggcagccaggcagaggggctcctaacatcccagacgatgggcggccaggcagagacgctcctcacttcctagacggggtggcggccgggcagaggctgcactctgggcactttgggaggccaaggcaggcagctgggaggtggaggttgtagcgagccgagatcacgccactgcactccagcctgggcaccattgagcactgagtgaaccagacactgtctgcaatcccagcacctctggaggccgaggctggcggaccactcgcggttaggagctggaggccagcccggccaacacagcgaaaccccgtctccaccaaaaaaa

SEQ ID NO: 523239 - DNA, 239 bp, Homo sapiens
  misc_feature (21)..(21): n is a, c, g, or t
  misc_feature (49)..(49): n is a, c, g, or t
  misc_feature (102)..(102): n is a, c, g, or t
tctctgacccagagggaaatnaatagaaagtagtgtgtgcttgtagganggagcatttggttgggggttggattgcatggcatgcaagataagggttcccantggccagtggcatttcaccctcatgttccccagtggaatttaagtgagaaatattctggcatttttcgtttgtttgtttaatatttctgaggaatctgtttattctgcacagattgcttttgttctttattttaaaa

SEQ ID NO: 523240 - DNA, 1001 bp, Homo sapiens
  misc_feature (1000)..(1000): n is a, c, g, or t
aatcctttgccacggtgtgcttcgtcgtgcgtctccccttcccgcacccacgcccattcccacttttctagcccatcctctttctccattttcctcttgatatacgataacgatgagcctgtaacattcaagttgtacccacttagtttatagatatatatattggggggggagactgaccctattgctggttatcagaaatcagttgcattgatctgtatccaatggtatgatgtctttcgtaaacagccggtcaccattcgatcgaatcgactttgcgaagacctctgtggagttcgcgatacagaccttgtggtgctaccatcttaattcccttgcagagccgcggatattctcatccatccggctagcgaatgtcccatgctactttagacgacttataagggagtatatatcttccagtggagctagagacttgagtagcgtctttggggaactacagtggctaggagcgttcgtacgaaataccaagagttaacaacgatcataataaagagttcgtcataccaaaaacaaagaaagaagatcaagagattttaacgtgtggattatatagtataggaaggggggtaataaggctagagagagtgaagaagtcattgggaattttatcccctcgttaatgaagtctcctttttattgtgaaaaaaaaggaaaatgcggtaaaatattcagaatattcaacaaagcctgttcaacgaagggccgaggggcagaaaaccagagaagggaaggccatattctggcacacttgcaagtagttggcaactacatttattgcacgcgggggatatgtgtgaaaacatccaaggggctgtacaataaggtaacaagaacgtcattccaagcgaacggtgaggtattatgaacacgtacaaaccgatacattactagatagaggattcgcgcaaaggattataacacacgaacatgaacatttcatactcaaaggagatggaaggcatcacccccttcattna

SEQ ID NO: 523241 - DNA, 241 bp, Homo sapiens
  misc_feature (64)..(64): n is a, c, g, or t
  misc_feature (148)..(148): n is a, c, g, or t
  misc_feature (175)..(175): n is a, c, g, or t
cgactcggagactgaggagatctggcagaacagagtactgaaatcgatcagagagaatcgcctngcagagcacgcacgcagaatagcgagctgctacaggcctaagagacgacgaggtcgagaacagctcactcagattgatgcacancttctaccattgagttccagagagaangcctgtagaactcacacaccaacactgatgtgttgaggaacatgtgctttgcagcacaagcgatga

SEQ ID NO: 523242 - DNA, 697 bp, Homo sapiens
ctattaactgcaaagttgtacgaccgtgagacccagattggacgaaaattctgttcgcttcatgtcagtggcccccacaatccttaggccttaacacgccgcagtactaatcattgcctattctcccccctctagtggatcccccacctccggatatctcatcgacaaccgacttatcaccaccccacacaatgactaaatcaaacttaacctcataccaatgatagccatacacaccacttaaggacggacctgatctcttatactagtatccttaatcattgttattgccacaactaacctcctcggactcctgcctcactcatttacaccaaccacccaactatctataaacctagccatggccatccccttatgagcgggcgcagtgattataggctttcgctctaagatttaagtatgccgctagcccacttcttagccacaaggcacaccgtacaccccttatccccataatagtgtattgatcagaaatccatcagcctagctcattcagagtccaatagccctggccgtacgcctaaccgctaacattactgcaggccacctactcatgcacactaatctggaagcgccaccctagcaatatcaacccattaaccttccctctacacttatcatctttcacaattctaattaatactgagctatcctagaaatccctgtcgccttaatc

SEQ ID NO: 523243 - DNA, 100 bp, Homo sapiens
cctacgtatccatgggggggggttgtatgattatgggcgtgattagtagtagttactggttgaacatggattagtggtgtatatattgtaattgagattg

SEQ ID NO: 523244 - DNA, 888 bp, Homo sapiens
  misc_feature (569)..(569): n is a, c, g, or t
aggcaggagcattaagttagggcccaagccaggtggaaaaacgattcgtttgagaggctttcctcgggcccccccggcccactaagagggtttgtttctagacagtgtttcaccccctttgcaagaagaggcgttggaacccctttctacagtcctcggcagaccacgctttcgagtacatgtgtgtaaacaaagagtcggctcgcgccaccacgtgcgtgacgtgtttgtttgcttccgtctcccgtgccccacaagcaagaagtgtatctctgaataagctctcgatcctatgtcggtcctcccgcaccgtatggcgaaggagtttactcccaaggcacgttggttgccatgcctttctcctatggccacgccagtggcggaatattctttgccccccccgcacacacgctgacactcctcgcgcgtgcgattgcactcacacatgccgcaaacagtggacgcacacgcaagggggaggcggaatgtatgaggttgtatgcagtaacaccgcaccgaattaatttcgtggccaggcttgcgtggatctcgcacaccaagaatgacanaaatagagatttgcggtgtttcaatacaacccgctgccgtgctctgttgtcccagcatcacaggggctttatcttattactgatgacgcgataagacgcttgtatgcggagcacggccacggagatattttgtgtcgcgccacgataaacagtagatcagtcggctcctcagtgttgtttgattgtattatgtgccggaaacaagagatacttccgctcgaggagatgtactgggcatacgtccgaacctagagctccgctaggatcaccgtcttcttattccaataaaccctcttgggattattcctaacaatataca

SEQ ID NO: 523245 - DNA, 473 bp, Homo sapiens
ggggggcctgcaaatgttgcgggttattcagcgccagtccccgcgttttccccggggtgcattaccctggaggtccaccggaggtttttggacctggaaaagggggggtacaagcacaaagacattccggccccctcctgcccccccgtggaggcccccccaacctaggcccccccgggaccgggcagggttttcagtttttgtccaaaacaaccgggaggagcctgggggcccccccccccggggggccctttttaaaagtgggctttcccctgtggccctcccggcctgtaaaaaatctgttaaaaagttaaatggacttggggcctcttaccccgccccctcaaccgtgggcccgggggcgggggggccggcccaccccaaaacggggtccaaaaaaaaaattttttttttttttttttccccagcgcttttttttgcctttaaaaaatgggaaataaaattttttccca

SEQ ID NO: 523246 - DNA, 1048 bp, Homo sapiens
  misc_feature (312)..(312): n is a, c, g, or t
  misc_feature (336)..(336): n is a, c, g, or t
  misc_feature (494)..(494): n is a, c, g, or t
  misc_feature (497)..(497): n is a, c, g, or t
  misc_feature (507)..(507): n is a, c, g, or t
  misc_feature (591)..(591): n is a, c, g, or t
  misc_feature (618)..(618): n is a, c, g, or t
  misc_feature (621)..(621): n is a, c, g, or t
  misc_feature (623)..(623): n is a, c, g, or t
  misc_feature (630)..(630): n is a, c, g, or t
  misc_feature (636)..(636): n is a, c, g, or t
  misc_feature (646)..(646): n is a, c, g, or t
  misc_feature (649)..(649): n is a, c, g, or t
  misc_feature (662)..(662): n is a, c, g, or t
  misc_feature (665)..(665): n is a, c, g, or t
  misc_feature (677)..(677): n is a, c, g, or t
  misc_feature (717)..(717): n is a, c, g, or t
  misc_feature (723)..(723): n is a, c, g, or t
  misc_feature (961)..(961): n is a, c, g, or t
tgctagaaaccaagtttgagtgactgcacagttgtatcattgtcagacagaaggtagctataaagctaccctgtgagtcatatcagagaaagagttcagaggaagattagtaaatatgtatcaataagaataaagatttggtttgttctaatatcttaacatatcctccccgttttaggaggaagaacgtgcaagaagtgaggagctagagcgaatactggaagagaataacgaaaaatggcagaagcacaagccaaactggtcgaagaaagtatgagaatgttgaagaacaaagaaagattcatgaggaanggatgaaactagaacaagaacganagtcaacaaaagaagaaaaaaaattatcctgggcaaggggaagtccaggccaaaactgtccttctcattaaaaacccaggattaaattgcaaactctgaactttttacaaagaaaaatggaaaaacttgtatggtagcttcatgttgaagtggtttgnttngtttgttttnttaatttgtaaaatctggaaagtagcttgttctaataggggctatgtctgaatcctttttttttttttttttcccttccattangtcaaatctttatcagatcatggtggnatncnaaggagngacgtnttttccaccngtngggattctatatnagnggtctgaggaanagcagatcactttgtaaacactatggatggtctgataagngctttnactgaccccattgacttcagagttatactctgttggctactttcataatgctggtttggctggacctttgggttctctcttctattattttttctacacaaacaggaaaaagttggtgattgctttgcggaatttcccaggttttactggacctttgtggtgttttggttaacccagtgtccttgtgatactgtggctcttgatgtccctgatacgggtaaggaaccagttggtcaantctgataccaggtttatatacaggtcaagatatggcgcctgggacatagggtgtaaattcatggacaaattcaaaccaagtttcccc

SEQ ID NO: 523247 - DNA, 988 bp, Homo sapiens
gctcgtgctctgctgaccggcgctctgcggtggcgtgctctgctggtcgtgatggaacatctagatctacgagctgatcattgacaatggtctgcgcatgtgtgatgctgatgaagctgggagacatagcgcttccccgagccgtgttaccttccatcgtcggcggcctcagaaaccaggcgtcctgttgtgcatgagcgcagatggagtcctacgtgggctgactgaggcacaataggcacagcagtgtggtcctgagcctgaagtaccccattgagcatggcatcgtcgactcaactgggacgactagtggagaagatctggcaccacatcttctacaacgagctgctcgtggcccggaggagcacccagtgctagctgatcgaaggccccctgaatgcccacatgggctagacagtagagaagatgactcagcattatggtttgagaccgttcaaacaccgccggccacatgtatcgtgggccaatccaggcccgtgctgtccctctatcgcctcctggtgcgcaccactggatattgtcattggaactctggatgacggggtcacccatcacggtgcccatctaatgatgggctacgctctcccccagccatcctgagtctgaaactggttggcgggactgagcgagtacctcatgaagatccttactgagcgaggtaacaagctttcgacacacgggcggcggaagtcgtgcgcgctcagagaagctgtgctggtcgcctggacttcgatcgggatgcccgcgattctccctcttgggaaacgctgaggttgcatggcaggctcacctgggatgaccggcggtcgggcggtccgcctctctggtgagcttcgggccgagcctatcctgaggggtgggtccaagctgcccggtgttcgacccatccggtgcggagagcgccgtctcaaatccccgtggtgggggcgccgtatgccccttctttcttgtttcgttgttccgagcc

SEQ ID NO: 523248 - DNA, 307 bp, Homo sapiens
caagcgtgtatgcggaagaagtcgtcgtaggccccgggcatgattacgctgtagctcccgcttccatgcgacattcatagacttgttctgaaaatgcagtcgttctcgtacagggaacagagcttgctccgaaggtagtcatggacctggtaggtctctatgggtcttgcctccatgttcaggtcccagaccttgactgttaggtagtcccgggtgagcatgtagcggccgctgtggctgaacttcacgtcggacacggaggagatgatttccgagaagaatgagcggttactggggtcctcaggct

SEQ ID NO: 523249 - DNA, 135 bp, Homo sapiens
ttcgcttttcacctcacacgtgcctcaatactgcccaggagcccacgggacagctggggcagccctcctcccatcatggtgtgccctgtgcggcttcacctcagtcccccacactttccctgcgctccttctggt

SEQ ID NO: 523250 - DNA, 913 bp, Homo sapiens
cacgcagcgacgaatgagtatccggatcccgatccagatctcgtgctgaagtaaattgtctcttctttcaacattgagtgatgccgctgcggttcctatcccacatggaatcttcctctggtatagttgtgatccaggccgcgacacgatcttccaagcaccttgggttgttaacagccgacttgagtgagggatcaaagcctgctcagtggagcgatgctctattcactcgttaagaaaagtattcggctgagcaatctttgctatgctaagagaggggagtataatgtagcagatgagatactcgtaattctaccaactgggaagactcccgtgtgttacatagtgccatgtaccttgaggctcggagataccttggaccctcatggtgcttgctgagtttctattccctattccaggcttccttactctcctgtgcgttctaatagctgaactttcgttgccagactccttccctgagagttggtagtcctactgtataaaccgctgttctggcgcttacatttgtgaggcaacgtttctgtcatcgagggggtgtgcccgacgggtcccactttactagcccttgttgaccttgggggtttcccgtccttgtttttttgaccccgggggccggacctagggctatatgactgctagggccataggttaggaagacttgtagcgtagaaaattgccgagagaacttcgtgagcacttggcggagttaataattctgagccagaaatcgtggttgaggcattagtggggccataggttgctaagcgtcccttgaaacgttgtcctgaagacaggggttattgtcctgttaacaagaagccgtcatagaaagtggtatatctcttgaacccttaacaagacgtaaatttcgcgggagtggcccattaaaaat

SEQ ID NO: 523251 - DNA, 401 bp, Homo sapiens
  misc_feature (46)..(46): n is a, c, g, or t
  misc_feature (60)..(60): n is a, c, g, or t
  misc_feature (114)..(114): n is a, c, g, or t
  misc_feature (331)..(331): n is a, c, g, or t
  misc_feature (345)..(345): n is a, c, g, or t
  misc_feature (349)..(349): n is a, c, g, or t
  misc_feature (374)..(374): n is a, c, g, or t
tgggggaacgaccaattgtggtgacctttacctgtctacctcaaangccaggccgttggngcctctcaacgtcaccgggcccttcgagattcctggaaaccaggacccttcggngcttcttggaccggggtccggactcatgtcccaagggctgccgtttctaggggccccttcctgtaatgagtgccccgctggtggggcaacgatactacctcttgttatacgtggatttctcagagtctgggacttctataattaaaagctggtttggtctgttggttttttttaacagcttttggcccctgacgtttggtgttggtgtgtgttgagngcatccccctgagnatanatgctctggccataagacgtgacancttttaggttttgaaacactaagcatg

SEQ ID NO: 523252 - DNA, 246 bp, Homo sapiens
tgtacctgggcatgaaaagtctgcttcatctaggtcctatactaaggagcttaaacttacactaataatatatacttaattaagttttacttttacaaagttgaattcaattgtatccagtaagagaataatattttgacatttctgtcatagttatattcttccatttccaccccagggtctgtctctgtctctttcttcttcctcctccccttttttttctctgtctctccccatccccccggt

SEQ ID NO: 523253 - DNA, 150 bp, Homo sapiens
cgctccgccagaagcaccgagcagcgagccggggcccgccgtccctcctcctccatgaggcccgagtgaggcgcggcggatatagccgatccgcggggcctttccccccgcgtcctatcgcgagcgcagctggcgagcggccactggagg

SEQ ID NO: 523254 - DNA, 113 bp, Homo sapiens
gactaggaggcaggcactgcagggctgatagaagctgataggcttagggtctggaccaatggcgtgctgcctgccgtgcagagcttttcctgcttaccctacgtgtgcgttgg

SEQ ID NO: 523255 - DNA, 869 bp, Homo sapiens
  misc_feature (21)..(21): n is a, c, g, or t
  misc_feature (89)..(89): n is a, c, g, or t
  misc_feature (95)..(95): n is a, c, g, or t
  misc_feature (184)..(184): n is a, c, g, or t
  misc_feature (249)..(249): n is a, c, g, or t
gaatccccagacagctcgtcngcccacctgtaccgtggcatcttccctgtgtgtgcaaggacccagtccaggaggctgggctgaggacnggaccncccggtgaactttgccatgaatgttggcaaggcccgaggcttcttcaagaagggagatgtggtcatgtgctgaccggatggcccctggntccggcttcaccaacaccagcgtgttggtccttggccggtgatggaccccagagcccctcctccngcccctgtcccacccccttcccccagcccatccattaggccagcaacgcttgtagaactcactctgggcttgtaacgtggcactggtaggttgggacaccagggaagaagatcaacgcctcattgaaacatggctgtgtttgcagcctgctttagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttttctagctctttaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagccccaataataataagaaaaaaggg

SEQ ID NO: 523256 - DNA, 631 bp, Homo sapiens
  misc_feature (21)..(21): n is a, c, g, or t
  misc_feature (89)..(89): n is a, c, g, or t
  misc_feature (95)..(95): n is a, c, g, or t
  misc_feature (184)..(184): n is a, c, g, or t
  misc_feature (249)..(249): n is a, c, g, or t
gaatccccagacagctcgtcngcccacctgtaccgtggcatcttccctgtgtgtgcaaggacccagtccaggaggctgggctgaggacnggaccncccggtgaactttgccatgaatgttggcaaggcccgaggcttcttcaagaagggagatgtggtcatgtgctgaccggatggcccctggntccggcttcaccaacaccagcgtgttggtccttggccggtgatggaccccagagcccctcctccngcccctgtcccacccccttcccccagcccatccattaggccagcaacgcttgtagaactcactctgggcttgtaacgtggcactggtaggttgggacaccagggaagaagatcaacgcctcattgaaacatggctgtgtttgcagcctgctttagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaatccacaactcacccaggagcccaccccgcaccctccttaaagtgctcccagggcctggcctg

SEQ ID NO: 523257 - DNA, 330 bp, Homo sapiens
agctagaagggaggcggtatccacctgcagccctgttagtggtggtgtctcactcttgctatctctctttgtcccggatgaggctaatcaataccctgtggcaactgatgggctacttggaaaacatagtagtagacctgagatgcttggtcaagtgccgttgtgatggagttcatcagtgagccgttgctaatgcagggcagtaaaagtataacagcaaagaaccgatgggtgaatctggagattagtggggacttagggcaagcaggtgtgaggctatggacaaatgtcagaacagtcctgatatactttttgccgggatacctgtgg

SEQ ID NO: 523258 - DNA, 398 bp, Homo sapiens
  misc_feature (312)..(312): n is a, c, g, or t
  misc_feature (379)..(379): n is a, c, g, or t
cccgtcagatcagcctttaccctggaagctgatttctgtttcgtggggcgtttttgtatgtgagacgaagtcttgctctgtcacccaggctggagtgcaatggcacaatctcggctcactgcaaccttcgcctcctgggttcaagcgattctcctacctcaggctccagagtagctgggattacaggtgtccatcaccacacctggctgatttttgtatttttaacacagacaggtttcaccatgtgggccaggctggtcttgaactcctgacctcaggcaatccactcgcctcggcctcctaaagtgctgngattacaggcgtgagccactgcgcctggcaggtggctggatcttgagtaaggcctccctgtgtcagntctgaggactccccaaatc

SEQ ID NO: 523259 - DNA, 194 bp, Homo sapiens
ggtactgtcatgagtgtattagatacacgatactttaaaactgtgtggaaaaaactaacttataatttggtatcacacacccgggatatgtgttctgtttctaagcgacatgtgtgagagattatagtaaaatgagagcgaacaaataaaacttaatttaatcttagcagatacatacttatgggaaatttgaa

SEQ ID NO: 523260 - DNA, 125 bp, Homo sapiens
aaaaagggctgaaaggctgctggggctgccccctcgctattcccgcataagcatttgcccccaacccctttgaccttcatttgatgggcatttttatacagaaaacaataaagatttccctctca

SEQ ID NO: 523261 - DNA, 169 bp, Homo sapiens
ccccccccccccggggggggggggggtttgggggagggcccccttttttttttggcccccagggggccctttttgggggggaaacctttttttttgggggggggggccccccccccggggggggttttggggggggggcccccccccccccccctttttttttttggga

SEQ ID NO: 523262 - DNA, 1011 bp, Homo sapiens
catgtgggctctggagtataccaggaactgaagtaaggtacatggacatttatgcataccctatcattccatcaggcattggagaaatgtactgggctgactaagaacattcgaaccaatgcctggatggaatgatagtggtatgcataaaatgttcaggtgtgtctcatggagatagtaccaggcaactcgaacgataacgagtaacatggaaggtttatgatatatcagtaactgagaatgaggcaaattcacctatcgacactgtatgcaacattacatgagacagatgcgggaagacgaccaggagcatcactggctaacagtgccacttgtatcgtataatacccttcagcatattcctacagatattaaggcatacatcctcacctgagaaccagcaggaagaatttacatacaacatgacaccaagttgagaacaagaacttcacctattaatcattcgaaatggaaactttcgatgtgaaaccactctgactgaaagacaaagtttgatcggggacaaaacagggcaggaagtggctgtcaatgagggaacttacatgggattgtcacaatagataagtcctcggcgacatcacacacgagaaaggacgaaacaggaatacattcccaaaatagacagagctggtgacgacaactcaatcgactaggctaggagagcaggcaaagacaaactcgaacgtcagtaacatgggaaaacgcgagtcaccatcaagcagaaacagcgcctggaccacaactacaacataaatgggagacagaaacgacccgtggccgagaccaatcgacgaataccggcacgcatcaatggacacaggccaaccaccagcaagcagcaacacccccaacaaaaccccgcacagacaacatgaaagcaacagccacacgactcccacgacacacacaatcacccccagtacccaggcacgaacaccaccccacagcaacacaacatcgaaccgccgcaccaaacacagaacgaacccg

SEQ ID NO: 523263 - DNA, 194 bp, Homo sapiens
  misc_feature (168)..(168): n is a, c, g, or t
ctgctgaagcgcctggccgatctgatcgagcgggaccggacctacctggcaggtattatgccggctgggctgataagtaccacgggagaaccatcccgattgacggagacttcttcagcatacacacgcacatgacacctgtggggcgtgtgcgggcagcatcattcncgctggaatttcccgactcctgtatg

SEQ ID NO: 523264 - DNA, 903 bp, Homo sapiens
tcatgaataccttcagtgtggtgcttcacccaaagtgtctgacaccgtggtcgagccctacaatgccagcctctccgtccatcagttggtagagaatactgatgagacctattgcattgacaacgaggtcctctatgatatctgcttccgaactctgaagcctgatcacaccaacctacggggatctgaaccaccttgtctcagccatcatgagtggtgtcaccacctgacctccgattgtccctggaccagactcaaatgctgacactccgccaagttggccagtcaacatggtccccttcccaggtcatccattctcttctatgcctggacttctgcccctctcacacagcacgtgtgcaatgccagacagctatcggagctctcacaggtgccggaactcacccagactaggtcttcgatgccaagtaacatgatggatgccctgtgacccccgctcacgggtcgaatacctcaccgtggctgctgttcttccgtggtcggatgtccatgaaggacgtcgatgagcagatgcttaacgtgcagaacaagaacagcacctacttcgtggaatggatccccaacaatgtctagagagccgtctgtgagatcccaactcgtggctccagatggcagtcatccttcatcggcatagcagcagccatccaggagctcttcaagcgcatctcggagaagtacactgccatgttccgtcgggaaggacttcctccactggtacacaggcgaggcctggatgacatgagtcaccgcgctgtagcaccttgatcgccctcgctctgctatccgcagccggatgcccgggaaacgcggatcggagagcaaaagaggcaagaagccccagtcaaccaagtacagcctttcccccaatgggcgcaacggtga

SEQ ID NO: 523265 - DNA, 627 bp, Homo sapiens
ctaggaaatgcatataagggctgatcacctggtgtttggagccctctcagaggtcatagacctctagagagagaaactgagatacataacagggcggaaacaactcactggtgacacactgtggagtcctgtctacaagcagcacacatcaatccaccacacaaaaaccctaggctacagctcagttccttctcttaagaaaaaaaaagtgtgaaacaaataacctaagaatgaggagaaaacaagaagaatgaccctcttgcgagcactctgtaggttttatggcacctctacttgccagagttaatgtaaaatggaagtaatatcgtcttcgtgcacatttacgttaaagaaaaagagccctaaagtagacctgcaaactatagagttcctaagttcccctttttctctattttattttctgcctgctttaaatctgctgttatttttctattatgataaaaaaaaatcacagtttggatccaataggttttttgtttgcaagccagtgaatttgtatttatctcatggttaaagttctgtaaaagctataggatatgtgtgtgtgtgtgtgtgtgtgtgtagtgagaaggaagtaacagaggtgaaggtgctggcacttgtaaa

SEQ ID NO: 523266 - DNA, 1120 bp, Homo sapiens
  misc_feature (173)..(174): n is a, c, g, or t
  misc_feature (302)..(302): n is a, c, g, or t
  misc_feature (493)..(493): n is a, c, g, or t
  misc_feature (571)..(572): n is a, c, g, or t
  misc_feature (642)..(642): n is a, c, g, or t
  misc_feature (674)..(674): n is a, c, g, or t
  misc_feature (881)..(881): n is a, c, g, or t
tcaccttccctgtcttctggcatagcctagcacactggtctttttggaagtccactctaccatgccaactgaccctcagtcccaagaggtgggtgtgtgcagtgccctttgcattctgtgtcactgctcggggaatggggagggcctggttgtgccccagttacagaaagcannctccagtaagttctctgcctagcctcatcaccatggtaacacatggtgggattcagaaggtcagaatatgctgatgatccagctttgttaatgctcagcaggttaaagaaaaaagtgtatttaccttnaaaccaactccctgttccaagaaaaaagctcctctgattcatttagaaaatgccatgtcttggtttggcaacggagtgttctgtcggatctgaaacacttgggctagccatcttcctggtgtcaggggcagcatgggctaccctggggggcgggtgggggcacatctatttagaaacagaagctggcccangctgaagtcaactgctgttccagcacaaagcagcgacaggaagtgacaggaggcaaaaagtggtgggagctgagctcnnggccaggtggaagcagtgatgaatcccaacagtatcacagtggcagggggcaggggaggagatgtgggangaaaagccagtgagtatctgggcatgggggantagcggggtgggggcggtagtggggcagacagtgaaagctaggctgtcagaggaggactaggaggtccatctctgagggcagaaggcgaagagccccttggaggctgacacctacactgagaaagtcctcaggctgtgtgagtgcagcatcaggattgattttatttgggggacatgtccacaatacaacaggctctgcaaagtccngggccttactttcagcatgctccaagccttcccacagaaactagaggctaacgggtgcatgtgtgagtgaccaaggccttgccttctgcattcctgactcctggtgggtacaggagcaggcagaccccagtggaaccatttgcagaagagggcttccctaggttagctgcccttcataagggccccatttcatttcagagtcgctgcgtggaaacagcccgaatggtggtggaaattat

SEQ ID NO: 523267 - DNA, 93 bp, Homo sapiens
gacagtccagtctttattagcattgggtccctggtcccaccacccattcccctccacgtaccatcccttcccaccccttctgtcgtcttctcg

SEQ ID NO: 523268 - DNA, 721 bp, Homo sapiens
tggtcttcaaagtcaagacagtgtttgttatgcacgttcgtcgcgtatactctgttggggacagcaaacttgacccaccaatggacgcatgtgtgttgactgctcaggtgattatcctgaaccatccattcctactcactgccggatatgcccatgggtcggattgccacacgattaacattgcatgcaagtttgctgagctcatggataagattgaacgacgttctggacctatgctgaaagaaggccttaaactcttgacgcctagtgaagctgccattggtcttctgggtcctggctagctcaagtgcgttgagagctcatcagactatgcacctttgtgtcctttcgttagtcactatatgcgacacacagttgcgcctggaggcatcaacccaaggcacacgatggcatgtgtactactgactgcaccaagtctgtccagacagctcatactgcttaatgaacattatccgtaatacgtgtcactccactcttaatcagagtgcaagatcgcataaggaactgtggtatcaattgaccagtcacgtatagttgttaatgactggttaatgatatcaatgcattcggcctttagattgatacgacaatcgatttggaccactttgtgttacttattgcagtagagactttacttatgagctatatccgccttgttattgcatttgccacatagttggccatattcctggaccatact

SEQ ID NO: 523269 - DNA, 563 bp, Homo sapiens
gcgacactcttgagtgatgtaaacaatgctatttaacgagtgctttatctactttactgaaatacggaaatacttatgtacacgatttaaatgtgcacaagacttgggcttttttcttctagactatgtacatcattcagcacacaattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaagaaagaaaaaaagagagaagaatcaaatagacacaataaaaaatgataaaggggatatcaccaccgatcccacagaaatacaaactaccatcagagaatactacaaacacctctacgcaaattaactagaaaatctagaagaaatggataaattcctcgacacatacactctcccaagagtaaaccaggaagtagttgaatctctgaatagaccaataacaggagctgaaattgtgcggatcatcaatagtttacacaccagagtgt

SEQ ID NO: 523270 - DNA, 270 bp, Homo sapiens
atttataataaaaaatgttggggggggttgatgaattcctgttaaaagctgtttttgtgtgttacatgtaaccgacaggggtaaaaatttgtttccagtttttgtttaaccacccatgcctttaagtttaagtgaagtccccaaaaaggaaataggggtatggatatgtgattttgagattaaagttagttttaaaatgtaaataaaatgtcccccggttccccacatagggtgtaagagacaggaaaaaataataataatttaaaaaag

SEQ ID NO: 523271 - DNA, 410 bp, Homo sapiens
tgtgctgagagggacagggaagtgtaggagaggaagggacacaaccttcaaccactagctgatgaaatcactggaagggaaggtgtggggggcatgttcggcagggtgatacacacagtgcataaatgtgcctccccagacgctcctcagaggtggaggggacagaggctgcagcctggggcatggtggggctccagctcgtctcctcacccagggaccccacaggaatgggcactgcctgagactgccaggtgggaagaacctcagtgacttctcagaccttcttcttcttcagtctcagggcttgaagccagctgggcgacgatccttctgaccctgaggatttctctggcctgggaggtaacgtgaggggcttccccagtcctgggaccttgtcggatctcgaacgc

SEQ ID NO: 523272 - DNA, 828 bp, Homo sapiens
  misc_feature (665)..(665): n is a, c, g, or t
gggagaaataggccccaggcatcatgatataaagaagtcttatatgccgagctctgattaactctcaggatatgaagataatgaatttgtgcctagatacgccatatagtgacagacaagcgcttgactaggtaaatgcttggccacagaatcacttgcaagacttagaatagcagaaggcagttctgttatactatactttgtcccatccggtggtagacttccagagatgtaagtctttgctgcgcaatgtgattaaccctgctttacgaagtcaccatattataataggaaaaacactgcctaggaggcaagagatctgaattccagttctgatgctgccactgtgtaaggaagtagttttataaaccatgggcaaatcatctgagctttctcatctgtaaagttagggagaggaattaattagttgatctgtaaaataatcagttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagctaacaccatttaggttttgtgtctttttcaggcttgcctctacttaaatatatntagatgagagagttctcttagacttctttcttgtaaggaagggttatttggggaagtgtggaaaaaagattagggcagggtacccttagtttatataagggtacacaagaatgcgaacatcttccttttttctttaatctctgaagtcgtgtttggaattctt

SEQ ID NO: 523273 - DNA, 319 bp, Homo sapiens
tacccaccggggctgctcatcgccttcagtgcctgcaccacagtgctggtggctgtgcactgtttgcgccatgtcagcactgcatctgccaacatcgagcggtgacaacgtgacaatctcaactcggtcaaggagtcccccatgacgcatgaccgcacatgagctgcctgggcttctccaccgtcatcggcacgctgctcttcctagctgaggtggtgctgctctgctgggtcaagttcttgcccctcaagaagcagccaggccagccaaggccaccagcaagccccccgccagtgggcacagccaacgtcagcaccag

SEQ ID NO: 523274 - DNA, 467 bp, Homo sapiens
aagcgcacgatgggctcccctgccacgtgtgatctgtagaagaacgccgacgctacaagcttgacaagcagcagacattccgggtcaacctctttacggatttgacaagtataaacgatcagtgacgagtgggatatcccagagaaacagcctttcaaagacctggggaacttacgtttactggcttgaagaggcagaatgccgagattcacgtccagtgtgatttttgacgagtggagaccgcacttccatattctggaatgccgtaaaagaaccctgtctcaattgaagaaagagcgagatggccagaggacgtatgttgcgttggtctcctaaagggcacctacctggctaacctttcatcaaagaggcatggtcctaatagggggggaacagaaattcaagcaaattcagagattcagccacccaagggggtacagcttaattgagttctcaccttgtgaaag

SEQ ID NO: 523275 - DNA, 344 bp, Homo sapiens
  misc_feature (323)..(323): n is a, c, g, or t
ccttgcctacatttttaaaaacctagagctgggcatgatggccccagcctgtagtcccagtgattcgggagactgaggtgggaggattgctagaagccgggagttcgagaccagcctgggtagcatagctagaccacatctcttaaaataaaatagttaatttagccaggcatgatgatatatgcctgtggtcccggctgcttggagggctgaggtgtggggatctttgagcccgggaggtcgaggctacagtgggctgtggtctcaccactgtactccagcctgggtgacggagcgagacccagactcaaaaaataaaaatnaaaaccctgaatatcttcctt

SEQ ID NO: 523276 - DNA, 112 bp, Homo sapiens
agcatcaggaggcaatgcagcatcaggcagggcatgcagccatcaggcagggcatgcagccatcaggcagggcatgcagcatccaggcaggggcatccctctagaagtcgca

SEQ ID NO: 523277 - DNA, 854 bp, Homo sapiens
ccgccaaaacggtcgacacaagatttaataactaagaaggctggcgcacattttttattttttttcaaaatagttgactccatacatttgctggatcttgagcaatcttcaggtattccatcatagaatcctcccttaacattcctctatgttcttcatgccagttctgtattctttcttcccactgttcttttgttagttatgagttgttccaatacacgctggggtaggagtctatcattagccaagtagcctggcttatgaatctctttattgtaaactccatacttggcttggacagcataggaagccaaaagaactgcagttttctggaggacaatatatctcatcatttaagatggcttctttaacttgcaagaagaagaccctctgggctatttattgaattaattccccagaaaacattttaaagaaagaattcacctctaaaactgcactgtaaaggatcctctttcaaaaccaaacggatgattacccctccattcaagtcaaacccatgaagtaacaacctctgctgtctacaaacctgcgccccaaaaaaccccaccttaatcacccccactgtctcaaccaacctgtgaaaaaaataacctcccactaatattggactaaactagcacccaccatccaacaatcactcgaacccaccaaaagacgataggagtacagaaaactcattcgacaggtgataccctatcaaacaattcaacaccccaaaaaatatgacctaccgttatgatacgccggatattctcccaaaaacctcacactgagaattaaacatatcatacaaaaactaaacccaccattacatatcgcacacgactacctcg

SEQ ID NO: 523278 - DNA, 177 bp, Homo sapiens
tgatacttttggtctcctgatgccctaattcctaaactgttggcaaatagcaacctctatggggtggggggtttggagggtacagtggctgggagctggctgacgcaatgaggcccaagtcactcgggaagatcacgatgccaagcgcccgcgtactgcggtaccgcggcatcgaca

SEQ ID NO: 523279 - DNA, 941 bp, Homo sapiens
gtgtttctctgtatgcttagaaaattttacacacaaggaatgttctgaaaaagtgagaattttagagtgcttgggtggttttatttggtcagtgctgatgtgttaggtgtttagggaaataatgcttcaggaccttttgacaacacagcttcatgaatgactgggggatatttatgtttgtgctgagaaaagggagggagtgggcaggttggagtggggacctttccattgaaagcagtgcagtcagctgtttcgtagatgactgggggatatttatgtttgtgctgagcaaaagggacgggagtgggcaggttggagctggggacctttccattgaaaacgcagtgcagtcagctgttctcgtagatgcatttttctcttatgcttgtaacatgctcttgtgtccataacttgactgaacatgtcaagctccacggaatgcaaggcatctatcaggtgaccagaagtagaaccttgttcgatctctcgacctgcgccacgaactaatgtccaagtagtgggggtacaatgacacatcaagatctcactggtgaattttccactgcttaggtcatgtacatccaacctctttttctcacgtgcatgttcactctgtctataaacgttatcgcgtctcgggcgcactgcccccgcaggtacaacaggccaacagcgacggacttgcactcacccacgtggttgaccccaacttacgtaccattcaccttattacccattgccttgagaaacgggctaatcataatgacctatccccaacagacaaacacacccaccacgagccgcaacacacacgccaacacaacacgcaacaaagccaccacgccagcgcgacagaacacacacggaaccacgcaacagccccaccacacccacgaacaacccgggcccacccctcgcacacaccacccacaccagacagc

SEQ ID NO: 523280 - DNA, 122 bp, Homo sapiens
catctcaaacttaagctaccctgaagtggcagtatgattagtacacagtaagaaattatttatgtttgatacagactctcaccctttcgcccacactggagttcagaggtccaatcttccgg

SEQ ID NO: 523281 - DNA, 1062 bp, Homo sapiens
tgtggggaaaagagagatcagattgttactgtctatgtagaaaggaagacataagaaactccattttgatctgtactaagaaaaattgttctgctttgagatgctattaacctgtaactttagccccaactctgtgctcacagaaacatgtgctgtattgaatcaaagattaatgcatttagggccgtgcaggatgtgctttgttaacaatgtgtttgcaggcagtatgcttggtaaaagtcatccccatcctccattcttgattaaccagggacacagtgcactgcagaaagccgcagggacctctgcccaggaaagcctgggaattgtccaaggtttccccccactgagacagcctgagatatggcctcgtgggaaaggaaagatcttaccatcccccagcccgacaccagtaaagggtctgtgctgaggagtagtgaaagagggaggcctctttgcagttgagataagaggaaggcatctgtctcctgctcgtccctgggaatggaatgtctcagtgtaaagccgaccattcccattcgttctattctaagataggagaaaaccgccctgtggctggaggcaagatatgctggcagcaatactgctctgttactctttgctacactgagatgtttgtgtaaagtgaaacataaatctggcctacgtgcacatctgggcacagtacctttccttgaacttattcatgatacagattcctttgctcacatgttttcctgctgaccctctccccacctgttgccctgctacactcccctcgctaagatagtagaaatagtgatcaataaatactgagggaactcagagaccagtgccggcgcgggtcctccatatgctgagcgccggtcccctgggcccactgttctttctctatactttgtctctgtgtcttatttcttttctcaaaaaaatttttcttttttaactgcaataacgtcagtctgttacccattcactgcgcgattccattccggccataacctacagtgcatccttgcgatcagagtattgaggagactctctctggaaatatgttgccca

SEQ ID NO: 523282 - DNA, 577 bp, Homo sapiens
  misc_feature (103)..(103): n is a, c, g, or t
  misc_feature (112)..(112): n is a, c, g, or t
  misc_feature (129)..(130): n is a, c, g, or t
cacctcctgctcctccccgggaaatggaatgtctcggtgtaaaacccgattgtacattctatctactgagataccagacaactgccttatggctggaggtganacatgctgncggcaataccgctcttnnctgcactgagatgtttgtgtaaagtgaaacataaatctggcctacgtgcacatctgggcacagtacctttccttgaacttattcatgatacagattcctttgctcacatgttttcctgctgaccctctccccaccattaccctatagtcctgccacatccccctcactgaaatagtagaaatagtgatcaataaatactgagggaactcagagaccagtgccggcgcgggtcctccatatgctgagcgccggtcccctgggcccactgttctttctctatactttgtctctgtgtcttatttcttttctcaaaaaaatttttcttttttaactgcaataacgtcagtctgttacccattcactgcgcgattccattccggccataacctacagtgcatccttgcgatcagagtattgaggagactctctctggaaatatgttgccca

SEQ ID NO: 523283 - DNA, 1069 bp, Homo sapiens
tgtggggaaaagagagatcagattgttactgtctatgtagaaaggaagacataagaaactccattttgatctgtactaagaaaaattgttctgctttgagatgctattaacctgtaactttagccccaactctgtgctcacagaaacatgtgctgtattgaatcaaagattaatgcatttagggccgtgcaggatgtgctttgttaacaatgtgtttgcaggcagtatgcttggtaaaagtcatccccatcctccattcttgattaaccagggacacagtgcactgcagaaagccgcagggacctctgcccaggaaagcctgggaattgtccaaggtttccccccactgagacagcctgagatatggcctcgtgggaaaggaaagatcttaccatcccccagcccgacaccagtaaagggtctgtgctgaggagtagtgaaagagggaggcctctttgcagttgagataagaggaaggcatctgtctcctgctcgtccctgggaatggaatgtctcagtgtaaagccgaccattcccattcgttctattctaagataggagaaaaccgccctgtggctggaggcaagatatgctggcagcaatactgctctgttactctttgctacactgagatgtttgtgtaaagtgaaacataaatctggcctacgtgcacatctgggcacagtacctttccttgaacttattcatgatacagattcctttgctcacatgttttcctgctgaccctctccccaccattaccctatagtcctgccacatccccctcactgaaatagtagaaatagtgatcaataaatactgagggaactcagagaccagtgccggcgcgggtcctccatatgctgagcgccggtcccctgggcccactgttctttctctatactttgtctctgtgtcttatttcttttctcaaaaaaatttttcttttttaactgcaataacgtcagtctgttacccattcactgcgcgattccattccggccataacctacagtgcatccttgcgatcagagtattgaggagactctctctggaaatatgttgccca

SEQ ID NO: 523284 - DNA, 443 bp, Homo sapiens
gttagtccaattcagtctctctcctctacagaaggtctctagtgaccctatgtcgcacatggccaaggtctcatctcacatgccaggtctcaggtaaggtgtcagatgcccggtagatgcatgcagaagtagcatcaccccaggggtaccgcaggacctcgctgctgcctcttctttcagcagcaaccacattacaattgggatgttatgggaaaagcatttccattggcctggtagagaacatggccccaagaatgtgtgtccttagaactcggagctggagtccatccactgtccgggctctgttgctcctgactcttcatctggaggcaggaagtatctccgggcagagggagaggagctataaagtcaccagtcaaatggtgaacagacaccaaattgggtgattttaccggcctacaagggccaggttatcccacaat

SEQ ID NO: 523285 - DNA, 399 bp, Homo sapiens
caatttgctgaatcgaggaaaaacaccaggtctgggggccaattggtgctgacttctcaaagctggatcaaaaggaggacacctgggtctgggggtagggaacctaaggccaattaacacgaacttcctaaaactaaaccagaaggggaaatcccatctccccacgccgagcagcaaaggatcaaatctccctacagccctcccgcttccagcacatctcagatggaaagagagagtgccctgattggccaagcatgggccaccccttcctctgcatagggcaccaattcacctcagcctttaattagccaggaaccaaatccttcatccagacaagaggtaacttataggagcctcaaaaggggtacttaaaacccggaaaactggctccttcccccg

SEQ ID NO: 523286 - DNA, 904 bp, Homo sapiens
tctgtacctatctatctggctggcggaacagctggccggcagtctcagcctctccgagacgcaggtgcaggtgtggttccagaaccggaggacaaagtacaaacggcagaagctggaggaggaagggcctagagtaccgagcagaagaacgaagggctacccatacacatcaaccggtaggcgcatatagccacgaagcaggccaatggggacggacatcgatgtacacctccaatgactagggtgggcaaccacaaacccacgagggcagagtagctagctatagctagctaggccaggcccctagcgtaggagcccaagctagggactactaggctcactaccctggccaggctatatggggagcgcctaggagtacatggccccacagggcttgaagcccggggccgccatattgacagagtggacaagcaattgtggctaggctagagtgcctgtggaccactataggccttactacctacggagagccctagccttgccttaggtgcgtgtgccctgtcctgccaccagcaagcctaacccaagctagctacttaccgtgtaactaccaatactacccttattagagtatatagaggattgccatatatctaagtatatataaaaattgtcataattttcccaagggcgacccaaaggtaggtaacggtatgtaaggtaagaattaccgcccaagttttgttccccccccttattcccgtcttaaatttgcgcggcagattaacattaacgaccacaaggtacgtaccttacctaccttatgaacaatttcggacacatcaaaccacacagacacaataacgaccgagaagagcgcagaaaagctctactacgcgcgacatgaacagcagcgcgagaaaccacaagtaaaacacacaca

SEQ ID NO: 523287 - DNA, 125 bp, Homo sapiens
taatagtaatagttttgaaaggttaaatgccagcttctaacatctttcaaaataaactctgattatgttagagtaaaaaaagtcagtcccaaaaggttacctacgtgtatgattccatttacata

SEQ ID NO: 523288 - DNA, 236 bp, Homo sapiens
tactgactgagctgggaagaactgtcttcatgggctagaaattggatgctgccggcgactgcacaaccagctgcatggaactcaaggtgcaacatcctgtgtattcttgccgggtccgccctgtcctgccgggggagcccactccacccctgtgctcctcctgtttccctctggccctggttgggcctctgatcctccaacccgcttagcctctcccggtctgacgagcggcgtgg

SEQ ID NO: 523289 - DNA, 449 bp, Homo sapiens
cttgcattttaaaatgaaaaagggagactaaaattacatttattatttcctatatgccaaagatctggctaggtgctttagtatattgggttattaaatattaaataaatttaaataatattaaatattcttaataacaatgtgaaacaaattattatctctgtttgatagatgagaaaaccgaagctcagaaaagttaggagagatgtttcaaagctacatagctagtaactatttgagacttgaatccaatctcttggacccaagatagcaaatgaattttatcttaaggattaactttagtcagttgatggagattgtctgcagcagtggagagaagggttctgaggctgtgtctgggctttctgggaaagaacatctcattcagccagtgacatttgttacaggagcgaggagaggagaccgcactccagccattttatttttcc

SEQ ID NO: 523290 - DNA, 237 bp, Homo sapiens
aaaagctatggaaggaaaatggataacagatcagttgagatggaaaataatcccctgcaagatgaggattgacagttaaaacaaacaatatgtaaaggagatgaggaaatggagacaaattccgaaggccttctcaaaaccaaggaaaagaatcagaagcttcacagtcgagcacaacggcaccaagagaaaaggagagattcagaggcataatcgcaaactttggtaccctgtagg

SEQ ID NO: 523291 - DNA, 252 bp, Homo sapiens
aaacgcaccgttcttgggtgggcccccacttggtccccggatgccccccccacttggacaaaggccaccttattgcccaccccagttgtggcgggaggtgcagagcaaagggctttagggagcagtgactgcggtcccccctttagttttttgggtgtagaccaccccccctcccattgggccccccccaacacggtgtcctgccccccagggcctggttccaggaaaacacgcttgccttccttcccggca

SEQ ID NO: 523292 - DNA, 354 bp, Homo sapiens
gtctacagcttcctgaggtcaggagttggagacatgcctggccaacatggtggaactccatctctactaaaaatacaaaaattagccgggcgtggtggcaggcgcctgtaatcccagctgcttgtggaggctgaggcaggagaatcgcttgaacccaggaggcggaggttgcagtgagctgaggtcgcgccattgtactccagcctgggtggcgacaagagcaagactttgtctcaaaaacaaaacaaaacaaaaaaataattctaacccttgggtcgggcttgggttaggtgcggtggctcacacctgtaatcccaacactttgggaggccgaggtgggtggatcacttgatg

SEQ ID NO: 523293 - DNA, 752 bp, Homo sapiens
cgaggagccaagggtggtagactgggggtgtggggacgctggagactgggaaggtcgcgggaaccatgtaagagaagtgcctcagcgactctggaccctgtcacacgagccctggatgttcgaaccgagcactgaatcatctgccagctctactcgttgagatacatgtagaagttctaggtcatgggagcatggctggcgttaggatgtgagcgtcctgaaaaatctggccttgtcatggttgtagacagacttcatgttatagatagtggacactatagatgtttccgaatctaaataggcagtttttatttaggcgctaaagatattggaagacctaaggctgaaggtgcgggcagaatttctaaatgacagagttcctaatttgcaagtgtagattccagcatttcaacgaacgattcagagatattgaacgacacgtttcgtatcgacaagtttcatattattgtatgtggactggactctatcatcgccagaagatggactaaagtgggcatgctgatagtcgtcttctaaattatgaagatggtgtcgttagatccaagctccattgtcccttcgactagatgggcgggacagaaggttgtaacaggaaatgcccgggtgattctgccgtggaatgactgcttgtatcgaatgcacgctggaacttgatccagcacaggttaattttcccatgtgcaccattgcatctatgcccaggcgtaccagaagcactgtactcgagtatg

SEQ ID NO: 523294 - DNA, 890 bp, Homo sapiens
  misc_feature (34)..(34): n is a, c, g, or t
  misc_feature (36)..(36): n is a, c, g, or t
  misc_feature (43)..(43): n is a, c, g, or t
  misc_feature (62)..(63): n is a, c, g, or t
  misc_feature (78)..(78): n is a, c, g, or t
  misc_feature (85)..(86): n is a, c, g, or t
  misc_feature (90)..(90): n is a, c, g, or t
  misc_feature (108)..(108): n is a, c, g, or t
  misc_feature (112)..(112): n is a, c, g, or t
  misc_feature (117)..(117): n is a, c, g, or t
  misc_feature (163)..(163): n is a, c, g, or t
  misc_feature (194)..(194): n is a, c, g, or t
  misc_feature (200)..(200): n is a, c, g, or t
  misc_feature (207)..(207): n is a, c, g, or t
  misc_feature (221)..(221): n is a, c, g, or t
  misc_feature (224)..(224): n is a, c, g, or t
  misc_feature (230)..(230): n is a, c, g, or t
  misc_feature (239)..(239): n is a, c, g, or t
  misc_feature (250)..(250): n is a, c, g, or t
  misc_feature (257)..(257): n is a, c, g, or t
  misc_feature (278)..(278): n is a, c, g, or t
  misc_feature (282)..(282): n is a, c, g, or t
  misc_feature (564)..(564): n is a, c, g, or t
  misc_feature (567)..(567): n is a, c, g, or t
  misc_feature (585)..(585): n is a, c, g, or t
  misc_feature (598)..(598): n is a, c, g, or t
ttccggccgcagagctccaccgctgaggccaacnangccatanctttattctgtgttattannttccatattatacangataggnntttnaaaaaacatataattttntaanacaanactcattacatgattgtattattttctatgacatatttaaagagtntaataacatgtataagtaaaaacaaatttangagaanagtcaanatatttcatgtatnccngggggntgatactancattgaggaanctaatancctaaaattatatccaaggcntggncacatctttttcccaaaacgtctgaatgatcagggcaacttcttatgggtcccttaggctggcagtcttggccttctcttctgggagctctggggtaatagtttggtctacagcagaagtgaaaacattgggtgtgctgggttttgggtgaattgagggcatgaaaactcctgcactggcatgtctaaagttgatcgcttctttttggaaatatggggggctcttctcctgtggacatcacagcaatttcaggagctgtgcctagttgggataaggaactanttnctgtgtcctcctgaatancagggtctgctanttggggaatggtccaattgaccatagatgggatctgctcctatactggggctggctgggtggggaggggaccttggacctgggggtgaggtggtcccaggggggaccttggaactggagggatggaaccttgggcttgtctggggcttttgaagggaatcctaggggctacctgactgggctgggtgggcgaggggggttaacgcgaaggagcactgggcgtgctggcgtctggcaaagggctttctgggaaggggccagtgggagcagcccaactgggtgacctaaaaaga

SEQ ID NO: 523295 - DNA, 472 bp, Homo sapiens
caccccgctggcattctttgatcattgccactgaaatcatatcacgcactactcccagctttccttcttcgatcgccagcactgctactgcatcccagagtactcccatcttcccttcttcgatcaccaccattgagaccacagcccacaagtacttccagcgatgaatatctacgattactacaaccggggccacctcacacagtacgtcccagcttcacttctttaagtcgaccatcactgcgttcacatcccacagatacataccagcttcacttcttcaatcaccaccactgagaccacctcacccagtactcccagcatcacttcttcgatcgcaaccactgagatcatctcacatagtactcccagctacacttcttcaatcacaaccactgagaccatatcacatagtactcccagacttgacttcttcactcacaaccagtgagaccatatcacacagtactag

SEQ ID NO: 523296 - DNA, 531 bp, Homo sapiens
gaacaaagatttctaatgaacataaggactatgctaatggatttaaattataactgtgtgtgagagaaagatgacttcaaatagattcaaggtatgattaacacaaagcagtactctgaaccacaccctctttcaaaaatgcacagatacaacatcaactaaagaatggagaaaagaggaataagtgaatacgctgatttttggaggcttgtatagtttattgtagttaagcattaacttcagctcactactttgtggtagaataatacatttggcagggtgaaactagataagaatgttatctttagaaaactagatacaagtgattcaaatgccattatcctatgaaatgtggtcgttggatgcaacttttgagatgactgcacgtagagaggaatctgtttaataaatgggaatcagtacccaaatctatgatcagcaagattttctgtgctaaggtacttaaaacatttgggtgggggagggcaagttcaaaactacatgagatactgttgcatcaaatgtttcagg

SEQ ID NO: 523297 - DNA, 249 bp, Homo sapiens
  misc_feature (215)..(215): n is a, c, g, or t
acggacccacagtagggaggaagccagcggtgagggagtgagggctctgtgggatacggctcttcggaaggtgcgggaagtaggcttagaagcccttgtgggagctcagctccagcatgcagataggacgagtttcctatctcagagagcatgacaggaacagacagaagggcaagctaaggcaagaaaagttcagggacagagcccacgtgggncgcctcattcaagtgcccagtatctacggacggt

SEQ ID NO: 523298 - DNA, 922 bp, Homo sapiens
agcggagagtccagccgctggtgcgcggagcggttcaccgtcttcagagcggttcggcccatgcctttcgcccaggctgccctatgtgcccgctgcgcgcgtgcgtgagcgcgccgtgacgccggcctggtggccgctgcaaggtgggaggatgatgaggccgcctcagcgaggatcccttttcacgccagaaattactcagatgctgaacagctctcaaagtggtattggatgacgctgaccgtgaccagtcggacgtgggaacggggaatcaaggaatgaaagcaatgtccagttccacatggtcccccgtgggaaactcgtcggaacttcgaggaaatgcgcaagaggcgggcctgtgagtctgacacgaaacgatcagacaagtttttgggagcaccacgaaatatttgggggccacccgagaactcgtaaaagagagcgaatattccacggagacatccacatgggaacaacttaccagagagacggcaaggggatagagcgtgaacgcgccccagtcggttccctgagattcagttgagaaccaggttggggtcccccaagaatttgtgccgaacgcgtggaatttacccctgcggaggcggttcaattgcccccataggcttccaaaccaaaaggattcaaaaccgggggagccttggcactaggggccccttccttctttgaagcttggttcgtccttgggagcgccaattagtgcaagggttccttggatttgctaaacctattgcgggaaaaaggttgccctactaaaaaactacttggggggccctaatttattacggggaaggccttcccgttcctggggttccaatgccatttttaacgcccttccttgtgagagcccccggacataattcattgggacgatgtgtatatcgacccctaattgtcgcgg

SEQ ID NO: 523299 - DNA, 495 bp, Homo sapiens
tcgggtgtcttacaagacatcccatatttcatttaataaacaaatggcagccaggtgtggtggctcatgcctgtaatctcagcactttggaaggccgaggcaggcagatcatgaggctcaggggtcatgagatcaggagttcaagaccagcctggccaacctggcgaaaccccgtctttactaaaaatacaaaaatcagctgggcatggtggtgtgcgcctgtaatcccagctactcaggaggctgaggcatgagaatcgcttgagcccgggaggcagaggttgcagtgagccaagattgtgcccctaaactgcagcctgggtaatacagggagactgtgtctcaaagaaacgaaaaaaggaaatggttcaaatgatcaattgtggtaaggtatattaggccacaatttttaaaaagaaatgaggtattgatacttcattgacaatttagatgaatccggaaaacataaggacaccggaaataagggggtaccga

SEQ ID NO: 523300 - DNA, 360 bp, Homo sapiens
  misc_feature (81)..(81): n is a, c, g, or t
  misc_feature (97)..(97): n is a, c, g, or t
  misc_feature (146)..(146): n is a, c, g, or t
  misc_feature (159)..(159): n is a, c, g, or t
  misc_feature (168)..(168): n is a, c, g, or t
  misc_feature (273)..(273): n is a, c, g, or t
attcaccaggtggtttttcccgctgtatcttcagagaacaatgactgatgtgagatgtgaagttttcattgactggagcanctcgagacagagaagntggtacaagtacaatcatgattgcagcacggataatgtgttaccccggnttgggcccttggngggttgggntttaaggggggcggcatggtcagctgaaaacacttattgaatatgaaaggtttcccccccccaaagcaggcccttgggcctgagcagtgtggcagaatccaaggnctttcaaaaataccagctcaagactgtcggtgatgtggtcaggggaaaaaaggaaaagctggcccaattggcccccaccgaattctt

SEQ ID NO: 523301 - DNA, 866 bp, Homo sapiens
agaagatggcgaccgtgtgggatgaagctgagcaagatggcatggggaggaggtgctcaagatgtccacggaagagattgtccagcgcacaacggctgttagacagcgagatcaagatcatgaagagtgaagtattgcgagtcacccatgaactccaagccatgaaagacaaaatcaaagagaacagtgagaaaatcaaagtgaacaaaaccctgccgtaccttgtctccaatgtcatcgagttgctggacgttgaccccaatgaccaggaggaggatggtgccaacattgacctggactctcagaggaagggcaagtgtgcggtgatcaaaacttctacccgacagacatacttcctgccagtgattgggttggtggatgcagaaaagctgaagccaggagacctggtgggtgtgaacaaagactcctatctgatcctggagaccctgcccactgaatatgactctcgggtgaaggccatggaggtggacgagcggccacggagcaatacagtgacatcgggggcctggacaagcagatccaggagctggtggaagccattgtcttgcctatgaaccacaaagagaagttggagaacttggggtatccaagccccccacaaggagtgctgatgtattgggccggcttgaaacagggaagactctgcttgcccgaagactgtgcttgtcagaacaagggcaacttcttgaagctggcagggccctcaggttggtcccggatgttattgggaaaggcgccaagctggtcgggaagctcttggccggccaggggaaggccatctatttttcctaccattggtgccgtggtccaagctcgacagggaaaggcgcaaccgagtgaagccc

SEQ ID NO: 523302 - DNA, 222 bp, Homo sapiens
gctttgcagcgtagccgagtcggtcagcgcggaggacctcagcagccatgtacgaagacccatagtgaagacgggactgacttcatacagaaccagcagctgcacgcgacatggctgacacattactggagcacatgtaacgactggacattgattcaacaaccatcacagaccggaacactggcatcatctgtacccttgaaccagcttaccgatcagtgg

SEQ ID NO: 523303 - DNA, 343 bp, Homo sapiens
cgcggatcacatctacacacgtaatgaggcatcactgccatcaattcttcagtatccccccaatctctccaatcaaacagacctccaaacaatacactgtgaaattccaccatgcctggggtggctcccaaggcacgcttacaccccagaaaacaacacagctggagcacaagtaacaaatgtaccacgttgcaatgactcacgggcagtccccaggtacagaggaccaacatctccagaaccaaaaaccctcacaccaggtgcacttctccaaaacagaccatttaccaaaacgctcatgtgcagtcacagagtgacaactagatatcataaacaacaaaga

SEQ ID NO: 523304 - DNA, 216 bp, Homo sapiens
tcgatcgagccgcccctttggatcttattaaaatcccaaaatactgctcctcctttataatagggtcaacactttactacttccttttaaaaatgtttttttttattgtggtaaatacatgtaacatacattttaccattttaataatgttttaagtgtacagtgaagtggcattaagtacagtaaaaaaaaacatttttaataaggatcccctag

SEQ ID NO: 523305 - DNA, 272 bp, Homo sapiens
cttaaggatccattgatagcgataggcgacttacttcacagcacagccgagggtacctcatgtagcagagcggagacagtctcactcacccaggagggaggctgagagtgctcaggcagcggagcgctcattgccatggtgatgacctggcgtcaggcagtcgtagctcttctccaagggagaagctggaagcagccgtggccatctcttgctcgaagtccagggcgacgtagcacagtttcttccttaatgtcacgcacgatttcccgctc

SEQ ID NO: 523306 - DNA, 475 bp, Homo sapiens
  misc_feature (388)..(388): n is a, c, g, or t
  misc_feature (463)..(463): n is a, c, g, or t
  misc_feature (468)..(468): n is a, c, g, or t
gtccaagggattattatataagttaagcctttgaatgctacctgtgttttgtttttctttttaactttgagaccgataaaggtagagggtttttgtttgcttcaaagtaagtaaaaaatgcactgaaactcgagacatacttggaataaaggtaatttggaagtatcttcatctctcctattaaactcagagtaaggctgggtgcagtggctcacgcctgtaatcccagcactttgtgaggctaaggtgggcggatcacctgaggccaggagctcaagaccagcctgggcaatatggtgagaccctgtctctattaaaaatgcattagcagagtgcgatggcacacacctgtagtcccagctgaggcagtagaatcacttgaacctgngaggcagaggctgcagtgagctgagatcgtgccactgcactccagcctgggcgacagagtgagactccgtctcanaacanaccacct

SEQ ID NO: 523307 - DNA, 693 bp, Homo sapiens
gcaggagccgggcccttgctgcccaggccacccgcagcagagaccatcgtggcttcctttgctttgggcttgaatggccagagccctcggggagcaaggacctgggggcttaagtgcagccgtgaggaagcgcactgtcccgggaaaggtaaataaagtgctccctaatggctggggaggttgctaagaggcggtcggggcccagtccctgcagaggcagcctgttttcttctccggccagcctctcaggctttctgcatcgacgtgcctttgcgattcactgggccccgttcttgtttgtttagtgattcctgtaataggttctgctaaagacattcatttgtttagggacagggctgggggatgacagcatgacttggtttctagcatccatctgctgtggccaggagtccctaatggtcttgtctcctggcgtaggtgcaaagctccggggtcggcgcctgccgcctctcggcttttagggccaggccatctggattaggcggtttccctcttaagctcggtaaactccacagactgtgacagatcccctttccagctgtcacaccacctggctgcatgctgccaccaggggagggtggtcgaattcggatctggtcagtagatcaagtgccagcatcctggcaggggtcttccggccaagccaggcagggtcactttctttgcagttgg

SEQ ID NO: 523308 - DNA, 268 bp, Homo sapiens
tggcccgaggtaaaacccttatgggttttaaaggacttggcataaaaaaaaaaattggcaaaggccccttagggggttggggaagacaataaggaactgtttgccttgggccctaaactgggataaaaaaggcattttcaaggtttatacgttgtccaactgtaagttccttttaggagcagacctaacaaaaattttaggtcagaaccctcccctgtttaaacaaacaaaaactttccctgttaataaaaggattcctttgctttta

SEQ ID NO: 523309 - DNA, 855 bp, Homo sapiens
aacctacagaatggaataaaatatttgcaaactatccatctgacaaaggtaatatccagcatctataaggaacttaaacgaatttacaagaaaaaaatgatcccattaaaaagtgagaaaaggacatgaatagatacttttcaaaagaagacgtaaatgggagctaaataatgaaaacacatggacacaaaggggagaacaacagacactggggcctacttgaagatggaagatgggagtagggaaaggatcagaaaaaataactgtttggtactaggcttagtatgtgggtgatgaaataatctgtacaacaaacccccatgacgtgagtttaactgtatcaaaaaccttcacatatacccctgaacctaaaaaaaaaaaaaaaaaaagggttaaaaaagggctctgtgaaggttctggagttggaaaaagggtcttgacccaagaccagtatgggttataccagggaatgagggagacagtgacagataaggctggattcaggtgtagactatagtaaaagtttttattcggtatatcatgggaaaaatggtgcttccactgaagcatcatgtatctcttgggcgttcataatcagggaaatacgtgtacgtatgtggttccagtgtacggggctaaatccttacctttccatattgtcctagctaaaggagggattggcatacttcgtacacgggaaaaaaaaggtgggcacaaatattggaacctataaccgcgcgggtcaaatgtgtggaataaataacactttggtagtcttccatttcccaggctccatgaaattactcccaaccccgtttaatccctgactaccacttaacacttgggggcaatatt

SEQ ID NO: 523310 - DNA, 516 bp, Homo sapiens
gcagccaccttctccaagacagtgtatgtcctagaagagaaaccttctaggccagcagttgatagtttcccttaaatgtgagccttgcacttccaccaagtctaatggattgcttgtgtttgaggccacagcagctcctttgataagtaccatatcctctgtactacacacagctaaattaatattgtttcatttaaccaaaccccccccccaaaaaaaaggttggctatctctcttaatattgcaggaggacctacctatgcaggagaaattttgccatttccttaagctagtggtatagaggctggtgctgggaggaagtcccacctctgaggatgggcagctctgtccagtggcatcattgatgtcccttgttttctcagttctgagaagcacagtacagtggtactgctttcagcactgaggcttattcctagaataggggaaagcccaaacctgacgtaaggttacaagttctaggggtctggcagtaaaccctgcagagagttttggttc

SEQ ID NO: 523311 - DNA, 138 bp, Homo sapiens
cccgacctatattatgtagcgatgaaagtggtatgctttagactataccgggatagcatctagtatataagcctaatgtggggacagctcatgagtgcaagacgtcttgtgatgtaattattatacaaatagggggga

SEQ ID NO: 523312 - DNA, 345 bp, Homo sapiens
  misc_feature (229)..(229): n is a, c, g, or t
  misc_feature (233)..(233): n is a, c, g, or t
  misc_feature (239)..(239): n is a, c, g, or t
  misc_feature (254)..(254): n is a, c, g, or t
  misc_feature (256)..(256): n is a, c, g, or t
  misc_feature (258)..(258): n is a, c, g, or t
  misc_feature (261)..(261): n is a, c, g, or t
ccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtgggtgagtggcactatatgcttgtgacggaaaaacccaagccttntaancttatngagaatcggtcttcntnanttnttgaacttttcctataggtttaacttttactgcatagaattaacactaggaacagtgtcatgaaatctgggttgaaggagaata

SEQ ID NO: 523313 - DNA, 382 bp, Homo sapiens
  misc_feature (8)..(8): n is a, c, g, or t
ggcggcgntggttcccgcgcgctccgggtctctgaggctgagggtactgcggggctgactagaacagagacaatgtttcgagcagcggcgcctgggcagctccggcgggcggcctcattgctccgttttcagagtaccttggtaatagctgagcatgcaaatgattccctagcacccattactctaaatactatcactgcagctggacgtcttggaggtgaagtgtcctgcttagtagctggaaccaagtgtgacaaggtggtacaggatctatgtaaagtagctggcgtacaaacggttctggtggctcagcatgatgcatacaaaggccttcttccagaggaactcacaccattgattttggaaactcagaagcagttca

SEQ ID NO: 523314 - DNA, 760 bp, Homo sapiens
gcttctctttgacaacttgcatctctcctacatggaagtaaggttttattcctgtcaatgttgtctttgtgtgtgacagattaggattaaattatggtttgacttttcctagcagcgtgatcatgggcaagtggcttatttttttttttttttggaaacagagtctccttctgttgcccaggctggagtgcgtggccccttgggccattgattccggcctcccggcccagtgatctctcgtgctgcagtttctcaagtagcgggcttcaccaccacaccgggcataatttggggtttttatagtaacgacgagtttcaccattgtggcgcaaagtgggtctcaaataccgggcctcaagtgatctgcccatttaagcctcccaaagtgtgggaatacaggcgtgagccattggccggggttttttaaacgcttgagatcctttcacataggaaatggcatgctaccgcgggttggacagctaatccttccagaaaactctggcatactctgtccgaccgggggacgtaaaattttccccctacaaaggggttgcataaacaaagtatggcgcttacggtttgtgcaacgggttgcccagttgcttgcgcaggcctactctaagtaaataggacgctttcagtgcgaaaaaagacgcacgtcaaagagcagcatccagcaacacaaaacaaggcgcggcgcgctcgtatatatcgcgcagaccacgagactacaccacggtgagaagcgcccccgagagaa

SEQ ID NO: 523315 - DNA, 177 bp, Homo sapiens
gagagttggcaggagagagactgtgcaggcagaagtgacagtgactgcccattccaacagcaggggccagttcctagcacctgttcacctcatctcctgaggctataggaggcctgagggaagaaactgcaggaggggaaagagcactctgagatgcacccctgccaggatgggtat

SEQ ID NO: 523316 - DNA, 101 bp, Homo sapiens
tttgcacccacagctcaccaacaccatgacaccttccacaacacacttcagcctctaacaatactcctctactacatcaataactcctcctacattttcac

SEQ ID NO: 523317 - DNA, 242 bp, Homo sapiens
gctccctgaaaacttctggtcatgagtgaggttaattaaccagaagctcatgtagttccagagctgagctctcgtgtggcaccgcaatcacgtttttgaaacatgaatttggggaactcattctataatagattataaacgccttgagcttggggatcgtgaaataatgatgaatcctccatggtatctgagtcccagaagcaggcaatcctgcatggtatttgaaacattctgtgctctta

SEQ ID NO: 523318 - DNA, 385 bp, Homo sapiens
agaaaggtcatgtcgagactttctatgtgaatgcgtgacgatccatatatgcaatccatgatgtgcaagggacgcccatgtttcgatatcaggtcactgaaaggcaacatcttgttccactggctgtgctcgatgagtaggataactctgtgcgatacatcatccttataggcgaccttagacccgtcggcacagcatgattatcaactgtgggataatgactgtgtacacgcagactttatccagatgcatctatttacatgcctttagtactggaacatctagcgagttctctcgactaaacctcatgcatgtagtcgtctgattcattatactccattttgagggatttctttcgagtctgctgtcttacagatagcttgtt

SEQ ID NO: 523319 - DNA, 479 bp, Homo sapiens
gcagatatactcatggttgtttttttatttctccccagtgtcaacaacgcacccatttgtggacagcaatcttctctaccagttcagaaggatgccatgactggcatggcttgtgcggtaaccagctccagcaaacctcacgttcctgtgttaaaccttgatgtctcctgtaaggtgcatgccgtgataggggtgctgatggatgacagggatcccctggtcacagtgatgaattttgaacaggcccccaggagacctatgcagatatgggggggttggacaaccaaattcaggaaatcaaggtatgatggatgggtaaccatctctgggttccagtttgggttactgtggtcccatttaggatacttggcaggtgtaagggatgtcggcttatttattaatcaaaccaatagctgagtcagagcttgccagtggtggtatttaggaataggttaatactgagttaggtgatagaaata

SEQ ID NO: 523320 - DNA, 1407 bp, Homo sapiens
atgagtgagttgggggccacacatacataaatagggcctttttattggggcccgccttgtgttttcctgtggtggaaataatatttgggcaatattgaggtgtcccattggcccccctattttcaatgggcctccacacctcatcgcttgtagtcgtaaggttgagaccacaagcagggttgctgttataaccgccgccctgtgtgttttctttgggcgcactttttgccaactgagggcaacaacatagtgtccccccggagggggggaaaatttgttgttggttccgccaaagccttctatggcgaaatattctttttctagattagagaaaagttcctcggggtgtgcacacacctctgagggaaataatcggcaacagccccttgggggagagacgccacaacattgtgtgtgagaaagaagataataccccgctgcaacacctttctcaacggccgccccaacacgctgtgcttcttaatagggggaaacaccacaacattgggggaagaaaggaaatagataaaatgggggagcttttggagataccaccacaagggggtaatattctcttttttgtttataataagggcgtgtattgttcctataaaattaggttagaagacgttcccaacacaggaaaagggggaaaaattgggttctacaacagatgtttgttgtgtttcaacatggaagagattttgttggacaacaataggggggcgcaccccctcttgggggagatatatatcacatcagcgtagaaaataaggggagagcccacacatgtagaaagaagatattcccacatgctcacacaaaaatctctttatacgtctgtacaacgcgcgctttgggggctctgtggagagagagcccacacaattataaagagaaattgtagaacacacatccccttatatgtaaaaatatacctttgtatataggcgcacacactgggccacgcaattttgcgcacaacatatggtataaaatgtgctggggtgaaaaatgcccgtgtgtgtggggtataaaggcacacacatggggtgtccacaaaattctaagaaagaaatgccacagtttcacaaaaaacacatagaccaagaacttcggagagtttgttaaggggctcgagaggagaaccacattcacaaggtaagaacacacacaagaaaaaattgtcttggggtgaaaaagtgtgttgctgattgtcaaccaccaactggcgttaataaataatataataaagaacctgtcttatataagactggctttagaaccgtaggtgtttttaaaaaaatatattatattatattttggccctctttggggaaatgggtgggtagaatttataaaaatcccttcctgagtaatcacaacgataccaaaatgttactgcca

SEQ ID NO: 523321 - DNA, 569 bp, Homo sapiens
  misc_feature (257)..(264): n is a, c, g, or t
  misc_feature (267)..(269): n is a, c, g, or t
  misc_feature (276)..(276): n is a, c, g, or t
tatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttagtctccaaacttctcaactttgccagctttctccaannnnnnnnttnnnaaaaaanaccccatcagtagagacattgctgttcctgcccatcccagtgccagctactccttcctggaagccttcctggatttcacgcatcccatcctctggccagaaatggcctccgaactgtgcagctcctgcagcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctgaaaa

SEQ ID NO: 523322 - DNA, 250 bp, Homo sapiens
cccttgtttagtatagtttagctttgtctttcgtttattcgctataggttaatcactgctgtttccctgtgcggggtgtggctaggcttagtcgttttgagctgctttgctgcgtgcttgatgcttgttccttttgatcgtggtgatttagagggtgagctcacgtgtaatgtggatgcttgcatgtttaatctttctaagatctaatagaatggctatgagctaagctatagcccaccgtggactagtt

SEQ ID NO: 523323 - DNA, 314 bp, Homo sapiens
ggtcacatgcttgcggatgaactgggacacctggagatcggtgcagttgatcagcggagtccgacctggggggctagatgccagcccttgttcttggaggacccccggatcggcggaccgctagaccagtgtgaggcggaacccgtcgccataggtgaccttgaggaagagcggagagccgcagcacttgagcttcccatgggagatgatggcaatgcggtccccaagcaggtcagactcatccatgtggtgggtggacagaaggatctgtgcgggctggcttgtacttcaggatgaaggtcccagcttgcgcc

SEQ ID NO: 523324 - DNA, 838 bp, Homo sapiens
ggctttgctctgctctcctgaatcttgaggcttgtctcggcccagtctgaagacgcaggaagttgatcaatccctgaggctgctgagagacggtggcgcgatgggacagtcgccaggatggctgagcgtgaagatgcagcgggtgtccgggcgtgctctcctggacgctgagcagagtcctgtggctctccggcctctctgagaccgggagctgcccggaagccccggatcatggacagagaaagcgcttagaggtttatgatttgattagaactatccgggacccagaaaagcccaatacctttagaagaacgtggaagttggttctcggacaagttgttgtgggaagttcaggagaactaaatgaagaagacatatctggtattatatccaggtttcacgccaacagtacctcattgctcttggcgacctcttattgggctgtggcttaagaagtaacacttcagcgatgtctacccatttaaacataagttgacaatcttacatttctgaaggaacccacttcaacagaagaagacatcaataagcagataatgacaaagagcgagtgacagattgtaatggggaaaaacccccaaattaacgtgaaattggtggaacaagtgtgtcctttgaacctgaatggatagctgtttaagagaacactggcgtgtaaagtggtgggtaaaatttggtaaaacctcattgattatgccagaaatcatgttaatacatagggattgtacctcgaagatttaagacatactacaaagaataataaaagaaaacaatgtcaagtacaccagtgacataataaaggaaattccatagaaaaaat

SEQ ID NO: 523325 - DNA, 121 bp, Homo sapiens
cgactagccgacagccggtggtggtatgcagcgggcagctgccagagacaggaggcgcaaactccccaggtcaggatgttgcttcagcccggaagtcttgcaccctggcagcaccaatcgc

SEQ ID NO: 523326 - DNA, 339 bp, Homo sapiens
aggaggagtggagtggagcagaagagtagaagaggagagctccgagatggatgatgatggactatgagctgatgcctgaagcgagtgtgtcagtgagatgctggacctggagaagcagttctctgtgagctaaatggagaatgttgttcagtggaaatgactgagtcagctgctgtgttgcgtgccttgtgaggaatgttggtgtggcttgagagcagccccgtgtaatacactggatgccccattggtatggggcttgccgctggatgccttcacgcattctgcattacaggttggcagtggaatctacaactggtgcttcttgtcttggattgtgat

SEQ ID NO: 523327 - DNA, 202 bp, Homo sapiens
gggggtttggggacccccccccccccccggggcccttggggggccgccgggggtggggggtttaaaaaccgaaacatttttttttggccccccccccccccctttggccccggggtttttccggtttttcccccctgggcgggcctttcccggggttgggggttggggggtcccccacccccctttccccctttttttgtta

SEQ ID NO: 523328 - DNA, 926 bp, Homo sapiens
gagcggggtcgtgaggtgatggcggcggccccggcccggggaggcggaggctggagtgcggaggcggacggcggctgctccggctccggctccagcgcctcgcggggctactatatcaacgacaggtcctgtcgactaggcccgcatctcctggcaggttgctaggagccgagaatccatatggcagaaggtccagagaagcttctttggcatgtgtccgagtggcattatccatggggatcttcccaggtatagatgaaagacggagagcaatgcgggtgatttgccagttggagcatttttcatgactcgacattctgactctatcagcacatcaagagaatatgtagctggctatccgatatatcacgttaccttcggagctttcctccaagaagagttcattcccatataagcgtgtactcagcgcgtccgaccacggaagaaaaggcaaacgacgacctcctgggacaaaacgggcccaggcaacggggttgacaccccatcaccgcgggttttagccatcgaaggaaggcgttacacaggtatatctcattgccattagagggatcacaagacatcccttgacgtagcttccttgaacttcgagtgggcccctttcattactgtgagaactcccaggtttgacttatactttataagtggggataggtaggaaggaaaattttaattaacagaaaagcagggttagccccactcttcaggccaggcagggctagacaaaggggcaaattgagttacccctaccacatttatgcacgggacatttcggtttgcagcccaacagtaggccgacttaatgcgcacagacgaaacatacacaaacaggtgaaatccccaaacagtgcgaaaactttaccgcacagtatcatcgaccgacagagtgagtatagttcgccacggtg

SEQ ID NO: 523329 - DNA, 188 bp, Homo sapiens
accctctctagcctggagtaactaaacgagcagatttaatctgagtgtccagctggaacagctcaagcaaggcgaaaatcagtactatctgcggttcaccacgtgttgcttcccacactttctgactctgctatgttcgcttcgcgtgtgtcatcttactgtggtcggtagaatgcactttgacttct

SEQ ID NO: 523330 - DNA, 418 bp, Homo sapiens
  misc_feature (13)..(14): n is a, c, g, or t
  misc_feature (37)..(37): n is a, c, g, or t
  misc_feature (48)..(48): n is a, c, g, or t
  misc_feature (86)..(86): n is a, c, g, or t
  misc_feature (115)..(115): n is a, c, g, or t
  misc_feature (189)..(189): n is a, c, g, or t
  misc_feature (200)..(200): n is a, c, g, or t
  misc_feature (275)..(275): n is a, c, g, or t
  misc_feature (299)..(299): n is a, c, g, or t
  misc_feature (357)..(357): n is a, c, g, or t
atgaaatagtatnntacatatgtaagctgcaaaatcntagcacatgtngtaactatcacattttattaactgtcttgtacttttanagaaagattatgatcatatttctttcttnaaaagtacaaagacagttaatatgatcataatctttagttttatttaaatcaaggatcatggatttattttganatactttctantaattataattttttccttgtaagcatatgtgcctaaattctcattgagggctttctgtactgtgtaaatagcanagaaaatgtctatataggaatgtntaaaaaatattttctgttgcatgtaactgaaaagatacatctaatatgcaattaaatngaataaaatagtacttagtgaattaaaaagttaacgtatgaaagaacacagaaaaaaaaag

SEQ ID NO: 523331 - DNA, 569 bp, Homo sapiens
ggcgcacatttacaattaaaagtaagtaagaaaaaaaaagtaccatttcacacgcactaggatagctatttttctttctttctttctttcttttttttattggaggtgcagtctcactctgtcgccaggctggagtgcagtgccataatcctggctcactgcaacctctgcctcccaggttcaagtgactctcctgcctcagcctcccaagcagccggaactacaggcgcgctccagcacacccgagttaatttccgtattttaacaagaaaatgtttaccacgttggccagaatggcctcgatttcttgacctcgtgatctgcccgcctcggcctcccaaagtgctgggataacaggcatgagctaccgtgcccggcctaggattgctgttttcctaaaaaaggaggtcaggcgtggtggtgctcacacctgtaatcccaatgctttggaaggccaaggtgaaagaatcaattgaggccaggagttcaagaccaggctgggcaacatagcaagattccagctctacatacatacatacatacatacatacatacttacatacatacat

SEQ ID NO: 523332 - DNA, 545 bp, Homo sapiens
ggtcacgaactcctgatcttgtatctgctggccttggctcccaaagtgctggaattacaaggcacctgcccccataaccggactaatatttgtattttcagtggagatggagttttgctatgttggccagcctggatctcaaactcctcacctcaagcgatctgcccaacctcccaaagtgctaggattacaggcatgagccactgcgcccagcaaggatgtcctctattttagacaaacatctagctaagtgcactataccttctattaaatcaatattttagatatagaatacatttcataccaacgtccagcacatattttttgtcaagtcaaggttccaaagatatgattcaaaacacattctgctgcctatgtcatctccaaataaatcctaccagccagtatttctagaatcgtacctttaacaagttactataagaaactctagtccaaatatacatttatttcctgagcaaaaaggcacatcagctagatcttcagctgtcagacaacatacagcttcaaaagtacttgcttcggtc

SEQ ID NO: 523333 - DNA, 433 bp, Homo sapiens
  misc_feature (43)..(43): n is a, c, g, or t
  misc_feature (159)..(159): n is a, c, g, or t
  misc_feature (369)..(369): n is a, c, g, or t
ggcacgagtcactctgttgcccaggctggagtgcagtggtgtnacctcggctcactgcagcctccacctcctgggttcaagcaattctcctgcctcagcccccgagtagcctgggactacaggcgtgcactgtcactcctagctaatttgtgtattttnagtagagatggggtttcaccatgttggcccggctggtctcgaactcctgacctcaggtgatccgccaaccttggcctcccaaagtgctgaaattacaggcatgagccactgagcccggcgagaattttgggatttttgtccataagcagcagataggtgcttgagatctttggaactaaagaatgtccacaattaggaacttggacatgnttttttttttttttttttttgggacggagttgttggctctgggagtggcaatgggcgggaatct

SEQ ID NO: 523334 - DNA, 747 bp, Homo sapiens
tttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggggttcaagcctgaacccaaaggtaagccagaagaaacgtccttttttcccccaattggaggtggctaaattagaatttaaggaattaaaataactccaccaatggtttaaggtggttattgcctttttaaaaaggccccaaaacaaacaaaatgggaaaccattacattgttccaactccctgtggaagggctggaagtcttgggggtccagggagggagggtttaaaaaggtttaccgggcattcttcctttcaaggctttgcttggtaacttggcacaacaccaggatggggttttaaagagtgggctgaaccccccacacgccatttacatcagtttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatc

SEQ ID NO: 523335 - DNA, 872 bp, Homo sapiens
tggagttccacattaacgggaactttattggcttaaaacctaaacttggtcagttggaaaagaaatccacggttgaccggtagacggatctggtggattaaatcctagggttttttttttttggggatcctgggaaaaattttttccaaaaaagcgggatccttttatctttttggaaggagggcaaattagtaaacttctcacgaagttttggtgggcagcccgcgggcttttttttcttttttttatatagccctcccataaagaagtgtggtacgtcgggaattaaaggggactcagcggggcctcgcgagttctcttgagaaaaaattaaccgagggtggatgtgaccattaaaaaaaaaggccaaatacccttccaatattaggggtgcggggataccccctgatgggccccccccctcccataagaggggttaatacacagtgtggaggtttccttcttaacggtcaagcgggttcacagaaattccattttatatatctcctcctatagcgcgtggccctcaagcgcgggggggagaggtttaacacggcctcagtgaattttttttacaaacacgtgtgggaatcatgtgggtgcctcctattagacacaaatattaccctcattattcagagatagtgcacattggtgtatttctcaaaaatagccgcgggtgacaccacagcgagggaccaaatccttttgggggaacctacaaactccttgctccatggcttctcgggggatcacacttttccacccttggggcattttcttaacagcaaaagcgccgagtttcccactgggtgtcccctcccatatttcctttgggcttcaaccggcggtggaacccccttcctttaaaa

SEQ ID NO: 523336 - DNA, 774 bp, Homo sapiens
aaaaccccttctctgtaaaaaatagaaaaattggccgggcatggtggtgcttgcctgtagacccagctacttggtgggaggtgggaagattgttcgagccaggaacttgaggctggagtgcagtggtgtgatctcagctcactgcaaccctgactcctgggcatcgaatgatcctcccacctcaggcacccaatgtagctgggattgccgggtgacagcaccaccaatgccccggctaatttctagtgttttcacgatagagatggcgagttcagacaaagattggccaaggaatggtctcgcggctcctgcgactcaccctgatccacctgcctcagacctcctaaggtgctggcataacacggctagacccaatgtgccaaggacatagcggagatactaccgaagaaacactatacagaccctcgatggagggacacacacacaaatagaagggcaaaggcacatactaacacatcacagacggccaccgcccaccacgcaccagcacagaaccaccgcatgaccccacaacacacgaagcagacccaaacaccaccaagacaagcacccgaacaggcagacaaagcaccaccagcacaaaaacaaagcgagcaaaggcaaaagacacgacacacacaccaaaacaacaaccagcaaagacacaacacaacacacacacgcaagccaagcacaaaaccaacacacgaacacgaagcacaaaccaggaaaaccaaaccaaacaaaagaaacacaaaaaaaaggaacacaacc

SEQ ID NO: 523337 - DNA, 403 bp, Homo sapiens
atatgactgatgtccttgttagttgggacacagacccaacaggtagaagatggacacctacaagccaaggagagaggcctcagaagaaaccaaccctaggactcaaaggaagaacaacagacacactggggcctacttgagggtggagggtaggaagagggagaggatcggaaaaaataactattgagtaactaggcttagtacatgggtgatgaaataatgtgtgcaacaaacccccgtgataggagtttacctatgtagcaaacctgcacgcatacccctaaatctaaaataaaatttttaaaaaaaaaattaaaagaaaccaaccctgtcaacaccttgatcttggacttgcagcctcaagaactgtaagaaaatacatttttgttgtttaagccaaaaa

SEQ ID NO: 523338 - DNA, 208 bp, Homo sapiens
ctcatcagctcggtaccgctctcgtgagactgcggtgacacgggggatcttaaccactgggccaccaggtcaactctataaattactttctgtcacagaaacatatgcaacttttaaaagactttctggttgtatttcagaaatcagggacgtcattgtagtgtcagttacactgaggtagcaaattatcctttaacgggtcctttag

SEQ ID NO: 523339 - DNA, 721 bp, Homo sapiens
acagcagtgtgccaacccggaagaaggcgtgcggcaggtcgttgaggcaaggccgatgcttttatccatgatgcgccctacaacctgatcgcgatgagtcggccacagaacagtacatgttggcacttgagcaacccttcacctttgagcccttggcgttcggcctgaaaaaaggcgattacgacagcctcaattggatcaaccattttctcaaccagatcgcccaggacggcacctacggtcgccttatgacaagtggtacaggatacggcctggatagccgagatcgactgatcgtcataactgcttacacatcaatccctgatcgagaggccgcgctgaagcgtctgcgcctgtgtttggccgggtcgctgtcagggttttccgacacacgccgataacatttaccggtgaaacctttgtggcggacaacgagtgggttaggatcgcaccccgaaatggcgcagccctcttgtgcgccaaccttataagaatcgttcaggggtcttgatgatgaaaaagtatctttcgatgctgatgctcggcgtcaccgcgctggtcgctgccactgcggcccaggacggcgccattgatgaggcggtcaagcgcggcacgttgaaagtatggcatggaccccaccctacatgccgatcgaaatgaccgacacgcgcgttgaaatcatcggtttcgaagtcgacatcctcaaggctatggccaagtc

SEQ ID NO: 523340 - DNA, 209 bp, Homo sapiens
aatcacactgcagcattatttatctaggtaatctatcctgccctttggttttttacgatacagagggcttgcgttagtgttgacccgaggctggtttcaaggccatagctttaagagatcctctcacgcacagaatttccaaatgtgctggagcttgcagagtgtgacttcatggtcaccctagactttggctgccgtttgcttacagt

SEQ ID NO: 523341 - DNA, 231 bp, Homo sapiens
agctatctggtacttaagatccactacagcagctatcagagtaggattaggaggtgcatcaccacaggagctaggaagtgacagctgttcacaccaggaaggtgtcctcagcagcagcagacatctcagctctcctctgtgccaggccttgactaactctcatctgcatctgagctaagcaggaagcagttaaagaaggccccaaacatgaagcagggacaaggagacgga

SEQ ID NO: 523342 - DNA, 213 bp, Homo sapiens
ctctctctctctctctctctctctgtctctctctctctctctctctctctctctctctctcacatagccttctctctctcaaactctatcacgacgtggcgcattctcactcacgctttacgaaacgcggacgggaaagggggggcaacgaacccaatacgccctctgggagaagagaacaatgcacaggcggaccggtcacaccgaggagag

SEQ ID NO: 523343 - DNA, 371 bp, Homo sapiens
aaaaagaaagcaacgagtatccccagttagctatgtagtaattttatttgatgacagcaccatcttctctttgcctgcgcctgggcctgggggtgtgttgcttacgtgatgcccacgtgccacagagttattgcccgaagtgccagtgggctgtgcaggggatgggctcttccttccagatggtctgcagcctctgggaccacgcagccaccatcccctttctttcttcttcggatgcaatttcaggagcaaagctgatctgaggggcaaggactttaaatccacagaagtgtaatgtgccatgctggagtggccacaggaagtatcgagaatctccattaacttctgtcttcgcgtacatctcggccgtg

SEQ ID NO: 523344 - DNA, 332 bp, Homo sapiens
tagatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggtcctacaggtatg

SEQ ID NO: 523345 - DNA, 107 bp, Homo sapiens
cagcactctgctttattgtccagcattccacatagatagacgcaggacagcaggcagggtggtgggctaagaggcagcctgcgggccttgatgctgctgggcaaacc

SEQ ID NO: 523346 - DNA, 306 bp, Homo sapiens
cttcctccccttccgcagtctcctgggtgcctcatccttttcctgtctccatagttttgccttttccagaatgtcatagagttggaatcacatagcacgcagcctgttcagactggcctctttcactcagtgctacacacttaagtttcctccacatctcttcatggtcgatagctcacttctctttcgtgctgagcactattccactgtctggaggcacgcagttgatttatcccttcatctgctcaaggacgtctggtggttgccacattttgacagttttgaatggagatgctataagtatcc

SEQ ID NO: 523347 - DNA, 323 bp, Homo sapiens
ggacgggagatgtctggagcaaagataacagcagcatctcgaccagcctcggcctaaaaggaaatctttatcaatcaggtagggtccacagataattctttaaaaaaaaaaccccaccctccaagagaagcacaacggtcaagagtctggtacacacaacttcagcttggcatcacgagtctggtatcccaagaaaaatcaggggggtacaatgggtgggtcaacactatgatactttcaaaataaactcttttttaatttttttttttttttttttttttttttttttttttttttttttttaattattttttttttttttt

SEQ ID NO: 523348 - DNA, 167 bp, Homo sapiens
gtcctgactctataggtagaacataagtagtaatctaatacattttgaggccaggtggtagagtggaaagactgggagctgtcaggaaaccaaggcttgagatctccactactgttatgtaccagctgagggcaaatcagaggaaccattcccaacatcctttaaaa

SEQ ID NO: 523349 - DNA, 281 bp, Homo sapiens
gacaccattgaaagttgtgttacatcaccacttcctagggaccagccgcctgcctagctaacacagcatgcgtgacattctatccaccttagtgcatttaagatatagcacagggacacggaattgtgtacgggtactcatcacaaacacactatcattcccttctctatcctctgtgtaaaaaccagcgtctgggccactgttaccagaggtgagtttatacatttacaaaatgcttaaaatcttcgggaagcaagaggaatcttaacagaagggcccat

SEQ ID NO: 523350 - DNA, 623 bp, Homo sapiens
  misc_feature (9)..(9): n is a, c, g, or t
  misc_feature (61)..(62): n is a, c, g, or t
  misc_feature (127)..(127): n is a, c, g, or t
  misc_feature (137)..(137): n is a, c, g, or t
agcggagtngctgacagccgcggcgccgcgagcttctcctctcctcacgaccagagagcanncattatggcgaaccttggctgctggatgctggttctctttgtggccacatggagtgacctgggcncatctgacangaagcgcccgaagcctggaggatggaacactggcggcgcagacgatacccggggcacggcagccctggaggcaaccgatacccaccatcagggcggtggtggctggcgggcagtcatcatggatggtggcctgcgggcacgcctcatgcgctggtgcgctgcgggcagccccatggctggtgcgcatggggacagcctcatggtggatggcctggggctcacacgagcgctggcaacccacgagatcagatgcaacaagacccgagctaagaccaaaaaaccaacaatgacagcacatgcgctagaacgacctgacacacaagccaagaggacacgaaagagagcgggcaggaccacagcgcaggtaccgctagcctcgggacaagtgcccactgaaccacaagcacaaacaaaacataacaggcagatgactcactcacggaccgacatactatcgagagaaaacaatgcaccgacaacccaaac

SEQ ID NO: 523351 - DNA, 513 bp, Homo sapiens
tgaggttgttgttggggaccattttgaaggttccccggttccgccaatttttggccaaacccttattaattccggttagggttggggttggaggatttccctttgaggatttttttcttgttttagttgccttggttacccccaaaaggttgttgttggttttttgcttttttccggggattcccccccaccccttttccttttttccccttttttgagaatttgtccaggccgcccgccattcttctttttgtatttaattggagttatttttttttttgaacccccttttcccaccttgaccttcttgaacccacttagttttttttgaattccattttttccattaatccgttttacccctttaagttttgagggccgccaccttgaaagggcctttccattttgttggggaaggggaggggtttgcctttttaatttattttttttcttcttttttaccaggaaggtttttttttttccttttttaattttggttcctttcttttttta

SEQ ID NO: 523352 - DNA, 153 bp, Homo sapiens
ctcgctgggggcgaacgggcaatgtggaaggcagagaagggagagagacatcaccatctatatttgatcccttttgggttttgtaacagcagaatacactgtgtctgatgacaaaattgaaaatcagaatcatgccggaagccgtggtaagat

SEQ ID NO: 523353 - DNA, 165 bp, Homo sapiens
aaacccttcctcaggacagagtggcctttatactaaattccacaatatacctggttttagtacagcctgaatccggggctgggcagcagaagttaaaaaggttgtagtccctgcaaacagagtgttacaaggacatacacactacagatgtctccccggatacag

SEQ ID NO: 523354 - DNA, 269 bp, Homo sapiens
gtcattcaagttacaacacgttactgaggacaacagtgtagccgggtttgacaaaatttttttattgtcttcatcattgtgtgtattctgagttctttcacatagttctttttttggtgttggttacttagaataagaataatctcaaaagtatggtcagtgttcatagttggttttttttttggtaaaaaacccatttcagatttttacctcctaaatgattagaatcagattaaaatagtttggtttcgagtgaaaaatgctgtcag

SEQ ID NO: 523355 - DNA, 779 bp, Homo sapiens
cagggctgcaggtctgggtgggtctcccaggagaggaatactgagatgggagatcgggtgtctggagtgttgcctgatgcgagtctctctctcctgagccggtcctcttgatgcaacgctctaaagggagaagtcaggccctgcctctccaggtatagacggcctgctaggccccagttcttcctccttccccctttcccaggaaaggccagccccagtccatggccttcttgggcctctgggcacagagccaatgttcgtcattgcaggctctcagcaaagctgggtcatagctttccccacagctacagcctggggcctgggcagggctcccagaccatgataccggctcccatctgaccagtggggcatgattctctcaggctttctgccccgaggtcgcttcgtcgttctctcagggtctggacttggtacagtgggccttttcaccagtggagctgccttcccagggagaaggatgccgttgctgccaggtcagggtcccgtggcattagacttctcccgatcccccagagacgctggtgcacaggtctaggcaccgagcacaggtggcttgggaaattctgcagctgaatgatgtttcaaatacaagcacaaagatagtgtcgaaagagaaaacaagaagacaaggagagctcacttaatgggcaacttggacccccaaataggacagtggacctacctatgaagtcagggaaggtgggggggtgaagaaagaaagtgacacgcccggggggcctggctgtcccggtggcccg

SEQ ID NO: 523356 - DNA, 92 bp, Homo sapiens
  misc_feature (36)..(36): n is a, c, g, or t
  misc_feature (40)..(40): n is a, c, g, or t
atgtcatcttgagcgtcttcatttattttgactgtnattnatcttggagtggaggcattgtttttagaaaaacatgtcatgtaggttgtcta

SEQ ID NO: 523357 - DNA, 307 bp, Homo sapiens
  misc_feature (48)..(48): n is a, c, g, or t
  misc_feature (53)..(53): n is a, c, g, or t
  misc_feature (66)..(67): n is a, c, g, or t
  misc_feature (82)..(82): n is a, c, g, or t
  misc_feature (87)..(87): n is a, c, g, or t
  misc_feature (92)..(92): n is a, c, g, or t
  misc_feature (106)..(106): n is a, c, g, or t
  misc_feature (126)..(126): n is a, c, g, or t
  misc_feature (131)..(131): n is a, c, g, or t
  misc_feature (145)..(145): n is a, c, g, or t
  misc_feature (160)..(160): n is a, c, g, or t
  misc_feature (183)..(183): n is a, c, g, or t
  misc_feature (199)..(199): n is a, c, g, or t
  misc_feature (243)..(243): n is a, c, g, or t
  misc_feature (248)..(248): n is a, c, g, or t
ccccggaactgcttcggatgatgatgatgggcactaggacacacaganctgcncggctgatgatgnngggcactaggacacncaganctgcncggctgatgatgangggcactaggacactcaganctgcncggctgatgatgangggcactaggacacncagagctgctcggctgacgatgntgggcactaggacacncagagctgctcggctgacgatgatgggcactaggacacacaganctgcncggctgacgatgatgggcactaggacactcagagctgctcgcatccgaagcagttgccg

SEQ ID NO: 523358 - DNA, 124 bp, Homo sapiens
ttcgactggctcgtcggctggtcgtcgacttctttctctggtgtgtgatgctcaccctcacggcggtttgatcttggtccactttctggctgttttcttcgttcttttttcacagtaacacaac

SEQ ID NO: 523359 - DNA, 118 bp, Homo sapiens
tcgatctacaggatctcgtatcctgagctgaacgggaagctcactggcatggccttccgtgtcccactgccaacgtgttagtggtggacctgacctgccgtctagtacaacctgccgg

SEQ ID NO: 523360 - DNA, 150 bp, Homo sapiens
agcctgactaactacaatggcacggtggacagtagagcagaatccattgacaagaagatttttcgattggtgaatgagctagtgaagtataaggttcatatcaagagatgagagaggccccgcaaagaatatggccaagcagaaagcctg

SEQ ID NO: 523361 - DNA, 571 bp, Homo sapiens
tagctcggtaccctatcaggctttggagctgggtgtgtatcaagctgctgaaaggttgggagcttggtttggagggtccactaggtgaggtagatgctgggcgtgaagaatctgctgtgaggcagatgttgggactgtagaggccgacgggaggcagaggctgggcctggaggggccaccaagatgcaggagctgggcctggagaggctgcaaagaaacatgagctgggcctggtgaggtcgacttgagaaagttcagggcctggagagaaggctgggaggcaggagctgggtctaaagaggccattgtaacgatggagctgtgcctgtggaggctgttgtggggcagtaggctcatctgcggagactgccgtgacgtagggtatgggcctaaataggccattgtgagtcatgagcttggtctgtagaggctgattggagaaagttctgggcctggagaggctgccgggaggtaggagcataatgtagaatcagtgggcgtcttaagcttgttttcctgcaactggatggtcccacctgtagtctcagccacgtgggaggttgagatggga

SEQ ID NO: 523362 - DNA, 709 bp, Homo sapiens
  misc_feature (336)..(336): n is a, c, g, or t
gccaatcttggtaagaccatccaagtcattccctggttcatcgtgtatccataatgaaaaggtgtataaccatcatcaagcttcatggtcatatcccaaagtgagttgacaagatcgatcatcaagcaaggcagtacagtaacatacaaactaacccaactcaatcaaacgcacagttggtagattgtcatattctgcaccagactctaaacaatccgctcagatcacatttcatctggtcgcatggactcaatttatcaattcatctgatcatgcacagtttagcatagatgcgaaacgtagcaaactgatgatacatacatgtgatttcactanaagcaggcttcttccagtgatacccatctcgaccctcttcagcatcctaaaagtaacttgtgatggcgcacaagaatctcgtcgcatgaatgcacagaaaggataggttagggtaatggaaatgatcacatatggacagtgactggttaccatggcaacacttcacgcatatatgatatagatatatataatatataatgtagatatatatctagacatatatgttcacatgtatatcacgcatccactcacacatactcgcacgcgctttggatcagcgtcatttccaggttcagcaaatagaggatcataatttctgtggcgtagcgtttatgcaggtactcgctggaggtctaagatccttataatgctg

SEQ ID NO: 523363 - DNA, 208 bp, Homo sapiens
tactttcctctctttattagtccttgaaagtggaatctgggtgacgttttaaaaagcagaagaaaaaggaaccgcgtgattgtcctggtggccgaacagaggtttcacagaagaccctcaatcctcctcttcccagaaagggagcaaaaaataagggtagagttggggccagcgcttacccagcttcctttctcccactttactaagt

SEQ ID NO: 523364 - DNA, 291 bp, Homo sapiens
  misc_feature (24)..(24): n is a, c, g, or t
gcagtgatcgagctctgtaccatncattgcggtgagcatcatacctaaaaaaaaaaaaaaaaaaaagaaaaaaagaaagggcttttagtgatttttttttagggtagcaagtgtaattttaataaattggctttatttgattctaataaatcccctcaaagctgaattcgaatcctgattttgatggaaaattttttttacttaagggaagagggatagattaattgacacgattagggaaaagacttctggtataaggccggggtttttcaaatgatttttggaatagta

SEQ ID NO: 523365 - DNA, 373 bp, Homo sapiens
ggccaaggtgggcacatcacgaggtcaggagatcgagactatactggctaacatggtgaaaccccgtctgtacttttttttaaaaaaaattagctgggcatggtggcgggcacctgtagtcccagctactggggaggctgaggcaggagaatggcgtgaacccgggaggtggagcttgcagtgagctgagattgtgccactacactccagcctgggcgagagagtaagactccgtctctcaaaaaaaaaaaaagaggttatttaggtctgggcctggtggctcaccacacctgtaatcacagcattttgggaggccggggtgggcagatcacttgaggtcagaggttcaggcattcagcctgtgcaacatggt

SEQ ID NO: 523366 - DNA, 171 bp, Homo sapiens
ctctagagtccccttgctttgggccggcggattgttgctgctgttcacaagttggtgttgtgcgcgttgcactgggcgcaggccaggttttggttgacatctgcagctgggctgtggacctccgcttgaggtgtgtgcggtgaggactgctagtgcctctacggttttggg

SEQ ID NO: 523367 - DNA, 781 bp, Homo sapiens
ctccaggatgacaaagaaaagagggaacaatggtcgtgccaataaagggccgcggccacgtgcggacctatgtcgctgcaactaacgtgtgcccgattgcgtgcccccaagggacaaggccattacagaaattgcgtcatgtcgaaacatacgtggtaggccagtagcgagctcaggtgacatttctcgaaagcgagacgtctgtcgatgcctatgtgcttcccaagctgtcatgtgaagctacattactgtgtggagtcgtgcatagttcagcaggcatccatgtagtcgggtaactcagactctcgtgaagggccccgcaatgggaccgaacttgccccatgccgtgattttaggacctcttgcggaggtgctttgccccaggtcacgccactagaagctcgcagtgtcacggagggtagaggttcggttagaagactgaacgacggggcttgattgctctggatgaaagaaatctaagatctgagagatttggtaccgagaatgtaaaaactcctgtcgaaaaattgcacccactgatttgctttggcgggtgagggccgccttcccgtggggccatttggtgcagcctttcggcgttgtccgcggacctgtgtcctgtcaatgggattgttaccgtcgtgtggccaacgggtgtgtcgctggaacaagcactccggtgacccaaccaggtggtagggagtctgtgcctcaattgaatcagggtgcgtgggtgcctgcacgcagtgtgggcccattatgcgcgggttttcccgggcat

SEQ ID NO: 523368 - DNA, 150 bp, Homo sapiens
ggcggacattcagactgagcgtgcctaccaaaagcagccgaccatctttcaaaacaagaagagggtccttcttggagaaacttgcaaggagaagcttccgcggtactacaagaacattcggttcttgggcttcaaggcaacccagggggg

SEQ ID NO: 523369 - DNA, 156 bp, Homo sapiens
ctgaggtacctagagatcccctgctccgccctttctggtggcaatagctatgggtctttcctgattttatggaattttaggggatattttgagctttgggttctcagtagtgaattgagacttgtagcgtgactattatcatgtttggagtatggt

SEQ ID NO: 523370 - DNA, 202 bp, Homo sapiens
aggtatatgtctctagaatttgttgcgagtagatagcctacattatggcccttaagctcaaaatacttaattgtatataatccaagaatagagcttattttcacttaatcaacgtatacttcttatctgcttgacagtctatattccaatttgccagttgacctaacattgtcctttggagcgcaaatgttacctctggtaa

SEQ ID NO: 523371 - DNA, 153 bp, Homo sapiens
tcttaccttggaaaaccccttgccgtggtgattgcacgtactcccctgccctcaatcaacgatgttttgcctatactggacaagagcgtgccctgatgcagcgtgtgggtaagattccacaacccccgacccggcacccgctgcttcgcgcct

SEQ ID NO: 523372 - DNA, 1356 bp, Homo sapiens
  misc_feature (490)..(490): n is a, c, g, or t
  misc_feature (601)..(601): n is a, c, g, or t
  misc_feature (709)..(709): n is a, c, g, or t
  misc_feature (765)..(765): n is a, c, g, or t
  misc_feature (1339)..(1339): n is a, c, g, or t
tgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccanaaataacatgctttgcgtggaatggactactccaagggaatctgtaaagaaatatatacttgagtggtgtgtgtatcagataaagcacccttgatcacagacttgcaacangaagatggtaccgtgcatcgcacctatttaagaggtatacctggctagaaacatctaaatggaaatctttttctaactctttagggagctttttctttggcttatagnggttcggcccgttgaacgacttccaattatcaatagctcacttacttactagaagngggacctttaagcaggcatccttaacccttttggaataccggctctttattaaccagagtggggtaaaactcttttcttttttggaccccaatagtgattaatcgccaggggaaaactctctaacctattgggtttggcgaacttaagagtccactctctgcgcggcgaaacttaggcgtctgggccctaatcttactgtggtgtctcttaacctctcggaacttccgggttacacacctccaattgggcgcctcctgtacccctatcctcttccttacacatccaggtacacatgcgacactccactcccacctcccaccgcgcgttagcgcctctcacgcgtttaagtgtcacccctttgcataacaattacacaacacaacctgtgcaccctgcccaccatcttatcatcgccacttctccggccccatactcattcaccctctctactggcgcgtcacaactctggcctttcaccgcgcgctaccggtgcccaccatctctcgcagctcaccaccctgccccacgtttcatccacgcctccgccgctctcacctctcctcacggctcatnctccttttctccgtcct

SEQ ID NO: 523373 - DNA, 203 bp, Homo sapiens
gcaagttctcccaggagaaagccattttcagttcgagcgccaagatcgtgagcccaatgggagagccggacgagttcgagtccgcaatctcccaggctctcctggagctggagatgaactcggacctcaaggctaagctcaggagctgaatataccgccacctaaggaaattaagtggtagtgtcggaaagctatcataatct

SEQ ID NO: 523374 - DNA, 144 bp, Homo sapiens
cctgtattagattgccacacggctcacatctgcgatgcaagtccagcagtacttggccatatgactacttatagaatcgctggtaggcatccggactagaaggaacccacttagacaagaatcttgacgaaagggagggctggc

SEQ ID NO: 523375 - DNA, 684 bp, Homo sapiens
ggcggagcgcggtggcagatggcagtgcaaatatccaagaagaggaagtctgtcgctgactggcatcttcaaagctgaactgagatgagctttcttactcgcggagctggctgaacgatggctactctggagtccgaggtgcgagttacaccaaccgaggacagaaatcattatcttagccgaccagaactacaggaatgttctgtgctgagaagggctcggcgcgattccgggaaactgacttgcatgtatgttcatgacacgtagggttggtggcatttctcagcaggcgcacgcttgtacgaagctattagtgctcgaaagagtgtgtgcgcatctacgtaggctcgtggtggtgctccatttgcaccgaggtcgaagcgtttctcgtagacgattaactaaacatgccgtagagaaggcgactatgcctgtgccggagcggccgtgactaatgggtgctgcgtggcgtggttgcatgcatgtgcaggagtaggtgagccatagaggcctgctgaaggtactgtggctgtcatggtgacatacctaccgaaggatcgagagggctacaattccgatgaaggtcttgtggacctggcctgagtgactccaatacgtgcgagcactcctgcttaacgtactatcggttgacacatgattgtgcgccacgctgtagtctcagaa

SEQ ID NO: 523376 - DNA, 721 bp, Homo sapiens
aagaaaccaaacaattaaggcataagtaacgaggctggtgttttgatctggcagtaggcagcgctggaagcctagcagtatctgagctctcacagtgccggaactcacccagcaggtcttcgatgccaatgaacatgatggctgcctgtgacccccgccacgggcgatacctcacctgtggctgctgtcttacctgtggtctggatgtccatgaagtgaggtcgatgagcagatgctataactgtgcagaacaagaacagcagctactattgtggaatggatccccaacaatgtcaagacagccgtctgtgacatccacacctcgtggcctcaagatggcagtacaccttcattggcaatatgcacagccatccagtgatctacttcaagcagcatctcgtgagcagttcactgccatgttcctgcctggaatggccattcctccactggtacacagtgcgagggcatggacgtacatggagttcaccgaggctgacgagcaaacatgaacgacctcgatctctgagctatcagccagtaccatggatgccaccgccagacgagtgaggcaggactctacgcgtgagcgaggccgaacgacggagtgctaagagccagtagccaccaataacctcaggtcttctcaaataccctaccacgatcttactcacatgccccttatctctcctcagaaaatgagtagctgcttcatctggtaaag

SEQ ID NO: 523377 - DNA, 144 bp, Homo sapiens
ggaaccaaccacacagcagggtgtgctcaaggccacggattgagccgtgaccctggcgcccagaggggacccagacgatgatggtcacaggctgagccctggtggcagtgtgatcagtgagatccggtaaaaggccttccagca

SEQ ID NO: 523378 - DNA, 616 bp, Homo sapiens
gtcattcattcattttcattcgtccaggatagtgctcctttgtcctccaggccaattaggtatcccaggttgtgggattctgtggcataggatctcgtgctctggtaggtgccgaatggggcaacacagcagtatccgtgctcatagcatgctgggtcgcccatgctcttcactcggcacttgctgtgctaggaattgtcatgtctgaaacggatccactccgttataccgccgcacaggtgccagtctttcagacaggcccagcaagaatttcgctgctggatgtacttctccaaccctgcaggtcgcgaacacgcagactgccaatgcagccgctggggctgctgaaaatgccttccgggccccgtgacccctgactgggatgccctggacctgctacttcgagggagcgtgatcttagctaccagtccgtgaaggtgctccttgggagcttggagagatatcactaagctgatggctctctccgtagtgctcccaatcctatggccatgatctgctgaacctgaccaggcgtgtggggagttcactgtgacgtagtccccccatcaggccacactgctgccacctctaataaccccacggagcttccctctgc

SEQ ID NO: 523379 - DNA, 908 bp, Homo sapiens
  misc_feature (38)..(38): n is a, c, g, or t
gaaggaagcactaaatatggaaagaaaagatcatcacnctgctactacaaaaacacactgaagtacacagtccaatgatgctaaaaagcaagcacatatgtaagtctgcaaaataaccagctgacagcatgacgacaggataaaatccacacataccattactaaccttaaatgtaaatgggctaaatgctcccattgaaagacacggggcaagctgggtaaagaaccaagaaccactggagtatgccgtcttcaagcaacccatctcacgtgcagtgccatacataggctcaaaataaaggaatggagaacacatatttcaagcaacatggaaaacagacaaaaggtgtagcacatcccagatatactgacaacaacagactctaccaataacagataccacaaagagacaggacatgaacaaagagtggtcctgaccttatgactaaatctcatcatcgctagataccaacctgggctatcggaatggcccaaacaataggataattagctgaggttgaaggacgcttctacaccttcacagaatccctgatctacgaaaataggatgagatgtaaggtagactaggcagtacaatccttcacagacagtaaactcactaccaaaacagaaggcaaatcaccggaaccatagaccaaggacaccagaacgcaaaactgagaccacagctacaacaggaaagtcatgaagaaaccacacaaaaaggcacaaagacaccagcgaccaatccagaacgacgaatacaaagagaaatacataagcacaaagatccacaagcgaaccccacaaagaaatacaatcaagaagaaaaaaacaaaaaaaggaaagaacaccaacaagacacacacaaagagacagcagcgacacaaaaaaaccacagccaaaca

SEQ ID NO: 523380 - DNA, 1602 bp, Homo sapiens
  misc_feature (1)..(1): n is a, c, g, or t
  misc_feature (173)..(173): n is a, c, g, or t
ntgggcgagcggttcgtgcgggtctcttgttgtcttcgttgtgctctatttctcctttcgtaccttcctgtcgtgttcggtgctgctgttcttgtctttgccttcttgtctgtgttcttgcgtatgtgttcgctttgtcttgttgtgtccttccgtctccgtctttgttttcnttcggttgatcttctgtctcctcctcctgtgttctctccgcttcttgttcgttcgttgcgttcctcctcgtactgttcgctgcttcgggcgccccttgttgtgtctctctctcgttcttcgtcacctttctcggttccctcttgctctgtctctgtccgtctctggtgtggcggtgcgtttccttggctgtgggtggtggttgttgtgttgtgtgcgtttgctttgtctcctgggtgtttgtgcgttgtgtgtgagttgcgccgtttggcgctagtgtgcctttgtgtttttctcgatgtctgcggtgtgttcagtgtctatcgcttcttttgtctgtggtttggtgtgttgttgtttcttgttgcggcgctggtgggtgactgctgtgcgcccgtcgttatgggctgtgtcgtgtacgtcgtcgtgttcttgtggtgcatgcgtgcttgggtggactcggcctctatctctgtcctgggggccgtgtgtctgtggccctggttgtctcccgtttcttctgtcgtctttgtgcggttggtgcgcctgtggtctgggttggttgtgtttgatttttttgcctggtgtacgcgcgtgtggtttgtgtgtcgggtgctgggtggcggtggggtgttcgtgctttcttgctggtgttgcgtcgctgtcggtggcctcggctgttggtgcccctcgcctcgcggaagtctccccaagagacttgtgcttgtgtcgttcctctcttaatttgggcgcccccccgggacacataatgtcctggagaacctccctcggggggaaaaaaaaccactgtctctgtgtgttagacacctctccacagagaaaaagtgcataagagatataatcgtgtaatggcgccacgctaattgttctaagcacgagaaaaaattttgtgttgtttttaaaagagggaaggctttgggccacgcagccccttctggccactgtgggccgcggctggaggaaagctggttttttattctttataattgtaaaaattgttgctttctgctcttgtggtttgtctggaattcttttctttataatggcttcgctcgccttctttggactatagcccgggaagaagagggcgaggaagcgccgggtgcctctccgggcccctgttatggctgtggcccaggccgccctgggggaatctctgccccgttttctcggaaggcccctcacaggggcccactccagtgtggagattcccagccggctccaccacccccttcccctgaggcacactcggaggtggaaaggcgcgcccgaactcgcttgtaaagttttgtttgctgtatgcttggttttcgcttgaggttcttttttcacatttgctatcgaaactgtagagaaaaagagaaaaaatacccacccaaataaatctgttcagatcccagtcccccccca

SEQ ID NO: 523381 - DNA, 406 bp, Homo sapiens
  misc_feature (30)..(30): n is a, c, g, or t
  misc_feature (70)..(70): n is a, c, g, or t
  misc_feature (74)..(74): n is a, c, g, or t
  misc_feature (88)..(88): n is a, c, g, or t
  misc_feature (94)..(94): n is a, c, g, or t
  misc_feature (107)..(108): n is a, c, g, or t
  misc_feature (185)..(185): n is a, c, g, or t
  misc_feature (195)..(195): n is a, c, g, or t
  misc_feature (197)..(197): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (240)..(241): n is a, c, g, or t
  misc_feature (243)..(243): n is a, c, g, or t
  misc_feature (257)..(257): n is a, c, g, or t
  misc_feature (270)..(270): n is a, c, g, or t
  misc_feature (309)..(309): n is a, c, g, or t
  misc_feature (354)..(354): n is a, c, g, or t
  misc_feature (384)..(384): n is a, c, g, or t
ggagtcaaaagcgttcatacatctggggtngggggaaaaaaagggggaagggggggcacgaaggctcatntttnaaaataaaacattnttaaanagttttttggcgnngtttttaaaaattttgcatttcatatttttcacgaaagcaatgctatcacctcccctgtgtggacttgggtgaggantgggccattntnctttntntnaagtggggtggcttttaggttggcaagggtcttnntnttacaacgcatctnttttttggaatgnctattaaaaaaacaacaatgtgctttctatgtcctcggncactttgtgtactttggggggtgctcgctccaaccgactgctgtnaccttcaccgttccagttttttaatcctgngtcaagccaaaaaaaaaaaaaa

SEQ ID NO: 523382 - DNA, 450 bp, Homo sapiens
  misc_feature (71)..(71): n is a, c, g, or t
  misc_feature (437)..(437): n is a, c, g, or t
gggacaggctcctccatgccgtctttccttcttttgaaaatcctatcaatggctgggcgcggtggctcacncctgtaatcccagcacttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctctcagccggtctncatggatccttga

SEQ ID NO: 523383 - DNA, 1741 bp, Homo sapiens
  misc_feature (71)..(71): n is a, c, g, or t
gggacaggctcctccatgccgtctttccttcttttgaaaatcctatcaatggctgggcgcggtggctcacncctgtaatcccagcacttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctcccggcctggcacctccagtttacagagacccccttccccctggagccagcctgacccctgggacagtgctgccgcgggggtcaggcaggtggtgagtggtcagggatgtttgtcccacttgacagatgggaactctgaggcccagagtggcacaaggacctaccagagaccctgcagctgtgactggaggcttccacctttctcctgcccagcctggggctctggacctgggagaacacatcaggatgcccggggtggcagtaggtagctcccatgccttgaggcacttggctgctccctccaccccctgacagcctcattggggcctgcactcccctcggtgcctttgaggcttcgcctagccctgtcctggtccttttaccctgaccccagtgctgagaaaatctggatccagagctggacatgtcctttctggatgctcccacccctgtctctgaggagcatgagtgacagagggaggaacttgtccgaggccagagaggatggtctgcagctggctcctggtgcacccccactgcccacggcctggcccccatttagggtgtgttctcttggaagcccgtaggaatgtgttcttgagcagccgacaagccaagggcctgggctcagcctggggcaagtgggtccctcctgggctctggccctgtggtccagcccatgtgcctctaaccatgcctggacgctctgagtctccgggccaccgtgaatgccccaccctcagcctggccccatccccttaccttccccaagtcccagaacacacctgagtccataggcccggcagcctctgcaaggaacctggttaacttatgttgttatatagcgtcgaaatgtctatagtgtctttaaattattgtgacctacactgggtaccggagagggggatggctgcggcccccatccctcatcccccatcccatcccatccctcatctcatccctcatcccatcccccatcccatccctgaccccatcccccatcccatccctcatccctattccccatacccaccccccatcccatcccccatctcccgaaccaggctcctcctgcttcaacagacccttggggcccctgatgccaccgagacactcgcactgtcccttggctgccgggcaccccactgagcccctgcccaccccaaagtctgccagcaacaggccctttgcctgggtgagacgggggtcagggtggcccagatgggggtgatggcgaccaaggtgctgcgtccccacccttctgacggcagcctcccctggaggggagtgctcggcccaataaaagctggaatcgga

SEQ ID NO: 523384 - DNA, 958 bp, Homo sapiens
ggagtacatagggacgtcatgtccgtgccgccgtgtcttttccgtgctacctgcagagggggtccatacggcgtagttctggatgcccggtcgtaacttaaagggaaagcttctcacaatgtccggagcccgttgaatgtgctgccatagtgaaggaggaggatgtccatgtaatgttccgtttgcacgcaggaacccactttaggtgtgcaccaatcttgactctccgagatggacctagtgacatctataaagaggaaacagtgatggcatctatatcataaatctcatgaggacctgggagaagctactgctggcaggtcgctgcagttgttcgccattgagaaccctgctgtggtcagtgtcatcactcctccagggaatacctggcgagagggcatgtgcttgtaacgttggttgttaggcaacctggaagcgattcaaattgctggacgcttgcaggtcctgaaacgctgtcagtacgcgcagatccaggcaagcgttccgggatccatcggttgcttatgtgggtatactgagcccaaggggctgtgcacagacctctcaggaggcctctctagtgtatgactacctagcaaatgacgcttgagatacccaccaggattctccgtcccggcgactaggtgggacaggtgccaacccgagtgcggaaaacagggagggcactcaggaagtcggagtgcgaggatgctggctcgagaagtccgagcatagtggccattccgtgacgccaggcgggtctgcctgattggacacacgagttcctgtaggttgccaagagaccgccgcgttggaagacgccaggggaaacaggggcagccgccggcggaaacagcaccccgggaaggtcagagcaggcccggtgcagaaaagaagcagcgcggggaggccccaaaaaagcggccctttctcgcgggagataccaaacacccggagg

SEQ ID NO: 523385 - DNA, 275 bp, Homo sapiens
caataaattgttggtcattgatttctgctgcagcttgggcaaagagtatgtttcctccgccatcaatcagtccaagtcaatgggctttggtatccaatcaaagtcaaagcattcaaaaccttttgattagtgaaagtgaaacgggcagcaacaatcgtccaccaaagttgaatcatatgaatgactttccatcatggaagaaccgctttcacacgtatgttcaagggcaaagcaccgatctttggacgtgtttcatcaatgaccaacaatttatt

SEQ ID NO: 523386 - DNA, 203 bp, Homo sapiens
ccggaggagtcaccagtaggcacatagtgagacactatgtccacaaatatttttaataattagccaggtgtggtgacatacacctgcggactcagctgctcgggaagttgaggtgggaggatcatttgagcctggaagggttgagactgcagtgagccatgatcataccaccacatcccagcctgggagacagaacagagacc

SEQ ID NO: 523387 - DNA, 212 bp, Homo sapiens
ttcaacaagcatagcagtcattagggcagaagcaggaatgcagcttcccaagcttaggttagtgatgtgaaatgctccgtggtcccgtggccctagctccttcgcctgtgcccgaccgcctgcataaggcagttgtgggttttcttccccaattcttttccaagtaggttttggtttagcctactccccaagaccctggcagaagcaggaag

SEQ ID NO: 523388 - DNA, 750 bp, Homo sapiens
  misc_feature (274)..(276): n is a, c, g, or t
  misc_feature (281)..(281): n is a, c, g, or t
taacctgtagttctctaattccccccatccttaccaccctcgttaaccctaacaaaaaaaacttatacccctcatttattaaaatccatttgttgcattcactctttattatcagtctcttccccacatacaatattcatgtttcctagatcaagaagtcattatctctgaactgacactgagccactaatccaaacaatccagactctccctaagcttcataactagcactacttctccattaatattcaatccctgtagcattgttcgttannnggtcntcatagaattctcactgtgatatataaactcagacccaaacattaatcagttcttcaaatatctactcattttcctaattaccatactaatcttagttaccgctaacaacctattccaactgttcatcggctgagaggcgtagaattatatcttcttgctcatcagttgatgatactgcccgacgtcagatgccattacacagtccgtccattcaagcaatcctattcgaaccgtatcggcgatatcggtttcatccgtcggcttagcatgatttatcctagactccaatctcagtgagaccacgaaaaaaatagccttcttaactgctaatctcgaagcctcatacccactatagaggcttcctactagcagatagcaggctaatctagtccatttatggtcttccacccctgatgtcgcttagcgtaagaaatggccacccccagtctttaagaaggaaaaaatagg

SEQ ID NO: 523389 - DNA, 404 bp, Homo sapiens
tttttttgctgtgttgacatctgcactggcaccattaaagtaatggtgaacaaaaatgctggtggtggcgccaaactgtatttgcaatatcgaacaaattgttaccaaattccaatatcaatttgtacatcactgagcttttcatacagttgtcaaactctgttggtttatcttgtaccatcaatgaatccattttacttccatgattttgcaccttcatgcgactgcaattcaagtctttgaacttcacactgaccatacaatgacattaagtgaaaaaagccagtttcacttaagaatgtttctgatgggccagtcacagtggctcatgcttgtaatcccagcactctgggaggctgaggcaggcagatcacttgaggtcaggagtttgagactagcctggc

SEQ ID NO: 523390 - DNA, 104 bp, Homo sapiens
gagtgagctggtaccggccctttgtgtggcactttgggtggctcgttgtgttggctcgtctggctaattgcatcctccacctcctccacgcgccacacgaagag

SEQ ID NO: 523391 - DNA, 333 bp, Homo sapiens
cgaaccaatgagcatcaagcaagatgaactcaaagacactcacatcaagacacattataatcaaacttttgaaagattaagagggaatcttgaaagcatcaagaagagtgactcttcacatacaagggatcctcactaagattatcagcaagtttctcatcaaaaatttttggaggccagaaaacagtgggccaatatatttgaaatactaaaagaaaaataatgtcaaccaagaatcctatattaagaaaaacagtatttcaaaagtgagagaaaaattaagacatcccatgtaaacagaagctgaacgagttcgctcattgggttccgatg

SEQ ID NO: 523392 - DNA, 294 bp, Homo sapiens
gccctctagggtcctgagtgcggccgtcatgttgtcgcccttttttgggcgctgagctgacggacctggaggactttatcgggccgtctcaggagcgccccaagcctgtcaaagtggaaaaaagggcggggagtggcgtcgccaagattcgcattgaagatgacgggagctacttccaaattaaccaagacggcggcacccggagcgtggagaaggccaagttctcgctaaacgactgcctggcgtgcagcggctgcatcacctccgcagagaccgttcttatcacccagcagg

SEQ ID NO: 523393 - DNA, 406 bp, Homo sapiens
ctagtcggaggttctgctgctgctgggccacgacctgatgacactgtagtcagacctggcactggttcatctgcctcaagcgcatcagccttgccgagaaccgcctgacgcaccttgcccgctggacacaggctgaccctctcgcggacttgcacctgcaagacaccagttatagccttctgctggaccccgccttgggtggccctgagaccagcctgcggcacctatatctgctggggaatccactcaggtggtggaccattggctggctgagagacctgctgcaccatgggcgcgacgacgtgaactccacccatgacctgaactgacggttcaaggtccactaggagcagcacctgagccacgtgcgttacgagcactgcaagaaggggatgctgaaccaccc

SEQ ID NO: 523394 - DNA, 337 bp, Homo sapiens
cacaagtcaaatccaaagtctcatctgagacgaggcaagcccatctcatgcctatgagcctacaaaattgaaagcaagttagtttacttctctagatatgtggggctactagtgcattgggttaaatatacctgttcaaacatggtagaaagtgggcaaatcaaaggggctacagcaggccccatgcaagtccgaaatccaatagagctgttgttacaccttacagttccaaaatgatctcctttgactccatgtctgaaatgatagcctttggacctgtaggattcatgtggcttgtacacatatttaacaacttcattgtgcctcgcattatatc

SEQ ID NO: 523395 - DNA, 243 bp, Homo sapiens
  misc_feature (19)..(19): n is a, c, g, or t
  misc_feature (85)..(85): n is a, c, g, or t
  misc_feature (213)..(213): n is a, c, g, or t
  misc_feature (239)..(239): n is a, c, g, or t
gtcgaaccgggtgatcatntgcatgccgaagtcctgcgcctcggccgaggccatgtcactgctgtgcgcgctgacatacggcgcngacatcaggatgccgaggtgcggcgtccgggtcaccgcgtcgagcgtgtagagcacaccttccgtcatcgcgtcggccggattgtggatcccgcgcacgtgctcgctgagctggtccagaaatccgtngactgaggcgatggcggctgcccgcntcag

SEQ ID NO: 523396 - DNA, 604 bp, Homo sapiens
  misc_feature (10)..(10): n is a, c, g, or t
  misc_feature (25)..(25): n is a, c, g, or t
  misc_feature (63)..(63): n is a, c, g, or t
  misc_feature (65)..(65): n is a, c, g, or t
  misc_feature (115)..(115): n is a, c, g, or t
  misc_feature (121)..(121): n is a, c, g, or t
  misc_feature (131)..(131): n is a, c, g, or t
  misc_feature (140)..(140): n is a, c, g, or t
  misc_feature (151)..(151): n is a, c, g, or t
  misc_feature (224)..(224): n is a, c, g, or t
  misc_feature (273)..(273): n is a, c, g, or t
  misc_feature (275)..(275): n is a, c, g, or t
  misc_feature (286)..(286): n is a, c, g, or t
  misc_feature (293)..(293): n is a, c, g, or t
  misc_feature (295)..(295): n is a, c, g, or t
  misc_feature (297)..(298): n is a, c, g, or t
  misc_feature (318)..(318): n is a, c, g, or t
  misc_feature (323)..(324): n is a, c, g, or t
  misc_feature (334)..(334): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (362)..(362): n is a, c, g, or t
  misc_feature (366)..(366): n is a, c, g, or t
  misc_feature (371)..(371): n is a, c, g, or t
  misc_feature (376)..(376): n is a, c, g, or t
  misc_feature (378)..(378): n is a, c, g, or t
  misc_feature (388)..(388): n is a, c, g, or t
  misc_feature (391)..(391): n is a, c, g, or t
  misc_feature (397)..(397): n is a, c, g, or t
  misc_feature (400)..(400): n is a, c, g, or t
  misc_feature (406)..(408): n is a, c, g, or t
  misc_feature (411)..(411): n is a, c, g, or t
  misc_feature (420)..(420): n is a, c, g, or t
  misc_feature (440)..(440): n is a, c, g, or t
  misc_feature (448)..(448): n is a, c, g, or t
  misc_feature (453)..(453): n is a, c, g, or t
  misc_feature (459)..(459): n is a, c, g, or t
  misc_feature (461)..(461): n is a, c, g, or t
  misc_feature (470)..(470): n is a, c, g, or t
  misc_feature (474)..(474): n is a, c, g, or t
  misc_feature (477)..(477): n is a, c, g, or t
  misc_feature (487)..(487): n is a, c, g, or t
  misc_feature (490)..(490): n is a, c, g, or t
  misc_feature (507)..(508): n is a, c, g, or t
  misc_feature (512)..(512): n is a, c, g, or t
  misc_feature (518)..(518): n is a, c, g, or t
  misc_feature (523)..(523): n is a, c, g, or t
  misc_feature (526)..(526): n is a, c, g, or t
  misc_feature (532)..(532): n is a, c, g, or t
  misc_feature (536)..(536): n is a, c, g, or t
  misc_feature (541)..(541): n is a, c, g, or t
  misc_feature (543)..(543): n is a, c, g, or t
  misc_feature (546)..(546): n is a, c, g, or t
  misc_feature (553)..(553): n is a, c, g, or t
  misc_feature (558)..(558): n is a, c, g, or t
  misc_feature (564)..(564): n is a, c, g, or t
gggattcatncaccatttattggancaaaaagggggtagggacaggagctttaggactggccngngggtgttctaaaggccacctggggttggaagacaatggtctggacacttnactggnggcaggctgngttccaagntccacaaatanctcaagaagttaaccagttccgttccagcctttttgatcagggggggcagctgctcctttgacttttcaaagnaagacttggcctcggcctgaagctttgggcttttgaccttctccatcangnccttgccatantcaggcncngnntggaagtactgaaaaaccangcttnncacacatggntcctttgccngnttncgaaccaaagctncttnaaggntgcananggggaggagnacncaattnttncgagcnnnttnatgttgganacagggggagggcggcctanccagcgtntttgncttggngnctggccccngccnaangggccaaatnccnggtaccaacacaagggnncgcntcccanaaaanaanaaaaancttngccananttnggacctnggcgnaatcanggcaatactgttttcctggtgaaaatatgggtccgccccc

SEQ ID NO: 523397 - DNA, 411 bp, Homo sapiens
gctgagaatctctccccgagattgctctctcttcctagtgccaactcctcagtgctcatcggagagccctcatcatttgggtgcctaccatctgtttaatagacatcgtggaagtcttggtttctgcaatttctagagtgaaattcaggacaaagcaatctctttgcaaatattcagcatgcagcttctcttcttcagggaagtgatgaagtgatgtgtctgccaacgtgtatagttagttgaaaatgatcagacagaaggctttgtgacacagcccctgatgtcagagcaacctctgaaaactcataataacatcgatggcataagctctttttggaatgttcaggaccacaactgaggacaatactaattcttcaggatgagtttaatatagcagatttctatatctca

SEQ ID NO: 523398 - DNA, 322 bp, Homo sapiens
taccatacttcattatccatctgtacttaacttagtctgcttatccattaacactggtaccgtattaatcatagttgttttaaattcctggtctgattattaccaggattcctgccatatttgactctgattctagatgcttgctcagtctcttcacactgtgtttctctccttccatatcacttgtagttctttgtagaaaggtggacatgataccatagggtaacaaaggaaatccgggtcaactaagcgctctcgtaatgtagcagcagccaatgtgtgtctaggggtgtagagagagatgtacatgtcagtcctcatg

SEQ ID NO: 523399 - DNA, 146 bp, Homo sapiens
  misc_feature (89)..(89): n is a, c, g, or t
ggtgctctagaggatcctcccccttccaagtgtttctccttttttcaaaattcattgttttggcccaggccatggtcagcttcaagccntgtcaattcccacaccactttggtgtggctgcaggccaggcaggcatcgcattgcag

SEQ ID NO: 523400 - DNA, 122 bp, Homo sapiens
tggtttccgcaaatgccattggatcctcagacatagcacatacagtatgtgtctgaagctgctgttcctctggtactgatcaggatgaccatggcacctcctcatcatcgtacacgaatgtt

SEQ ID NO: 523401 - DNA, 328 bp, Homo sapiens
aatcagacacagatgatttattttcatacctaaagcactttataatattctctgtgaaatataaaaacatatctgtgatcctaacatttttatactatcatcattttagaaaataaaaggcctgcgttatatactagagaacaactgcgagaggaaggaaggtcctgaaagaggttcatttgggatctacctaccccaaccccaagacataaagaccgattaaggcgctaagaggctaggatgtggctatggctttcaataacccagtcagtgcatacagataacccatgggatatattcaagccactctttgagccattgatggtca

SEQ ID NO: 523402 - DNA, 1013 bp, Homo sapiens
ttcattgcttttgtctctttttatcttcttgtcctgtattccctgattctaactcttgtgtctcagtccgtttgctctcttttatgtgctttgctctgtttattgttcccttttatctgtgtttgtttcgtgaatgttctttcctggattgcttatttgtggtttcttccacccagtacccttggtgtccggtgtcggtgtcttttctcgctctgttgttccaatgagtctctgtgaagctgatcctcacccccgtccatttctctttcagtcctcggttgttccggcactttgagctttcctcctcccatgatccttgtgctccttgccccttgtatcttgggctgccctgctctggctgcttgtcttgggacgcgtgctttgtattctggaacgcattgttgccgtgctcgttcatggctgggcttctgatcatcgcgcggctctggtgagtctttgcagcattatcccttgcgtgcaaagctcgctggccctctggcggatggtatgttgctcctaccttcaagtcattcttctgtgatgacttttagctgtcggcgcctgtgaaaccagatccaagcaaacatttctgataattgtgtggtgattttctcaacatacatcctgttcttactgtacaatggcaattaaagcttttccatgtactatgtaatgttcaactataaagtggtggaactggacctgcttgcaatatggaaaccagttccatagaccgctctctacaataatgactggtgaaagaactgttccaagcatatttgtccccggtacttgtattggaggtgccacttgacactcataggcttcacaagaaggaaaattgctcccactagttcatcagtgttatttagaaaaatacagtaagaggaaagaatcttcagtgatgtttatactaataagttctgctcccacagtgtcagcttatatcaagtggtaatgcccgataatgtcttttaaatgttgagtatgttctttaaccccgggtggtcttc

SEQ ID NO: 523403 - DNA, 323 bp, Homo sapiens
  misc_feature (49)..(49): n is a, c, g, or t
  misc_feature (68)..(68): n is a, c, g, or t
gcagcttaaagcgagagatcaacacatcgcggaatcctccgagatagtntgaagtacgaaacaaacancggggcggcgcacgagcttgaaagggggacggggcattttccttatctccttggtttgattaaggagtgccattcaccgttgcgacacgaatgggtggcacaccgtacaggggtcgcaaaccggaaaccaaggaacccggccaggccgaagcctgccctgcacggtgcgccatagaaaagcagcagctagcacttgaagtgctgactgtgcgatatggcacgtaccgcgccttggtttcgatgcgtccgtagcgg

SEQ ID NO: 523404 - DNA, 1320 bp, Homo sapiens
aaaaaagggggggtgggggggacccttttctttctagttggtcttaaagggaaaattataattttatacttttttttttgggtctctgtggcgccggaaatttttatattggagagattattctctcttcacttggttcttcccactttggacccgggtaaaaggcctcattagcgggctcagctcttgtgaatggagagggaggggaagaagaccccccgtggggtgttcttctctctttgtgaacagaggaaactccggcggtgctgtggagaggggctgtgcccctcccttcagtgtggcgtgtgtcgcgggtgctcggttctctctcttctccggtgacacgcatctctgtggggtgaattattccagagagaggtatacatttatgtggcaaaagccactctccagaggcgcggtctctctgtgaaatgtgtgtgaaaaggcaatattacacccacccagaggccaagaaatctccgcgggtgccccttgcgtggctcccccacaaggtgcgcggcgccccagagtgttcctctctctctctccgggagagtgctccccccaaaggggaagtgtgccaccgaggtctctctcgggacactttaccccagagaacgagggcggacagctccctgtggggggttctctttctcaaaaaaacatctcgggtgagagagagagaaaagccgtgtctctctcaccgggggggcaaaatgatgaggggggggactcccccccgcgggggcgcgacatgtggcagcggggcccaagaggtctcctcttatctaaaagtgtctgacacacgtgtgagatttgtctccccatgtgacaaaccaaggcggtttttgcggcccgcctctggtggggcccagcccccctgtttctcggcgcccacgaggggcaggcgcgtgtgacaatatacgcgggggcgccatggggcgtgctcaacacttgtggcttacggggcgtgggatatctccttcgccctcttttcccccctcttctgaacacgccgggggaacaagtgggggaccccctttaacacggtggagcttgatccttgggcccccctttctcccaaaagcgacgactacacttgtggacacaccacaaaccgcagccaccggcccgacaactcaagccacaaaaacgagggggggggcgctcgagccggacactatagagaagacactatcgaccagaagacgagggggggggcccagcaaaggtgtcttctaggccataacaccccacagagcagctctgtgtggcagcaaacaagaagggtgggcccccccaaatgaaaggcgagaagca

SEQ ID NO: 523405 - DNA, 247 bp, Homo sapiens
tacccattcgtgtcgcaacggtgaatggcactccttatctccttggtttgattaaggagtgccattcaccgttgcgacacgaatgggtggcacaccgtacaggggtcgcaaaccggaaaccaaggaacccggccaggccgaagcctgccctgcacggtgcgccatagaaaagcagcagctagcacttgaagtgctgactgtgcgatatggcacgtaccgcgccttggtttcgatgcgtccgtagcgg

SEQ ID NO: 523406 - DNA, 453 bp, Homo sapiens
tcagtggctgatgaattaaaatatataattgatattttatggtatttcaaaattgctatacctcctttatatcagaaaatttataataaataagcatatatgtacatatgtatgtgtatgtacatgcatgtaatatgtgtgtgtttgtgtacacaaaatatctataaacacacacacatcttttttctcaagaagctggtggataaccactcaccagcatactattctatatgggccttgattttggcatcatgtatgtaaagagaatacataaagagaacacttgggtttgcatagcagctttgctaattgctgaagatggcatttgaacccaggctattcccagaactcacactctgagtgaagccccatgtggctgatgtactatctccatcctgaacaccctcaatctgctgcctttcaaagtgtgttgttaatggataaagagtgtta

SEQ ID NO: 523407 - DNA, 547 bp, Homo sapiens
  misc_feature (39)..(39): n is a, c, g, or t
  misc_feature (49)..(49): n is a, c, g, or t
  misc_feature (79)..(79): n is a, c, g, or t
  misc_feature (82)..(82): n is a, c, g, or t
  misc_feature (110)..(110): n is a, c, g, or t
  misc_feature (159)..(159): n is a, c, g, or t
  misc_feature (175)..(175): n is a, c, g, or t
  misc_feature (181)..(181): n is a, c, g, or t
  misc_feature (238)..(238): n is a, c, g, or t
  misc_feature (265)..(265): n is a, c, g, or t
  misc_feature (276)..(276): n is a, c, g, or t
  misc_feature (392)..(392): n is a, c, g, or t
  misc_feature (436)..(436): n is a, c, g, or t
  misc_feature (454)..(454): n is a, c, g, or t
  misc_feature (541)..(541): n is a, c, g, or t
gggcccccagggggggtttccaggaaaaaaatttgcctncagggggggnggggatgggaagcaccaccagcccgggggnagngcagccttttgggggggggaaaccagtntccccaccatcagccaccaaaaaacttttgtgcctggagatgtgttttngacctgttccgccccntttccntggagggagcaccttttggacagacagaaccatttgaggctcacctttgggttttgngacaagaagggacgtgttgggtttttnttccctaacantatattttggctgcacacatgtctttaacccaggagcccaggggtagacaaaggaggactaaggtaatcaatttgcacctttttttatttttattttttttctttttttcttcagnggagacttccttccctttatcttttttcattcttcccggtcttntgccctgatctgtgtaantcttatcttgggtacttgagcagacggtatattccagaggtgggaggtgggaggggaagggagaaatccaaaacaaagtgttcttgntctgac

SEQ ID NO: 523408 - DNA, 263 bp, Homo sapiens
  misc_feature (44)..(44): n is a, c, g, or t
  misc_feature (184)..(184): n is a, c, g, or t
  misc_feature (212)..(212): n is a, c, g, or t
aaaacaatgataaaaggtcacctttactgagcacacactatctnggtccatccctacatcagccctttatttcaccagtggggaagctgggacacagagtagttacgtgggatgcccaaggtgggaccactcctatgaagtttcaacaccctaatgtgagatcctccatgacctagcccctctntttctccagcctcatttcctggattctntcgcttgccctgcaggcttcaaccacacaaacttcttgaaagtaccttaaa

SEQ ID NO: 523409 - DNA, 402 bp, Homo sapiens
gagagagagagagagagagagagtgcgtgagactcatcttacgccattgtctcttctcacttctatgctctagccatatcacctgtctctatacctcaatccgagcctcacttattgctgctacctttgactgtagtgcttctcccatatggtcttctcacacctgcctgcatctctgcacgtctttgctgacactacctcttcacagaggctctctctggttgcgcttactcataacgtacatcccactgctccaccgtcattcccatgctcattaccctggttcatgttacccccaagcgttgacggctgtctgacatcatatgctcatttgtatgctcgcccactgatgcgacggatctttacttgctcggctaccatgctactaccactgcctgtacc

SEQ ID NO: 523410 - DNA, 343 bp, Homo sapiens
gctcggtaccccaacgatcagagctggggtgaccttctgtgtccgcatggtcctaatctaattcttttcaagtcttcaataaagatctaggagtgtgattccagagataactttttcaggcaacaaaaccttcaaaatgtccttctcagaaacgagttttctccaggtcctcaggaatgctctaaactctcaccattacagcatctctcaagttatttttgttattttttttgtttggttttttttttttgttgaggtgcgttgtgaaacgagacggagtcttgctctatcgttcaggctgtactgcaggggtgcaacctcggctcctgtgaactgtaaactg

SEQ ID NO: 523411 - DNA, 149 bp, Homo sapiens
ttggaagtatgggtcaaactaaatgtgaccagcacgtgtaacctggtcttcgtccctgtattgtctgtcagtcgttgatagcactcagaggactgtccaatgtctttctcgagaaccatgtggaaacttgagcattcagtttcttggta

SEQ ID NO: 523412 - DNA, 96 bp, Homo sapiens
gggttaaaaaaaaaaatgagtttttttcccccccaaattggaaggaaccccttcccaacaagggagggttgttttaaagcccccgattaaggccga

SEQ ID NO: 523413 - DNA, 757 bp, Homo sapiens
  misc_feature (42)..(42): n is a, c, g, or t
  misc_feature (45)..(45): n is a, c, g, or t
  misc_feature (47)..(48): n is a, c, g, or t
  misc_feature (55)..(55): n is a, c, g, or t
  misc_feature (59)..(59): n is a, c, g, or t
  misc_feature (62)..(62): n is a, c, g, or t
  misc_feature (75)..(75): n is a, c, g, or t
  misc_feature (83)..(83): n is a, c, g, or t
  misc_feature (95)..(95): n is a, c, g, or t
ataagagagcactctagccagccactactgcgcacccacctnctncnncttagtncagncgnctcttagagtagnaaccgccngaaaggagtcgnaagaggtctcacgaggctgtcatcaccgccatgcccaagaataaaggtaaaggaggtaaaaacaggcgcaggggtaaaaatgagaatgaatctgaaaaaagagagtgggtgtttaaagaggatggacaagagtatgctcaggtaatcaaaatgtggggaaatggacgatggaagcatatgtgtatgatggtgtaaacgaggttatgccatatcaggagggaacttgagacaccaaggttggataaatacatcagacattatatgggtggtctacgggactatcaggataaacaaagctgatgtaattttaacgtacaattgcaggatgaaagctaagaagcctgaaggcatatggacaagcttccagaacatgctaaaatcaatgcaacaggacaattgtggtcctggagatggatgatgaaataccagattgagacgaattatggagaatgatgatgaagaaccattgatgatcatctaaaatgcaaccaaggtgatataacaatgacaagtttctcctgagcgatggaactacagatggagatttgggcatcaataaccaagaagagaaattcataaggggtgtagtcctggaaacaaaatggtaattcataggttaagaaattaatatatcagagcgaggcatgaattactagttaagt

SEQ ID NO: 523414 - DNA, 850 bp, Homo sapiens
tggtttacacgggttcatctaaggaaataccgacggcaaatcctgtttctctgccaaagcaggcatgtcttccccggttcaattcttagtgagctctgcgcatctgggaatttatacacgcctactaagttacaactcggaaggaatttcaatggttaatcaactcatgtggccgtcttgacgatgcgagacccagtccattttgcacagatatcgacgttgcctaaggtctgtccgccctggtagttgcccattgctgatattgtgtcatcttctcacctcgatgggggatttgcatgataagaccttcaggcctccattattaccataggaatctgcatgagtgagtttattgggactcatccgaggtcactatgaggcaaagcaaggtgggttcctgccagggggagtggagtcatacacagctacaatgaccccccatggacctgtatgctggaccgtgctttgagaaggccagcaaggtcaacgcttaggcacactgacgaggattgccgatggcaccatggcatttactgtgttgaatacatctttaagtctgagctggtcacaaagtggggactcataggcctccagttgtttggatgagaactatcacaacgtgctgggagccactcaagagccagcttcacatcctcaaactccaggaacccagcagaacctcaattgagacctggaacagttgataccataatcaagagtagatttgtgaagatttcttcagaatctcatgctatctggtagctattggaggagaggggcttggttcaaatgatagacttcacttttcacagtcaagtaagctcagaacatactccggaggcattagcaa

SEQ ID NO: 523415 - DNA, 158 bp, Homo sapiens
cagtgcacgagagatggaggatagcttgtgagccaggagttagagagtcagcctggtgcaacatagcaagaaccctgctctctactaacacgatttcaaaattagtcatgcagagtggtgcacgcctgtagtcccagctacatgggaggctgaggtgg

SEQ ID NO: 523416 - DNA, 585 bp, Homo sapiens
  misc_feature (1)..(1): n is a, c, g, or t
  misc_feature (92)..(92): n is a, c, g, or t
  misc_feature (109)..(109): n is a, c, g, or t
  misc_feature (126)..(126): n is a, c, g, or t
  misc_feature (152)..(152): n is a, c, g, or t
  misc_feature (161)..(161): n is a, c, g, or t
  misc_feature (185)..(185): n is a, c, g, or t
  misc_feature (211)..(211): n is a, c, g, or t
  misc_feature (232)..(232): n is a, c, g, or t
  misc_feature (235)..(235): n is a, c, g, or t
  misc_feature (243)..(244): n is a, c, g, or t
  misc_feature (264)..(264): n is a, c, g, or t
  misc_feature (267)..(267): n is a, c, g, or t
  misc_feature (284)..(284): n is a, c, g, or t
  misc_feature (301)..(301): n is a, c, g, or t
  misc_feature (304)..(304): n is a, c, g, or t
  misc_feature (351)..(351): n is a, c, g, or t
  misc_feature (356)..(356): n is a, c, g, or t
  misc_feature (360)..(360): n is a, c, g, or t
  misc_feature (376)..(376): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (405)..(405): n is a, c, g, or t
  misc_feature (407)..(407): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (421)..(421): n is a, c, g, or t
  misc_feature (426)..(426): n is a, c, g, or t
  misc_feature (435)..(435): n is a, c, g, or t
  misc_feature (443)..(443): n is a, c, g, or t
  misc_feature (461)..(461): n is a, c, g, or t
  misc_feature (470)..(470): n is a, c, g, or t
  misc_feature (492)..(492): n is a, c, g, or t
  misc_feature (505)..(505): n is a, c, g, or t
  misc_feature (515)..(515): n is a, c, g, or t
  misc_feature (523)..(523): n is a, c, g, or t
  misc_feature (580)..(580): n is a, c, g, or t
ncaaggattgcatatacatggtggtcccgtaagattacaatggagcagccagacacggtggttgcacctgtaatcccagcactttgggaggntgtggcgggcagattangacatcaggagttcganaccagcctggccaatatggtgacacncctctctangaaaactacaaaaattagcctggngtggtggcgcgcctgtagtcccagcngctcgggaggctgaggcagangantcgcttgnnctcaggaggtggcggttgcngtnagccgagatcatgccantgcactccagcctgggnganacagtgagactccatctattgtgaacagtgctgcaacaaacacaggngtgcngatnttgcttcggtacattnttttntttttnttnttggttttttttttntnttngtnttnttgtnttttnttgtagctncatttttngtttttttgtggtacctntatactgtnctctcatagtggttgttatttntttcattctcaanagcagtggtnccaatgtngaggggtcccttttctccacatcctctcaagcatttgttattgcctgtctgaaagtnttctc

SEQ ID NO: 523417 - DNA, 677 bp, Homo sapiens
  misc_feature (324)..(324): n is a, c, g, or t
  misc_feature (359)..(359): n is a, c, g, or t
  misc_feature (366)..(366): n is a, c, g, or t
  misc_feature (433)..(433): n is a, c, g, or t
  misc_feature (463)..(464): n is a, c, g, or t
ctcaaattagataaatggctttctactgaacagagatagaaagatgagcatctttcatcagactttccagtactcagatgatcaggacgagtcaaccggctcacttcttatagataactagatcaggtcattgctaactgtaattgtttgcaccaggagccacaaaggagctaaactagcctttctaagtatcctaagttttactatctaaccagcacttctgatttttttttcccttaaaactctaaagtacaggtgtcgtatgtctgccgcatctgaaaggctgccccggaaatcagagcctatctagcgggaatgtctggncagtcacccccatcctgcgcgcagatagcaaaggnctgctgncaggtgtcagacacacggtaccgcaacagcagtcccgaggtctgagattctcaatgtcagcaggtgnctggagagtatcaccagagccactcagganncagccatgcggaagctaaaattgttagtgggttttgggccagcacagtgtatgggaacactttttttgttgttgaggggggcctatgaagtctccctctgttgcccagtctggagtgcagtggcgcaatcttggctcaccgcaacctccacctcttgggttcaagcgattctcctgcctcagcgtccctagtagctgagattacaggcgtgcg

SEQ ID NO: 523418 - DNA, 136 bp, Homo sapiens
cctatatgtaggtaggataaatataaatagtattcagattgtgatgtaggcttaaatatttagaggctgaccatggcagtggaccaccaccaccaaaagggaccacagagttttgcgagattaagaggtttgggga

SEQ ID NO: 523419 - DNA, 187 bp, Homo sapiens
ggagctcggcccatgttagatatggcactactcatgcacgtatttggaagcgcagccaagcaatatcaaccattaagcttccctctacacttattatcttcacaagttctgattctactgactatcctagagaatcgctgtcggccttaatgccaagacctagcgttattcacgactttctagataa

SEQ ID NO: 523420 - DNA, 84 bp, Homo sapiens
aaaaacctggaaggggaaaggaagggaagggggggggggttttttttttttgttgctgtaaaaaaagatttttggccctttcca

SEQ ID NO: 523421 - DNA, 100 bp, Homo sapiens
atagacgactctgcaacatcttcctcatttttcacaggtatgtaacgcaccacgaagttcggttaacatcaatgggatgagggggtaacacgaccggtgt

SEQ ID NO: 523422 - DNA, 201 bp, Homo sapiens
  misc_feature (101)..(101): n is a, c, g, or t
  misc_feature (131)..(131): n is a, c, g, or t
tcgatagggcaaatgcagttataagaggcttgtgaagtacattcaatttagtttgctcagcgaacaaccctggtccacactcagtgttaccattaatttantataagtattgacactacattatgattccncatatgcaagtaagatagggtcataaacacggtttcgtgaacaagacacagctgaactcacgagtgagca

SEQ ID NO: 523423 - DNA, 229 bp, Homo sapiens
attttgacaccttttagaactgtataaaagtgtgttgtgttggagcagccaacccatgagtgctgcattttggaaatttagttttatctttaggtccacaccatcatggtggattcatttaaaccatctaaaaaatgacacactggtgtaggatggataattttgtgatctttattttccccttgtaatcattttaagcatctaaataaattgctgtattgtgcctaaa

SEQ ID NO: 523424 - DNA, 215 bp, Homo sapiens
tccgcctcttggcctcttccgcttctacagtctgctgtttcctcctgtgctcctcgatctgctgctcccgctcccggtagcgcctgtcgcgctcctcttgctcctgccgctcctgctccatccgctcctgttcgaacctgagcctctcatccagggccttcttccgctcctcctccttccgaagatcttcttccttcttggccttgctcccaaca

SEQ ID NO: 523425 - DNA, 132 bp, Homo sapiens
aaagattagctgaaagacttttcgaatggaccctatgggactcctctttttcactgtgagatctacagtgaacccaaaagaatgatctagagtatgttgaagaaaatggaagtggggtggcatcgataaaca

SEQ ID NO: 523426 - DNA, 239 bp, Homo sapiens
ggcgacctaaggaccccatctgtctcaggatggggttgtcaagttgtacgaatcaggctactttatgagataccaagtgaattagaagacgacgagagggtaaactgattattatgctcggaacgcttgggtgatacagataaaaataaatacaaaacaccccaaatacagggatgatagttccgtggtgacaaaacagagatatcatttgtcagattgcttatgccgtaatagagggg

SEQ ID NO: 523427 - DNA, 945 bp, Homo sapiens
  misc_feature (153)..(153): n is a, c, g, or t
  misc_feature (438)..(438): n is a, c, g, or t
tgggctcaaatgcccactgccagtccccgcatccgcaggcttgcagcatctctcttgtgtcctggcggaagatgggagggatgtgatgactggagaaggctacagtgcttgtgttgcaaatgacgacgtaagacatgaatgtggtggccaaanagaaaataaaaaaagagataaaaatcaaaagaaagaaagagagagacataatagaatagagaatatcatagaagagggcgcggtcgcgacacgcattactctctttgcgtcgttgtgtggagcccaaagcttcttctcggccaacgaagaatctttgttaagttcttggagagaaagggggcgctaacttgcataattagagggaggagacgtaatgttatatatataggaagggccagctggggagacgcgtggaagggcaagctgttcatattagagataganacgacattgtaagatagagttcgtgaaagagaaacacaagcgctgcgaagacgaatgggggaggcacaattctattgtgggataaagagagaggaaacccaatatcttagtctaattggagggtgggcgtggagaaacatacatattatagagtggcgaaacacacaatatctgttatctatcaaatgaaagaaaagatatatcaagagaaagcgctatattggaaggaggggaatagatattatactagacacagataatgtttacagaggcgagtgtaaatagaagtgtgtgtgattgaaacaaaagacacgcggggtctacaattgtgtgtcactgtaaggagggacgcaatgaatagagaaaaaatggttatggagtggaatcactagtgagggagatgaatatgtagtatttgtagatggagcgagagaaactatatatgtatatgccacgacgcggaggggaggggaatattgatgtaatataaaacaagattagaaaggg

SEQ ID NO: 523428 - DNA, 211 bp, Homo sapiens
  misc_feature (79)..(79): n is a, c, g, or t
  misc_feature (117)..(117): n is a, c, g, or t
  misc_feature (132)..(132): n is a, c, g, or t
  misc_feature (154)..(154): n is a, c, g, or t
  misc_feature (164)..(164): n is a, c, g, or t
cccttcaatagcatccttaagatttaaaaaaaaaaaaaaaaaaaaaaaaggcaaaaaaagtgatggcaagccgtaagtncttctttgtcatcgccgtgcaatctttctaacattccnatctccatctcaccngtttcttgtttgacaaccttcnacaaagcaanaattaatctttcttttaaacttgtttcatttatgatcaatgtagaga

SEQ ID NO: 523429 - DNA, 368 bp, Homo sapiens
  misc_feature (8)..(8): n is a, c, g, or t
  misc_feature (29)..(29): n is a, c, g, or t
cctgtctnagcctcggaaagtgctcagcnacccacgcccggccaatcttataacattccattttatgcgttttaatcctttaaaaaaatctccctggccgggcgtggtggcttatgcctgtaatcctagcactttgggagcccgagacgggtggatcacctgaggtcaggagttcgagatcggcctgaccaacatggtgaagccccatctcaactgaaaatacaaaaattagcccgggcggtggcacacatccgtagtcccagctgcagaggctgagataggagaattgcttgagcccaggaggcggaggttgcagtgagccaagatcacaccattgcactccagcctgggtgacagagcgagattct

SEQ ID NO: 523430 - DNA, 153 bp, Homo sapiens
tattcaatagcagaatcgtgttagttctgatagagcctcttttcagactgatgtcttattcttcttagtgcttcaaactagatccttattatattacatcttcaacttcttgatctaaatcaatattacaaactggtgttctcttaagaaaaa

SEQ ID NO: 523431 - DNA, 1065 bp, Homo sapiens
  misc_feature (274)..(274): n is a, c, g, or t
gtggcgaaacgaggaggagataacgcggtcgttggtgctcgggatgtctccctagctctgctaaagccctaaggccatcacacagtggaccttccagcatcgcgcactcgggggcacagatccgtgggagcgggggctgtggctctctctctcgtcctgacgtaggcaatcctgctgaccgtcacggtgacgcgcctccgagcgagactgagccctggtacgaccaatctgaacatccaatcaacggacctcgctactgttcaatgaacgaagncacctggggctccgtgatgagatgcgagaatcgtcgtgccttgacgagcattcgagcaacgagatgatggggagctacgcgtgagcgagctatacgcacgggcgacgaagcatccagtaccgaacctaggcgccggcgtaggcatgccgacagtgaggcccaagggaggccccttgtcctagtcctgtgccatgtaggacggtcagaggctggagggtgatagcaacgttgggtggaacggatcaggccgtgccctgcgcgctcactcacacacgtgaaccaacgccaggagcagacgtcggggagtatcgggccttaggcatggatgctctcgctctttccctagcattggtactaatgctttgcatgatccgccgaatgtggcattcattgcctacgtgtcatccgcggttcaggtgttcatggcagtactgatgcatgacgtgatcgaagcctccggtaccggcgcttggacagtagctgctcatggccgtcgagccctacgaaaccattgccttcaaggtgccgagcagcagagatcgacaaggcggagggcgagtcctggacacactggaaccggggagaccaaggcaggtcttcctccagttccactttacagatgggaaaaaggcccagagtgtgaaacaaggagataacatgaagggacccctaggaggaaacgggggtcaacgagcgcggggaaaagcggcgagccacgggccacaaccgcgtggagcaggggagagcagggcgacagccacagggagcaggcaggaagaagcacaggaagg

SEQ ID NO: 523432 - DNA, 538 bp, Homo sapiens
gggagcagaggttgcagctgagccaagatcgagccactgcattccgacctgggcgacagagtgagactccatctcaaaaaaaaaaaaaaaaaaagctttggtttttaggcagaatgaaaatatttggattaaaaatttggcaagctggccaagtgccatggctcatgcctataatcccagcacttggggaggtcgaggcaggaggattgcttgagcccaggagtttgcaggttacagtgagctacgatcccaccactgtaatcactccaacctgtgtgacacagtgagaccctgtttcaagagagaaaggaaagaagaaagacagaaggggaaaagaaggaaggaagggagggaggaagggactgagagagagaaagagaaaaaaaaggggagagagacagagagagagagagagagagagatctcaaagctaccaaatcagtggggagacagtactgaaataacaggtttgagaataagatccgtgaaattcgagtcagaatgaccagcggccttgtggtaggacaagactatctgt

SEQ ID NO: 523433 - DNA, 605 bp, Homo sapiens
acggaagtaccgcctcctcccgtctgacgcccctcaggtgaccctgcatcgctccagccgccgtcggccatgtctgggccaggcaatcaaacgcgcctgccggcgacggtggtgctcagggcccccggaaaagaagctgagtcgtgaggagcaagaccaccacgactcttatcgagcccattcgtcttggaggcatctcttccacggcaggagatggacctggaaggtactacagtttccatgaacaagtaaactggctagagcggctggaacaacggcagcgcttgtgaagatgaactcctgagaacgaattgagaagttggagaagcggcagtgccactagatgatgccacactcctcatcgtcaatcgctactgggcccagcatggatgataacctgtggaatgccctttctccgactgccatgagatgccatggtggatgcttgtcttcagctgccatggggcacctggtgacccagtgaggggccaagcttgtgatgggactcctctcccagagccggggacatcagagctgagagaccccattgctgatgcagctgcggcccctctcagtgagccggcttggcttctgtggtggcactg

SEQ ID NO: 523434 - DNA, 324 bp, Homo sapiens
gctgaatttgaccttggttgcgtcgccgaatagggcagcggcaacagcacggcatacgtcagcgtcgatcccgaggatcttgccgctggcgttcggcaccgagaagcctggcagaccgtcgctcacgccacactgcacaaagcctttcttctgcacggcatccagcgtggcgccagcctgggcgaaaacactgacaccccaataacggcagccgcggtcacgatggccagggtggatttcaataccttcattcaaacctccagttttgctcttgttgtgtcggagctagaaccccaccgcacccttattaggcgacatcgaccc

SEQ ID NO: 523435 - DNA, 188 bp, Homo sapiens
tctactatatgatgcgtagttttttggagtgcactggaggtgcatggaatggcgagtcgtggaatgtaatggagtggagtggagcgtagggtagtggagtggagtggaatggaaaggaatggagtgttgtggaatggggtgtagtggactttagaggaatggaatggtgaaatgaaatgtgagttaag

SEQ ID NO: 523436 - DNA, 2173 bp, Homo sapiens
  misc_feature (2165)..(2165): n is a, c, g, or t
gtcttgttggtgcctcttgaggtagtttggtgtgagtagagagactgcgtgttcttgttggcgtcctgctgggctagttacaggtgtgttggttcgccccccccacgcgtgtgctcttccgcggaggagatagcttcagggatgcgtgtgggtgtcgctctccacgggggggtgcatttcctgttgggccggatacacccctggtgtcgtgttggattatttcgtcctttgttttaatgggagttagtgtctttcttcttccgctgcgtgctgttgtacgcttgtgggttgttgctgtgagtgtggtcctcttgtcgcccccttgccttccggccctggtttgggttgggtttgtggtgggtcgcgcacgacaagcataggtctatcgacgttgtggtgggctggtcggagttggatgtgagtgtggtggaccgcgttcgcgctctaggtgttggcggtggacgttgtcttgtgccttcgcttttgtcgggtgtgagagattgtgtcttcgttgcttctcctccccgctgtcgtgttcatagattggtgtgtgttggctccccacacctgcgaggaggtggtgtggttcgctgccgccgctggggtggtgcccggcctgcctcgctcccctgctttttgtgtggttgtttgccgccttcgtgttggttcggcacctagcgaacgttgagtgttttgtttttttgttgttgttgttatggaggacggcatatgaaggagggtgctggtggtggtgatggtcgtcttctgggtgggtggcggtgcctccccgcgcctgcctcctcactgcgtcagttgtcttttctttgtggaggtgagtattgtacgtctgttcttggtaagtagtagtgttgttgttggtgagtaggtgatgtggtgagtttgcgatttgtcggccgcccgcctcgcgcggcctcgacatgagtgtggcgtaacgacacactgctccaagcagcaggtggtggtgtcttgccccacactgccacttcagcagctgtgcacgccgcgtctcttgttgtttctcctctcgcgcacgccccccctctgtttcgtgtgttggtgcgcgccccccgcggcgttggtgcttgctgcagtaagtggggggcggcggtttggtgttattgttagagtggtagttgtgggaggaattatccggcggatgaagcaggctgccgcacaccatccccgcggctgtggggattgcgccgcctgtgtgtagatgatatatccgcccccccgtcgtgtgtgctctttctccgcgcaagtatatactgtgctgggtagtgtgtgtggtgacacacaacagcagtagtgtgagaggagagagcctacacacactgtgtggtgtgtgttgtgtactacacacacacacaaacatagtgtgttggtgtcacccgcgtgcagtgagagaggtgaggggggtgtgtctctctccgcagcagtagagtagtagagatgatattgtctctctccacagagaggttttgtgacacacctctccttcatgtgtgattgatgagagggacgcgcgtcatgagatgagggcgtatgatgagagagtgtgtatagataacactctctcgacgcctctctgcgcacacacaggcgacacacacagaggtgtgtgtgtgtgtgtatatatagaaaaaacacacacggtgtgtgtaatgtttgctctaccacaaccacctgcgagagacgacactgctgttgtcgagatgagagagagatttcttatataaacacccctgttatatattcgttgtgttgtgtgtgtggggtggtagacacacacacagtgagggagagagagatatgttgagatggtgcggctccgcctcgcactcagagagagaagagagtagtgtgtgaataaataagagatgtgtcacgactgaatgaagtgtgtcccatcgcacctctggagcgtcttgcatccggcccccgggtgtgttataaatacacacactgtggtgttctctgtcgtcactcacactcatcacaccgctgtgggtatggaaatcatgtgtgtatatatatataaacatatataataatacaataaatatagaatataagaatataaataaataccttccgaagggcaagtttaacggtcggggccggagatagagtatgtatcctcntcccccct

SEQ ID NO: 523437 - DNA, 92 bp, Homo sapiens
ttgctgtgagattgcccctattttgtgcttttctgtttgcagtgggcccggccttgttttaacccggaataaaggtgattgtttgttttgca

SEQ ID NO: 523438 - DNA, 683 bp, Homo sapiens
  misc_feature (472)..(472): n is a, c, g, or t
gggaacggtcgtatatttccccggtggcctgggtgcacgcgcccgccgtgcatgggatgctcccggtcgcccccggttccgcggctccatctgtgatgcggcgaggagggcagtcgagctgtccgcaaacaacgggcctttagttttcaggtggcgaaactgactggtctggttagagcgcgtccaagccaagccgcagtgctgtttggactattaaatttctccttctgagtgagtagcaatcgagatggaaccattcgcacaacagctccagctggcagcatcacttaccgccaatttatccaacttgtgccaaggctctgaaatgccaacaacgtcgaggcctgcacttgatgtcaagggcggcacctcacctgcgaaggaggatgccaaccacgagatgagctccgcggcctactccaaccttgcggtgaaagatcgcaaagcacaggccattctgcactaccctggngtagcctcatatggaaccaaggccagtggggcttccactaagatctcgggatctccaataggctcttctacaaccacccctgtcactaaacccccatactttaacctggacccccgccccttactttgttggctaggatgcccctgcagaaacattatgcaggctcaggggatgggtggtgccacttcagggccccgggtaggcagcccct

SEQ ID NO: 523439 - DNA, 144 bp, Homo sapiens
ggaccctcattatggccaaagttgtggagctggcaggtggatgtgttgttagcagttgcaactgggctgctgtggactggtgtcgattcctcactacggcccaaggttgtggagctggcagaaaagtgggttgttggagtcgag

SEQ ID NO: 523440 - DNA, 345 bp, Homo sapiens
accctcccactacccgctcccctccccgacaagactgccccataggaaaaacaccccaatctctgcccccagtttctcctctcttcattcccagttccagggccagcttgttcaactcactctcttgcctccatttcttcagggtcatggacaagagacccaccaggagcaagatgaagcatcaagtcacagggcatgatgtatgggggagtggggtgaggcagatgacacacctaaaccctgagcaatgagaagggaacttgggtctccagctggggcaggctggtgggagtggagcacacctgttacgtcgacgcggccgcgaatttagtagtagtagtaggc

SEQ ID NO: 523441 - DNA, 180 bp, Homo sapiens
gacgttatctctgtggggcagaggctgcagaggctgtggccacacaggagacccgggctcaggtggatgaaggaaggagcttctctccctctacaaccgttgtggctccctccttcctcacctccctgggaagcgctgacccagctctttgttcctggacctacaccccacagagagagt

SEQ ID NO: 523442 - DNA, 127 bp, Homo sapiens
tgttaatatctggtggtactggatttgaggcggattacgggatcgcctggggatctcctacagcccagtacccgccacgtaccggagtcaatgtagactctaggaggaagggggaattagatagtgg

SEQ ID NO: 523443 - DNA, 466 bp, Homo sapiens
  misc_feature (17)..(17): n is a, c, g, or t
  misc_feature (65)..(65): n is a, c, g, or t
  misc_feature (79)..(79): n is a, c, g, or t
  misc_feature (141)..(141): n is a, c, g, or t
  misc_feature (193)..(193): n is a, c, g, or t
  misc_feature (273)..(273): n is a, c, g, or t
aagggtaaatcctgtgntttaaaattttcctggaggtaaactgcccaaaaagtgttttccccaanaggaagctgcaccnattttaaaattggcccacccaaatgagggaataaagtattcttttttcctcccacatccctnaaaacttccttattttgttttccttttaataatcatcccctggctaggccgncagttgtcacgccctgtaatcccggcactttgagaggcccagggcgggcaggtcacgaggtcaggagatcaagacccatncctggctaacatggtaaaacccatctctactaaaaatacaaaaacttagctgggcatggcggcacccacctgtagtcccagctactcgggaggctgaggcaggagaatcacttgaacctgggaggtggaggttgcaatgagccaggatcacaccactgcactccggcctgggtgacagagcgagactccattt

SEQ ID NO: 523444 - DNA, 799 bp, Homo sapiens
  misc_feature (1)..(1): n is a, c, g, or t
nggctttctagccacccgccttttgttttaaacccagaaggagatggcccctttcttgtgggccgcctaaacaacaacaccttcttttagctgaaaagaaaaaacggttgagtccaggaatcccttttaaatcctcgagtgtgccctgtaaagcataaaccctttcgaagctaaaatccctgtgaatgtgggacctccataagggtgaagactgtttgaccataaacaacatgacaatgctaaagcctttcggccgtaaaacgtccccctcgtcaggggcggtgtaccaacttaaccccttgataagttgggtgtccagtctggctatcctcacgaaaaaacaagctcagtcctgtcttagggtccccacgggtaaaagtccccctttaaactaggttgttccctcaggtgtcactgaggtggtcgataagttctatgcctttgaggctatcactgggacggtgtttgtaaaagtaaacaggtttgaggcctccgtttatggaaaagtgccgtatgtaccctctcatgcaataaaaccttaaaaggcctatgcattgggatttgcatgtttctcctgtgtaagttgaggcatctgagtccaggtccccccaatatcatctgcagccagctacacagggatttgtgtgtcatctagaagacaggcctccaagcttcaggagcctattggtgcccagccttttctggctctggagttagtaatttaacactcgcctcttgctgatcatgggacggtttttctagataaagcaaaagactcgctcaataaaactgtcttgtg

SEQ ID NO: 523445 - DNA, 1555 bp, Homo sapiens
atggcgcagaagcagaaaaacgaactggaagaaatgccatgaacactgcaagaaacatatactgcttacctcattgacaacaaggctcagcttgaacataccgactggtcagagctgctcctaacagacatcactatggcggccgatatagctgaagtttgagcttgctcgagaagctacctatttacgctcaactcataccacatacttgttgtagccacctctgaccagacaaaactgggcagaatttagtataggcactaaactactactggctgcacaacataggataccagcatataatgctgcgcagagtccgcaccggcaatctgcgcctttctaggacaaaaccgtatatactcctctgcacggggacatcgggcctatcgaccaactaccccaaatcctatggcctacacacgaccacaccaaatccttacataactccatgacatcccacacacccaccccagcgcacacgcgctacaacactgcgaaacgggcaagaacctgactgaaccttgcacacaacctgggcgcctaccacgacagccctgcacacggcccaggaaccttcccacggcgccctcaccacacggccgccctcacacccttggcaccacccaccttcccacggaacgctggacaacacagaggcccccatggtacccaaaacgcaggcactatcagcgccgttgcaccccgtgtcaaagcccagcataaactatgcgtgcacctgcaaacccgttggccacggcaccgtggcgtccacctcgcttcaaacgaagtacaattcaccatacacaccgaccgtctcccccggacgcgcgctaagacaacacactaacggaccaaggcaggtaccgagcaccccctacccaaaacttgcgcgccggcctaacatacctttcgacagcggcgacaaccacattggcggcgcacgaaacacgcacgtaggcagaccacccgcacacagactacaaccaaaaccgctggcgaaacaacagagcgaacggcctaaggacccaacccataaccgacacaaaccaccagccgaaacaacaatggccgcgactgcgcaccactgggacaccccacggtgcaacgcaaaagacaggcaagtggcacaccacaacttcaccactaactaggcggacacatgccacgaaccacacagcccacccacaccgacaccagcaacaatgcggacccaggaaaccagaatcacgacacagcgcgcaccacaagcgaacacccggacacacagacacacacccgcacatcaccacacctccgaccacgcgccacctcagcaatacggcacacacacaaaccacatacggactacgaaccacacaacgacacacaatctcggaaccacagaccgcaccacatcggccaagacgccacacaagcgaaagtgttcaccaagccaaaagagacacgaagcacagcgtatcaccggcaacgcatacgagacgcaacggcgacagacaaggcgcagaaaccacaaccgcacacacataccagcgacacacagacatagacacaaaag

SEQ ID NO: 523446 - DNA, 1069 bp, Homo sapiens
  misc_feature (203)..(203): n is a, c, g, or t
  misc_feature (216)..(216): n is a, c, g, or t
  misc_feature (593)..(593): n is a, c, g, or t
gctgaggcaacggcattgatcgccaaactacgaggatagcgtcgatagcagatctgaagacctgggcgcaatagatataggtgaccggcgacgggaagaagatgacagaatgatatgccaaggcataagtatatgcgaaggacatataccacacataataccctgtcggtgcagtacagtgcaagttgacacctaggaaacantaacgtgttgcantcggtacgaagccaatcagcatagaatctcccgtaaagcatgactgagcgtagctaagaagagcgtagaaagaagctacaaccacgggtcagtggtaggcgaaaagactagtttgggtagatgaatctggagtaggctacgcacgaggcggatgcaaagaactctagcgcgaaaggcacgtgacgagggaataagtcctgtggtatggtcgcgaacgtagtaggcaagactccgtttagctttgcaaagcttacatgtacaaatgtttgtggacgccgaacaagtagaaacgacctcgtatcgatcaccctcgtatatgtaaaccacattgtggcaaagcgtgagatataatcagttcggcgacatacgccagtgcnacactccaggcgtgcaatcccttgggaaccaactttggagcgagacaagagaataccccttacgtagaggaaagccagcaagtacacaagatatattgtcaaacaaaccctcgagatatagctggagggaacgttagagcaaagcaccaggcctgagcacaaaagtttttgaggcgcaaacaaaagtctgggttctcccaaatattgggagttcaaaatccccatccacgaagcttatccaccgatcaaagtcaaagatgtggcacccaagtgtaggcaaattatgatccacccgtggataggcgatcgctaatctaactgggacgccagaccccctggggacaccccaaaatgcataagtcaaagaaccctggaccaagaaaaaggaagaccataacagagttataggttagatacaatgttaagcgcaagttgaagacccagaaggtgcttgacaatcccggggcacgtagcag

SEQ ID NO: 523447 - DNA, 473 bp, Homo sapiens
cccatttcctcaccaggggcttaaagccatggggccccgagaccctttctttaggtgccaagccctggaaggaacctttaaaacagggattacgcagaggaaactccagttcccccagtcctgccatggtgctacccttacggacagggatggaaacagggcagccaagtttgccaggacctgaatagcgggcccaagaatggccttcctcttaagtcatgccaaagccttcctgcccaattggaaacagttgctggcaggtgaacacgacctgcgtggacctcctggcagttgccatggttgttgtaccccaacccatcccccttagggagacatgggctcagtcccattgcttgtgccacagccacaaagatgccatgggtctctagcctgatatccgtggcttggcagggtcagcacccctgggggatccaagccatggtcagaggaaagtgttggcaggctcgcacagc

SEQ ID NO: 523448 - DNA, 297 bp, Homo sapiens
  misc_feature (3)..(3): n is a, c, g, or t
ggnattggcatctactccaacgctgatcgtaaccctggggattggcttcgctgcattactctcctctcttcgctctctctctgctagtcctgtcaaactcctctacgaatatcagcaggggttctcctcctttccacaacctcccatccttccactttccagtcctctcttcccatatatatcatagatggacctggtttgtgggtcactaatacacttcataatgcctggtgaacaaggttaaacagtcgttccgcctgtgacgttgagctctgggtctctgtcgtcgttggctgt

SEQ ID NO: 523449 - DNA, 619 bp, Homo sapiens
tacgaacgtcgaggtcggtacccgcattggagcaacactcatggcctctagccttgaaaggggccgccattatggggtcgtttgttcgttgtgtagaccaactatgctgagatgccgacacccagtagggcgaggcaatcggcccatagaagaggtagtatagatgagctctttgctccctccctcccactaacttcaaagatttgctctccatctccttaggcaaagttccttggccttttgtcttatttgggtgaccccctcgaaggtatcaccagtccatttgcatccaatcgtgcatcttgacggagagcggtctcatatgctatggtggtcaacgtgaactagtatttatgtgtagagaacagtggctgtttgtcaggaaaggtgtgccaaaacaaagagtacggccggccctggaaatgcatcagcaaaatccatttccccggtgcactcattctgagcttccttccttcatttctgtcattactgctgagaactggactgtgcccagtatgactttcccttccttgccctcttcttgctgccagggtctgcaggttagccaccgtcccggcccagtctgagacctgggattatcacagaatgggggtggcag

SEQ ID NO: 523450 - DNA, 1626 bp, Homo sapiens
tggtggaaaaaggacgctttattggggaagcaaatcttggctgcccagggaccaaacaggccacccaaggggcatcttaccacttcgtacctccaaaagaaccacgaggaagtgtttggctaattaaaacactcgaggtgggaaacgagggaattccctctgtgggcaactcccccaaccctcatcccttttcgagggaatgtgaagaaatctcccgaaccatttctccgtggagtcaccagccagtggtgtctcaaatataacagaatatacacgccccctctcgagcggcgtgtgcctatctcgcgtggttctctatatataaagaacaccattttttctttatagacatattttgtgtgacagttcttctcattgtgtggtatactgttctcattctctctcacagtgtatctctcttttcagagcgcgcccactcagagacacaccaggctatctctgtgtgtcacacagacagtgtggcctgtgtgagagtgtgtcacgagacaccacccacagaacagagagaggtccactcttctatagcgccccagtgacactcgagagactcgacgtacagagtgggtgtctcacaatctctactatcacgcacaagagagcatcatctcccagtgcgtgtgtgcgcgtgaccctctgtagaaaaaagaaatcgccggccatatctatctcgagactctatattcaacaatctccaagggacaagagggggagcaaacactcaaaaaatctataatcctgtgggtaccaacgtagcggggcccctgtgggtcaccgatggtacatcacagggtggccgactgggccactccccaaaagacggattctctacattaactacccggggatgttgagggggggagccccaagttgtaatataaacacctattacacccaaccattattcttttccccccctttaagaaacatatcaaagaatgtcgcaaactcccaaaaagcgggtcgatgtcaccaagacccaagagacttcccaaaccaatggttggtgtcccccgcataggcaaactattcctacccatcctacaacgcaaaccacaacgacatttcgtggagagtccaattcattcctttcagtagagcgcccccacattggggggtggtacgaaatatttacatatccacaaagtaatacaaccgccgagattgcaggccacggggaggctcaatggtttatcatataagacaaaaacctccggggaaacaaaattcccgcgcggcaaacgcaaagatgttgggggagccccacaaacaacccttaagaaggaacaacacccagtgaaaacacacaaggttcaagaacaggcaacaacgaccgaaactgctacacagaaaaaaaggggctgaacagcattcgggatacacacaccggctagggaggacacacgaaggagagtttaaccatgtggccccggggtgaacccacaagagaaaaatgacgccgccgtaggagaggcgtcaacacccacattcgcaaaaataacaggaggagcaggcgctaaagatacacacaccgaagattcacgaaatcccgcaatcgagggagtcaaccaccccaaatatatgatgagatcaacgggaggcgacgaa

SEQ ID NO: 523451 - DNA, 764 bp, Homo sapiens
tcaggggagacacttctttaattataggaagggaggtcttccctacgggcgccggctcctgccaaaggtcggggtgacagcaggatcaaaagcacggtctctcacacacagggggagtgtggaggagtggctctcccgcagccctctttagaaaagcccgaggagttctcctcttatatttcagagagaagaagggcattctcttatacaagaacattcatcccatatacagttcgctcactctccaacctacgagggctcgagggaagacgacctctgggatatcacaataggatattattattttatcgctttataactctcattattttataagaaatctcagcctcttctccacacctataagaattagaacacaataagaaattaacaaataattgtgggtccgtgtaaagctaatagtatagaaacgtttcacaagagtgtctataaaaacatattctctccaataacagagtggacacaagaggggctttgtgggtgatccttgtgtggggccaacagacaagaaccccaaaaactcagcggcgtgaagaagaaaagtagcgcccatgtggcgcgtgtgatgagtccggggaagtgtgagtgacgtggaaggcaacatctcatgtgggcatacagaagcgggtgtgctaaagagaacaagagatcacatttcctcccactttcagccgggaaagtccaagctcttcctctgggctaaagaaatctaaccttcgggatctccagagagccttaggcgg

SEQ ID NO: 523452 - DNA, 217 bp, Homo sapiens
ccaagtggggcccctggaaattaatttttactccttggggcccccctttttttgggggttgccctgctccgtttttccccaaaaagccctggttttttcaaggccccccccgttttcctgagtgccctgggaaatttgggtataggtcaggcttggccccctttttccccggaaagtattaatggttcccagtccaataaaaggccctccagtggga

SEQ ID NO: 523453 - DNA, 799 bp, Homo sapiens
tgagactggtccaccatatgctctgtggtaaatttctccccaaaattttgtattactcatttggcttaaacccactaacacccgtggttgtgcatattcccggacgcgtctttttggacacaataggtggtcgggcatcttcatatgtttaccccccgcacaagttgtccttttcttcagcccttctttccatccattgctttcaatggggaacacttttcccatttcataaccctcctaaatgatagtgtttcccaatagagacatggtgacgcccccccccgttcacaagtcgttgtgaatcccgtctcccttaatacatcttcaactgctacaagtttctgtataacacacaaattttttataccacgcatcagagagccaatgctccccatatttcaccccgatactcccccccgagctaaaagtctatttgtactcctacacaccaacaggcgccttaatcactctttctaaataaggggccactggttgcgcttcacaaggcataacagcactggcacccctcacccctccgtggatgaataaattattgcatgaaccttggcaacctatttaccttctttccacacgaagcatgcttccaattcttaccaactattacaagacaagttcttaattcgtcttacagttgttcaataaacgagccgctcatgtcaatagccacctgcagcatctctgcgcaaacatgacagactcatagatgcttttcgtcgtacaaagcatccgtctcatgaccacaaccccaatcgaaaaacaattctacaaccacaaaaca

SEQ ID NO: 523454 - DNA, 288 bp, Homo sapiens
agcgacgtgttcatgaaaagctcactgctgcccagcgggttcttaaggagtcagtgtctatgtatcatccattactctgggaatctactgtgaatcctgtctgttttttctggagccgttcacatagagtagaatgtgggatttaccgtgaacgtttccttcctcccccgtatctggcggctgtcacttcgccaccgtgctagaatactgttgtgttgtaagatgactaattttaaaagaacctgccctgaaaagttcttagaaacgcaatgaaagggagtctcctcc

SEQ ID NO: 523455 - DNA, 145 bp, Homo sapiens
agttctattatcttctccttcgttccttctccttcttttcttcttccttctccttcctctcctcctccttcgttctttttctttcttccttcttccgtctccttctggtaggtatactaaggacgggtaggtctgatgaaggacg

SEQ ID NO: 523456 - DNA, 324 bp, Homo sapiens
gcgtcgacgtcattataacgatgatgaaaatggtgtttctttttaagctataggtttattcttgttttattttttattaaacagatgattttcgctctgtttctcagactggggtgcagtggcatgattatagttcactgtaacgatgaactcctgggctcaagtgttcctcacaccctagcctcccaagtagctgggactacaggtgtgtgccaccacacctgggtaattttttattgtttgtggagatgaggtcttgttctattgcccaggctggtctcgaacttctggccttaaatgatcctcgtagacacccacctacaa

SEQ ID NO: 523457 - DNA, 343 bp, Homo sapiens
cacatggctgctacagtcctctattaagcaatgtgccacagcaggggtgcctgacccctgggccatggacatgtactggtctgtggcctgttaggaactgggccacaaagcaggaggtgaatggtgggtaacaattgaagcttcgtctgtatttctggctgctccccattgcttgcattgctgcctgagctctgcctcctgtcaaatcagcagcatcattagattcttacaggagcatgaaccctgttgtgaattgcacacacgagggatccaggttgcatattccttatgagaatctaattcctgatgatttgggggggaacagtttcatcccaagaccatt

SEQ ID NO: 523458 - DNA, 972 bp, Homo sapiens
ggaagtaatgaaacgtgaatgtgtgagccccaccacaccacagtgagcctgggcctgccaatggtggctgttaccatgctatgcatgcatgcatgcatgcatgcatgcatgcatccccatgtgctgagaaatgtccccaccaccaatgtccacatctctgtgcacggaatgacaatgacggaccaaggaccatgccatgatggcagcatgccttgagtccatgctcatgatgtcccagccagatggcagcctcctgctgccatgctccctgcgggaacctgtggctagacgatgcaaactgaacgatggacgatgcgccatgaggtagcgaccgcatggactgtggcctgcaaacgtccgggtggagcagcggctacttctctctggagcaagaccaaacaggcacttgaaggctgaagaacagcatgctgcccccgtcgcatctcccctcccacccccagcaccccgccaaacacacggacgatcaccaggctgactctgaccagctccgacgcgacctcggacatcgacaagcgcacagacacactggcagaccaatgcccgatgcgcgacctcaccatccagccaccacacgcccacgccccgccagcgcaccaaagacgcgacggtacccttaacgcacacccggcccgaccctgctcgaaatccccccaccacggcctggcccgacctcacaccacctactcacggacaccgccccagccggccccacaaccctgcctccgaccttcgcccgcaaccaacagcctgcaccatcactaccccccacccccctccttcctcaccccccccgacttgcgctcggtcgaacctgaactcgccccgccttcctcccactgtccccacaactctcccacgtcagacaaccaccgccccccacatcacccacaagccctcccccgtccaccctctgcgcctaacaccatctgagtccgccggacattgcacccg

SEQ ID NO: 523459 - DNA, 850 bp, Homo sapiens
  misc_feature (444)..(444): n is a, c, g, or t
agcggagggggccgcgtagcggacatggcgggctcccggctcccgcggcagctcttcctccagggcgtggcggccgtcttcatgtttgctttcgcttccctctacaacgcaaatcccaggcctgtatggccccgagggcatcctacctgtcaaggaggacgctgctggtcctcagggacaatggggcgctggcagcagctgtgggagaccccgacgctgctgtgggaagcgccgagactggaggctggacactggtccagaggacctgagatgactgcatgacgccgtgactgagggtgcacatagatgagcctctagggacgcccgtgcttgcatggagacccagcgtgacagaccagaccctgtcagtcatacattgcgtgcgtttcggagcacagacgctacacgtagtacagcgctgccgagggtggggccagggatgtnaccattgtgattgtccgatgtgggagctctcctggcttgctagatgactgggacttccatggcgcgtggctgggtggagtccgcagcttgaaggccaagccttccctagccggcaaggcaggccccaccaagggcgagtgcagtgcgagggagcccatgtcccaacggatagaccatccccgttctgagctggtgcagatggctgcttgttccagcactcgatgtacgccgtcaggcgtggtcaagctgaccagccagctgacctgcagtggtgggggctcagctgacctcaactctaccactactgagacccagttgcctagccacgcccgccgtctggttctgacaacagctgccggtctggctgcacaagctcagcagtggtggacaccttcctaattgagag

SEQ ID NO: 523460 - DNA, 203 bp, Homo sapiens
  misc_feature (79)..(79): n is a, c, g, or t
  misc_feature (163)..(163): n is a, c, g, or t
  misc_feature (201)..(202): n is a, c, g, or t
cgaggatccaaataccatgggagtcaagcatgcctcgatagccacagatttacaagaattacctacagtttgcttcttngaatcgacatgcaaatctgcttaaggattctcacattcaggacagagaacaaattttttaatgaatccatccaacaggtcttgnagtttattcgcctcatgagatccattgataatggaacnnt

SEQ ID NO: 523461 - DNA, 248 bp, Homo sapiens
gggaaaacccggacgatcatcgcagaaaataaaactgagttaagggcacattactgacatgtatagagtcagccaatcagcaacagactgctgatagttctgtccccaccttcacccccacctcccctgtggcttatagaaactctaacttatcctccaagactctgctcaggaatcacctctagaaagctctccttgccctccagccttccaagttgaattagggtggagacaagggtagagccgag

SEQ ID NO: 523462 - DNA, 152 bp, Homo sapiens
tgaggggggtggtactgtatggatgctatgattcattctgctttaaacaattgcaaggaatgaagtgcatcgacttgtcagtggttcttgcgggtatatacataggtgtgaaagtcatgggcatgttcagtaattttgttttaagcttatga

SEQ ID NO: 523463 - DNA, 883 bp, Homo sapiens
cgtgacagtttgcgcagtgtttgctatggtgaaataggttgtgtatagtctcgttagctctattgtgtgtttgttgtgtccgtgtgaattgttatggtagtacttgctctgtacgtctgtggtggtgatcttgtgtgtttgtttgctcgtgttctatatgatagtggttggcgtcgctagtcgacgatgcctcggggacggtcgtggggcacgccgtccgccttcgggtgttaccgccccgctgggtgtttatcgcgccctctattggctgttttttttccccccaccccattgtccgccccccgaatcccttgtgcgaagaaacggctcccccaattttcttttgaacaaacaccaaaaccaagtttttaccagtgccccgggtcccccaccaaaaaattccggcgttttctgcccccttctccctggcggccctacattagcttccattagcgcacaccttatttccgcaacattccggaaattacgcggttccccctttgaagcccataaccctcctgtgctgcagtaaacaggtaatattttaaatgtattctcttctctggaaaaatccacaacaagtgcgcgttaaaattacccacagggaggtcaacacctttcaataatctctatacgctagtgccacaaacatagttttgttcttttatttaaaatatgattatataaaacgtttctcctctcttttgtgttcccaaataaacagccattggtgtgaatacttccacgatccaggaagaaaacctttgcaataaatatcagtttttagaccccaaaaaaagataattgcaccctccctccccccctcaacaaacaatggggaaaaaaaaaccccccaaaattgggtaatcccccccacaaaaaa

SEQ ID NO: 523464 - DNA, 422 bp, Homo sapiens
tgcattataaataaaattgaatacgttcccacactctacaagggggacgacatttacgtccagagaaccataaataactcgaaacaccctgaccaccttcgtcctgtggaccttgacgccgtttcatcctcttctttacccctcctgagcccaccccctcctgcagggccgaccctacttcagaccaccacccagcattcaaatcctccactgacgtaggaggtcgtagagttgaggcagacagatgacacactctgaagccgcctggtaatccttactctaggcactctaggaaggtagaagaacttcagcggaaatcccaccgacgctccatctcccaacccccaaccacccgacagtgcctcgctgatagctgtagcggatcatacaagacacttgtgtttattttaactaaatgacag

SEQ ID NO: 523465 - DNA, 227 bp, Homo sapiens
agaagcgccgaaggttctcctctaggatatatactatggactctgagaacttgatcatagagataaacctctactcatatatcatctaccaggaacatcactctcagtttgtccacctcctgagagagccacactttctcctggatccaataggaggccataggctggcagttggagtccagctggcctgccagggcctcctggagcactttggtctctgtctccgc

SEQ ID NO: 523466 - DNA, 507 bp, Homo sapiens
  misc_feature (393)..(393): n is a, c, g, or t
  misc_feature (419)..(419): n is a, c, g, or t
ttgtcccagctggtctcgaacccctgggctcaagcaatccacccatcgtggcctcctgcagtgctggggttataggcatgagccaccttggcctgcataattcttttttttttttttttttgagatggagtttcgctcttgtcgctcaggctggagtgcaatggtgcgatctcggctcaccgcaacctccacctcctggattcaagcaattctcctgcctcagcctcccaagtagctgggattacaggtgtgcaccaccatgcctagctaattttgtatttttagtagagacggggtttctccatgttggtcaggctggtctcgaactcctgacctcaagtgatctgtccacctcggcctcccagagtgctgggattacaggcgtgagcaacntgtttcccagcaggaatttctttttnatagtattggataaagtttggtgtttttacagaggagaagcaatgggtcttagctctttctctattatgttatcatcctccctttttt

SEQ ID NO: 523467 - DNA, 412 bp, Homo sapiens
tacaaatatacctaattgatattttaaacttttgtttgtgtgtgtgtgtgtgtgtgtgtgtgtgtgtgtgtgtgtgtgtttttcttgagacggagtctcgctctttcgcccaggctggagtccgtggcacaatctcggctcactgcaacctccgcctcccgagttcaagcaattctcctgtagtcccagcactttgggaggcgaggcgacaggattgctggagcccaagagtttgaaaccagcctgggcaatatagcgagaccctgtctccacaaaagaaaaatttttttaattagcctggaggcgtggtgcgcacctgtagtcccagctgcttgggagtctggaggatcacttgagcagggagtttgaggccacagtgagctatgatcgcgccactgcactccatccagcc

SEQ ID NO: 523468 - DNA, 343 bp, Homo sapiens
  misc_feature (311)..(311): n is a, c, g, or t
gtactataactgatctatttgaagaacaaaattgttaattggaagattaaagagaatatttcacggggataaaaggacaaggaaatagcaaatataaaagaaaaattgacagctatcaaatacagaaataaaggtattgacatccagaagataggaatctaagaagggagataattttttttaagtggagaataaatacttaaagggataaaagggatagttttctagaattaaagcgagagagaaaagagagaggtgagaaatttcagattaaaaggagttcagagtcaagagagaagaaagaaacacancatacgttaaagttaaagtacaacctgccggt

SEQ ID NO: 523469 - DNA, 279 bp, Homo sapiens
acggttagtatccgtcgctctagtggtggtgcaccgggcacacagtaggcactcaataaatatgtatggataaaaaaaaaaaaaaaagggtaggaaaaaaaaaaggaaaggaaattaaaattaacaccccttgggataaaatgggggaggcttctcagaaggatatacgggtgagaagcaaccagggggcacacacagggttaacaggtttagggttttaaaaacccaggtaccacacaaagtgtataaacgcccgggcaaggcaagtcaccaacggga

SEQ ID NO: 523470 - DNA, 116 bp, Homo sapiens
gatgcttacctaccacggacgtctccaccagaaaaccatcgccaacgtccgtgcgactcagcttgtgaacttacaatacctgtgtttaaaaagctgctttacatggactgtctgtc

SEQ ID NO: 523471 - DNA, 639 bp, Homo sapiens
aatctaagggtaaatggattacctaaaaaaaaaaaaaaaaaaaaaaaaaaaaaaaaaaaaaaaaaaaaaaaaaaaaaaaaaaaaaccttggggccggcctgggccaggcggcctttggattggggcaggttttggctggcggccgaatttggggctcattggcccatttccccttatggggggcggaataccatttaatggcccgaggtttaacacggccgggctgggaaaaccctgggggttccccacttaatcggcttggcggaaaatccccttttccccggcgggggaatttgcaaaggggccggaccggatggcctttccaaccagttggcaaccctgaagggcaatggaaattggaaggcgttaatatttggttaaattcggggtaaaactttggttaatcaagctaatttttaacccaatggcccgaatcgggtaaattcctttataatccaagggattagccggggatggggtggagggttgtccaggttggaaccaggaaccccttattaaggaacgggggctcaaacggcaaggggccttttgggggcccggttccggaaggcccttaattggaaccccttaggggggcccccctttaagagtttgcccggaaaggcccggtaaccgtct

SEQ ID NO: 523472 - DNA, 1326 bp, Homo sapiens
gatttgcccgtactcagctcgtgtatgtggtttgcggacctggatcaacgtcattcaggcagcagcttccagaagctcttgggaagataatcaagccaaacacttgtaattcgattgggggttgcaaggaattatttctttgctatctctagcaagcccctggaggactcctcaagagctcttcgtcagcactgtgtgccctccgttgagttacgcacagatctatcgtaggattcgatcgttgactctggcggctcgggttcctagaatagcgccctggtaggttcccgaggcgtcttagcgaatgaagctaatacaggaggttcccaaggcatcagcttccttgcctatgtggacagtgcttcttgatagctccttattcgcagtcttgcagatgcggtgacaacgcacggaatacaagcgtcacaaaggcaaggcaactagatttcaagcccagctggctctacgaaagggcaaacctcttcaagctggacaaggcgagctgcacttaaagcgtaatctaatgcataaagcccggtgctcacgtacctgtttacttacacatcgtcctgtgtgtaaatgcatacgcattcgggaacggtatgaagggccttgcaaataccagaggtcttggaataccacagagcccaagtataaattacaacctaattcacacgacccgaacttgcgcggttcggaatgcccccagtagcgctaggacgatcgcaagtcgctaaatggatcgaagattaacagtcccagcgtcatgtccaagcctgtgggagccctttagaattgttcttgcacgttaataccttggtgcgcaagaagttccccgtaatgaactcagacaatagggtcagtggggacctttacttacaatgacccatagaggttcgaaggacttcaggaaaaacggctgtctaccatgcaaaggcttccttctgtccattgaaggatactggcttggcttggacatgtccacgagagggaacacccccaggggtcattaatgccacgagaaggcaacggcgtcacttttacatggcaactttctttggcgaagagtcaaaccccccgtgaagagagttcacgcaagtacccgtctaaaaactccagttaagcacgaggggacagtgtggcggagacttgttcccatgtggcgtcgtcgacaatagaggtggggactgcaacacatggttgacactcatccttgccgggccatacattcaggagagaaaaacccggatcttgggaagatcacccagtgtagaaggtatggctgtggtacccgggacgagctcctaactgacaccaagtgtcaaa

SEQ ID NO: 523473 - DNA, 239 bp, Homo sapiens
aatgagacacaacattattttttaacattttgaaacgagattgcaatggttaagagcctgaacgaattcctatcctggctctatcatttgctagttgggggatgtgggcgaattaccttacccctttgagtctcactccctcatctgttacagtgagaataataataatcctagaatctgccgcatggctgtgattgagaacatgcgtgtcaaacacagcacattgctggctgtacatt

SEQ ID NO: 523474 - DNA, 144 bp, Homo sapiens
agttgggtggtttggtggggaagaagggttgattttttttttttaatagagccagggtcttactatgttgcccgggctggtattgacctccgggcctcaaacgatactcctacctatctccccttttatactaatattttttta

SEQ ID NO: 523475 - DNA, 375 bp, Homo sapiens
gtgatgggcgacgtgtggcacgtgctgaagacacactgttcttcctcgagggatattcaacatggcgcctatttcccagacctcagcccgagtgtcagccactgtacagttcggaaacagaactgtataggagaagagcggagagataagggccagtaaagggctgtgtgcccagcctatggcccatgtactttctcccaggccacaaatacgcttacctgactggacaatgaaaggtggacttgcagcactagaatggcactgtggaaaaatgaccagggacctctctgccactctctgtgcttgcttaagctctagtaacatctctttgaagcttcaatcccctggactagggacccctaacctcaaatccca

SEQ ID NO: 523476 - DNA, 231 bp, Homo sapiens
cggttgatccagaaaataaccaagagacagaaacggtgcgctacagaagccgctgacaccatggaggtgtgttattggcaagaaaagagacgtgacggtgcactgaagctctagaggaattaatcacaatagacaagagaaagaatggagaacgtgaaacaagaagatattgtgagaaagccaggatggtcagaaagatggcaaaagaaagagggaaccgtcgatcgaggg

SEQ ID NO: 523477 - DNA, 309 bp, Homo sapiens
gagggttcagctgtctcttacttttaaccagtgacacagcaagacgagaagaccctatggagctttaatttattaatgcaaacagtacctaacaaacccacaggtcctaaactaccaaacctgcattaaaaatttcggttggggcgactcggagcagacccaaccctcgagcagtacatgctaagacttcaccagtcaaagcgacctactatactcaattgaccaatacttgccacggacagttacctaggtatacagcgcatcatttcagagtccatatcacatgggttacgcctcgatgtggatcag

SEQ ID NO: 523478 - DNA, 169 bp, Homo sapiens
  misc_feature (61)..(61): n is a, c, g, or t
  misc_feature (85)..(85): n is a, c, g, or t
  misc_feature (163)..(163): n is a, c, g, or t
agacttgatgttgctctgctcagaactcgaattaatgaagatatgcccacattgtgtgganccctgaaacatcaaaggctggcancccgctgacctgccagccccttgcttcccaccgcacgcggtggccagccctattcaatcccgaccttttcccctgtanccgcaa

SEQ ID NO: 523479 - DNA, 126 bp, Homo sapiens
catgttggtggtgatcttgttgaagtgttgggtgatcctgatcatggtgggatgtatctgtcttctgggcagcatctccctgtgtgtgatccatcagccagtggagacatgggaccatggcagcac

SEQ ID NO: 523480 - DNA, 138 bp, Homo sapiens
aaaacatgccacctcaaggctgggcgcggtggctcacacctgtaatcccagagtgctgcaattaacaggcatgagcactgcacctgtcctaaaaaaaaacacaaaaaattttttttaaagagagggtcttgttctgtc

SEQ ID NO: 523481 - DNA, 217 bp, Homo sapiens
agtgctgatggtacgcacccgtcttcctgtacaagcctttcctcagcatcacaggtacaccaccccgtcttcttgtcaccggagcttcctcagtatccacaggtcacgccaccccgtcttcctgtcaccgacacttcctcagcatccacaggtgacacaacccgtcttcctgtcacggacacttcctcagcacccacaggtcaggccacccctcttc

SEQ ID NO: 523482 - DNA, 405 bp, Homo sapiens
gctcgaacgaccagctatctgagtagctgggactacaggcgcgtgcccctatacctggccaaattttttttgtgtgtatttcttttagtagagtcagggttttactatgttggccaggctggtatcaaactcctgatctcaagtgatccgctggcctcggcgtcccaaagtgctgggattacgggcctgagccacagcgcccagcccattttggattttggattttcagattacggatgctcagtctgtagttggaatcaatgcagtctgtagccttttcagactggtttctttcatttagtaatacacatgtaagtttcctctgtgtcttttaatgacttgatagtttatttctttttggtgttgaataatattctattgtctagatgtaccacaatttattta

SEQ ID NO: 523483 - DNA, 317 bp, Homo sapiens
tcagtgaatgtctggcacattgcaatcctcaaacatgtggttatcttggtggtatgggcataatcagtgacttgtactttcagcaatagcattggagcaagttttatcagcaagcaatatttccagttaataaggttctcaaaaatcatgtagggattaacacttgctgattgtaaagattgaacctcaagttcccgtgtagccctttagataagtggctatagtgggtatttagttatagaatgctagcacgtgctgtggtgcgtgggcaatatttcggaattttattaaaattaaaaagttgaacgtgcacagtc

SEQ ID NO: 523484 - DNA, 278 bp, Homo sapiens
  misc_feature (249)..(249): n is a, c, g, or t
atcaaagattcaacacgagaacacaaccggctaagagacgaggtttcatcatgttgcccaggttgaccttgaacttctgagcatcaagtggtccttatgtcttgaacttccaaagtgctgagaatacaggcatgaactaccccaactgggatatgtcataggtttgagagtttgaattctaaccttgggacttttggtaacttatttataatattctaggaatatacttttattaggatgagtagaaanttcatttagacagagattattataaattt

SEQ ID NO: 523485 - DNA, 651 bp, Homo sapiens
cgccttaattgaaatgtgtttggaggcggggatcagcagaggatgtcatgacagtgctcacgccactaacagagaaggattatgaggggtagaagagggtgccgcgggccttacaggcccataagatggcctggcctttccttgaaccagtagaccctaatgatgcaccagattattatggtgttattaaggaacctatggaccttgccaccatggaagaaagagtacaaagacgataatatgaaaagctgacggcaggggtggcagatcatgaccaaaatttttgctcaactgtcgttactacaatccaagtgactccccattttaccagtgtgcagaagttctcgaatcattcttcgtacagaaatggcacaggcttcaaagctagcaggtctcataacaacaaactgcagtctcacagcttcttcaccgttcagcgtgttaacctaacataaaacacagcaagaatctggtagtctgaactattttaaattaaggagccagatgtttgcagtcaggctatcctgacaagacttgacctaaacttcgttttcattggtcatcccagtccaattatatgctaggccaatttttgtccaacgaacaagcaaaacgcaaagcaacgacaccattatctgatcaagatcagat

SEQ ID NO: 523486 - DNA, 256 bp, Homo sapiens
cccagcttcgcctggacaccgtcaccatgcgggctgtgcggagacacctggtcccccagcactcagcccctggccgaggtgccgcctgctagtggctgagcgacgatggctactggactgactatgatgcctgcgtctgcgactatctggagcagcaggtggccagtgacaaccagctcgcgcgcttgtccctcctggggtacatctacactgtcaactacaccacccacactgcagaccaacaagactaccagcg

SEQ ID NO: 523487 - DNA, 419 bp, Homo sapiens
tgcatagctttcagtccacgttaaataaaaggtaacggggactaggtttctccgtttgccgagactcctcaggcacattcactatacatagtaagtatattggtgagtggagccatactagtattttcacgctagtagcctctgtgccatgtatatgagaggagagagtaggcactgtatacgtcttcaaaggaaaaagcagtcacagttgctagggatttccacatacactacttgtgcctaaggcttactctcgaatgagaggatgcctagtaaagcatagcctgttctataccccaagttgtccagagtacctcataaagcccttcaaactacaatttcgccaaccttccatttttggtgggaacccatattcacacctcctccaccagacgctgctacagtgtaagggaaagctt

SEQ ID NO: 523488 - DNA, 279 bp, Homo sapiens
gaatccccgcgaccagaacaggcagcaataaatacaatagcccttccacacattttcacaggtggaccctgaggtatctgctgcccttactgctgaacttcagagagagccgacagcagcgtatgatcaaagacaaaggctggacgagcacagcactcaccagcagtcagccagctcatctgagccaaacaattctttacttcatctaaaggcagcactgaaaggagtgaaaacagaagacgttctagcaagggataacaaagcagaggagaacgctga

SEQ ID NO: 523489 - DNA, 689 bp, Homo sapiens
ttgtgtaagcacacggtctcgttctcccccacgccgggtaggttttccttaccgtttgaatggtgtgtttgggccagatagttcaagtttctctgggcggctcctgggcatagatcaattttgacaggtccgcccgcgcggagtcaacacatcctggcgtttatccatcctctccacgcgcggtggtagtcttccacgcggtggaatgttccgcgcgttgcctctcacgctagttggcctggtagacgccccttctgtgcgccccgctgttgctcgttctctgtcctcctgtacagcccactgcttattgggggtcgctccaccctctgttcggaattgcgtgcccacggtgagtatccagcgttcgtcttgtgccgcgcgtggcacgcgcccactttgtctccgctcaccccccggtgtgatagagtagaacgcctctgggtgtctcacccgccatccgcctcccccagcagattttgagtcgccccgctttgtcttgttagcttcgcacacattgtttgtcacgcacacaggaatgtttcccgccccccgggagtctgagaaggtattgtctgtggaggtcgatggtctgagacgagttgttcatgcgtctaatgggcggcgccccattgtgtctccacgcttgattagaaaatgctcctctcgcccacccccgatcatgtcagaga

SEQ ID NO: 523490 - DNA, 146 bp, Homo sapiens
tgatagtgtaatatcttgtatggtgacagatggtaactagacttgtggtgatcattttgaaatgtatagaaatatcaaaccactatgttgtgtaacaagaaactaacatagacattgtagggtccatatatagcttcaaacgacaa

SEQ ID NO: 523491 - DNA, 164 bp, Homo sapiens
  misc_feature (81)..(81): n is a, c, g, or t
gcgaccacactactactactcttcttctccttctccttctagaaccgtgtgggatactcgccttggcatcacccaggtttngcccatccgtcaacccaacacccactctcatcacacactccaccacacacaggcaacactgtcagctgcacaccccaccagca

SEQ ID NO: 523492 - DNA, 168 bp, Homo sapiens
cttgaggatcccctatacaccgtacagcacgcagcagcagcagcagcagcagcagcagcagcagcacgagtaactctgacttaggaatagagaccgccagagagcaatgtgatcaatgaacggaacatctggagtgtgcgtgcttcttcagagggacgggtggtatag

SEQ ID NO: 523493 - DNA, 349 bp, Homo sapiens
ggccttaattctcccaattctgtgaagggtgagagaagtaaggaagctgcagaagaacagttggaagctaggaaaggttggcgtgtgaggtttaaggaaagacaccatctctatagcctaaaagtgcaatgtgaaaccacaagtgctgacacagaagctgcagcaagttatccagatatctagctaaataattggtgaagatgactacacgaaaccacagattttccatgtagttgaacttaggacttccttagaaaggagaagtcattgcctggctctaaagcttccaagggcagattgactctctcagtagtggctatgcagttggtgactttaagttgaagccatt

SEQ ID NO: 523494 - DNA, 1068 bp, Homo sapiens
ctgctggtgaaaagcttctccgagagtggaatcatactatgaaacttattaattcatacgatgagtggatagcccagatggaaccagatgggactgttgctgacatcagttggagatacgatctatggggtcgagacgcgaattcttctacacgaaccacgagagaaaaatgttgggagctacgtgaactgctgtatattcatggattgagtacattgccgagctaggagaactatcatcagtatatttattggcatgcttgatctctgctacaggcatgcctagaaaatttattcgctgaaatttattacgtgaatgccacaaggcacgggctaatgtttgatatttgttctcctggaaactcgcttacataccgtgaaaatcggaagcgtgctatcatggccttggcggagtttcgatagagagaaaattgacttaaggtccacgcgcgctgggagcccaatttccctataaactttcaagaaatctgtgcttggagcaacccaggtaggccatcttgatttttagcacagggaacagtttccacagtttagacccgaatgaagaagttcttaagatagaaattcttaggtgagcaaagcccatgggtggtttccgctaagaagggcttaactgtcgcttaccccagaatgggaccaattggcattgtgtttcagtgcggccaggaaccacgtttcgtagttttttccttattttgggccgaagggcttttcccaacttattccggttttcggggcgaattccagacgggtcaataggggggaaatccccacaggtgtgtggcaaccgcagacacttggaaacagtacccttatccttctcccctgtaagaggggagactcagattggaaaccccctcttaattgcgttagcttaaccctctagacagcggaaaagggatttcctcctcaatttgtgaataagccaaaagcgtttcccactttgtcggggcgttcttataccacatgttgacatgaaaacgcgcgtgtttaacccggagcttgcggctttaacacaagttgtttcccccccttaaagagctcttta

SEQ ID NO: 523495 - DNA, 3788 bp, Homo sapiens
gcggccgctcggcggccgggggtcccttcggtggggccgcggctccccgcccgccgcccccgcgcgtccattcgctttgtgtcccgcgcgcggccgggccccccgcgcactctcagccctgcgccccgcggcccggcgggcggctcccggcgcggccccagcagcccgcgccggcattgtgtggacgcgcccggccgcgagcgcgcgcgcgggccctgccgagcgcccccggccccgtccgctccggccgcggcgcccgcgcccgccgcccccgccgccctcgccgcgcggcccccggcccggcccggcccgacccgggcagcgcagcggcggggcgagcggcggcgcggcaacatggcgacggtgcccgtgtactgcgtctgccggctgccctacgacgttacccgctttatgatcgagtgcgatgcctgcaaggactggttccacggcagctgtgttggggtggaagaggaagaggcaccagacatcgacatttaccactgcccgaactgcgagaaaacccatggcaagtccacactcaagaaaaagcggacttggcacaaacacggccctgggccaacaccggacgtgaaaccagtgcagaatggcagtcagctgttcatcaaggagctgcggagccgaaccttccccagtgctgaagacgtggtgtcccgtgtgccaggtagccagctcaccgtgggctacatggaggagcatggcttcactgagcccatccttgtccccaagaaagatggcctgggcttagctgtccctgccccaacattctacgtgagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatacgaggtggaaaggaggttgaaacttggcagcctgactcagtttcccaactttgaaactgcgtgctggtacatgggaaagcacctattggaggcgttcaaaggttctcacaagtctgggaagcagctgcccccacatctagtccaaggagctaaaattctcaatggtgctttccgatcgtggacgaagaagcaggctttggcagagcatgaggacgagctcccggagcacttcaaaccttcacagctaatcaaggacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaacaaagagcaagtcagaagccaagtggaaatacaagaacagcaaacctgactcgttactgaagatggaggaggagcagaggctggagaagtcgcccctggctgggaacaaggacaagttttccttttctttctccaacagaaaactcctgggctccaaggccctcaggcccccgagcagccctggtgtgttcggcgccttgcagagcttcaaggaggacaaggccaagcccgtgcgcgatgagtatgagtacgtatcagatgatggggagctgaagatagacgagtttcccatcaggaggaagaagagcgcccccaaaagggacttgtccttcttgttagacaagaaggaggctctcctcatgcccacctcgaagccaaagctggattctgcggtgtacaagagcgatgactcctctgacgagggctctctgcacatcgacacggacaccaagccaggcagaaatgccaaagtgaagaaggagagtgggagctccgcggccggcatcctggacctgctgcaggccagcgaggaggttggcgcactcgagtacaaccccaacagccagccccctgcctcccccagcacacaggaagccattcagggaatgctctccatggccaatctgcaggcctctgactcttgcctgcagaccacatggggcacggggcaggccaagggtggctcactggcagcccatggtgcccggaagattggtggtggcaacaaaggcacaggcaagcgcctgctgaagaggactgccaagaacagtgtggatctggaggactacgaggagcaggatcacctggatgcctgcttcaaggactcagactatgtttacccctcactggagtctgacgaagataaccccgtcttcaagtcccggtcaaagaagaggaaaggctcagacgatgctccgtacagccccacagccagggtcggtccatcggtgccaagacaagacaggcctgtgcgtgaggggaccagagtggcctccattgagacggggctggcagctgctgcagccaagctgtcccagcaggaggagcagaaaaacaggaagaagaagaacaccaaaaggaagccggctcctaacactgcctccccctccatctccacctctgcctccgcctccacgggtaccacctccgcctccaccacgccagcctctaccaccccggcctccaccacaccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgtacctcccagcccatggcccctggggtctttctcacacagaggcggccttccgcatcgtctccaaacaaacaccgctgccaaaggaaaacgtacgaaaaagggcatggcgaccgccaagcagaggcttgggaaaattttgaaaattcatcggaacgggaaactactcctctaagatttggaaagccaggatccttctgatatgctaaggacccccggagccccgctacatcagcccctcccaggacggtggctgtgccgcctggcccggggagggcttgcttcattccgaccaattttccaatcaa

SEQ ID NO: 523496 - DNA, 162 bp, Homo sapiens
aacctgtggtaccctccaggagagtggagtaaggcactaggagggcgtcaacccccaagcagaacacgagtataagtgagtgcgcaagagggtacaggaagaaattttgcgagctgcccacagcaacaacacaacaaccgaacaaacaagcaccacaacacc

SEQ ID NO: 523497 - DNA, 5556 bp, Homo sapiens
gcggccgctcggcggccgggggtcccttcggtggggccgcggctccccgcccgccgcccccgcgcgtccattcgctttgtgtcccgcgcgcggccgggccccccgcgcactctcagccctgcgccccgcggcccggcgggcggctcccggcgcggccccagcagcccgcgccggcattgtgtggacgcgcccggccgcgagcgcgcgcgcgggccctgccgagcgcccccggccccgtccgctccggccgcggcgcccgcgcccgccgcccccgccgccctcgccgcgcggcccccggcccggcccggcccgacccgggcagcgcagcggcggggcgagcggcggcgcggcaacatggcgacggtgcccgtgtactgcgtctgccggctgccctacgacgttacccgctttatgatcgagtgcgatgcctgcaaggactggttccacggcagctgtgttggggtggaagaggaagaggcaccagacatcgacatttaccactgcccgaactgcgagaaaacccatggcaagtccacactcaagaaaaagcggacttggcacaaacacggccctgggccaacaccggacgtgaaaccagtgcagaatggcagtcagctgttcatcaaggagctgcggagccgaaccttccccagtgctgaagacgtggtgtcccgtgtgccaggtagccagctcaccgtgggctacatggaggagcatggcttcactgagcccatccttgtccccaagaaagatggcctgggcttagctgtccctgccccaacattctacgtgagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatacgaggtggaaaggaggttgaaacttggcagcctgactcagtttcccaactttgaaactgcgtgctggtacatgggaaagcacctattggaggcgttcaaaggttctcacaagtctgggaagcagctgcccccacatctagtccaaggagctaaaattctcaatggtgctttccgatcgtggacgaagaagcaggctttggcagagcatgaggacgagctcccggagcacttcaaaccttcacagctaatcaaggacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaacaaagagcaagtcagaagccaagtggaaatacaagaacagcaaacctgactcgttactgaagatggaggaggagcagaggctggagaagtcgcccctggctgggaacaaggacaagttttccttttctttctccaacagaaaactcctgggctccaaggccctcaggcccccgagcagccctggtgtgttcggcgccttgcagagcttcaaggaggacaaggccaagcccgtgcgcgatgagtatgagtacgtatcagatgatggggagctgaagatagacgagtttcccatcaggaggaagaagagcgcccccaaaagggacttgtccttcttgttagacaagaaggaggctctcctcatgcccacctcgaagccaaagctggattctgcggtgtacaagagcgatgactcctctgacgagggctctctgcacatcgacacggacaccaagccaggcagaaatgccaaagtgaagaaggagagtgggagctccgcggccggcatcctggacctgctgcaggccagcgaggaggttggcgcactcgagtacaaccccaacagccagccccctgcctcccccagcacacaggaagccattcagggaatgctctccatggccaatctgcaggcctctgactcttgcctgcagaccacatggggcacggggcaggccaagggtggctcactggcagcccatggtgcccggaagattggtggtggcaacaaaggcacaggcaagcgcctgctgaagaggactgccaagaacagtgtggatctggaggactacgaggagcaggatcacctggatgcctgcttcaaggactcagactatgtttacccctcactggagtctgacgaagataaccccgtcttcaagtcccggtcaaagaagaggaaaggctcagacgatgctccgtacagcccacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccgcctccaccacgccagcctctaccaccccggcctccaccacaccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgtacctcccagcccatggcccctggggtctttctcacacagaggcggccttccgcatcgtctccaaacaaacaccgctgccaaaggaaaacgtacgaaaaagggcatggcgaccgccaagcagaggcttgggaaaattttgaaaattcatcggaacgggaaactactcctctaagatttggaaagccaggatccttctgctccgtcaggacccccggagccccgcgaaaacatctggctcccaggagggtgccgagctggctcaaccagggagggccttgcctcttcccggtggcattcttcccaacaagcgtctgtgccttcagcgggcaagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccagtgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggacaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacag

SEQ ID NO: 523498 - DNA, 2580 bp, Homo sapiens
agcggggggtgggggcaggtagccccaaaccaggaggggtggacaggctgtggcctacagcttgagggggctggcccttcttttccacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccgcctccaccacgccagcctctaccaccccggcctccaccacaccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgtacctcccagcccatggcccctggggtctttctcacacagaggcggccttccgcatcgtctccaaacaaacaccgctgccaaaggaaaacgtacgaaaaagggcatggcgaccgccaagcagaggcttgggaaaattttgaaaattcatcggaacgggaaactactcctctaagatttggaaagccaggatccttctgctccgtcaggacccccggagccccgcgaaaacatctggctcccaggagggtgccgagctggctcaaccagggagggccttgcctcttcccggtggcattcttcccaacaagcgtctgtgccttcagcgggcaagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccagtgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggacaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacag

SEQ ID NO: 523499 - DNA, 276 bp, Homo sapiens
  misc_feature (33)..(33): n is a, c, g, or t
  misc_feature (200)..(200): n is a, c, g, or t
  misc_feature (207)..(207): n is a, c, g, or t
  misc_feature (238)..(238): n is a, c, g, or t
ataaggtattaaacaactattcttgtacttganttaaaaaaaaatcaagctgggtgcaattgctcatggctgtaatcccaacactttgctagggttaagtgagaggttcagcccagaagttcagtaccagcctgggcaatatagtgagaccccttctctacaaaaaaaatgaagaaattagctgggtatggttgcatgtnctgtggncccagctcctcgggaggctgaggctggaggntcacttgggcccagaaggtcaaggctacagtgaacctt

SEQ ID NO: 523500 - DNA, 255 bp, Homo sapiens
ctctagagtatcccctaagtgtgctggcaccagggtggaatgtacacgcaactctggagtaggctaaatttattaatgttggcccactatacagaagattctgtgattcagcgattgtatgtcaaagtttttacaaacgggctccaaggcgttggtttgatcggattacttgagttcgttggtctggttgcttgcttgacttgcttcgcttttctggttttttttgttgcttgcattgctttttgtgttacttgg

SEQ ID NO: 523501 - DNA, 411 bp, Homo sapiens
  misc_feature (78)..(78): n is a, c, g, or t
tggctttcagtcgcgtgttgctcttcgcatttcctaaagttcctgatgctatgattctggtttttgtggtgttttgcngcttgtgtgtgattgattattggtttgtttgtttgaactaagtgggactataaatgtagatagatgtgttttagtaccaagatgttcttttttcattatcagtctttcagatgtctattttcttgctgaatagcagaggactttatttccacctccctataaagtgtgagcactgtgtttcagcgagctgcattgcgtacttttgctgaaaacttctctgtaaacacaattgccttgttgagtttcattgtaaactgacctcgccatgcgatgcactgttgatagcttcctgatgtgtggtggataagagtgataaaataaagcttacaaaga

SEQ ID NO: 523502 - DNA, 405 bp, Homo sapiens
cagaccaaaaaaagcccaggagggcaagtttagacacacttttacagttaagactagacatgccccctataagtagataggcaccaccgattatacgccttatagacacaaggcttcgaaaggcaaaacattatactaaagacatacaaccgccaacattgtcctttacaactaagctgtggtattattagtttagattaataaaaattcctatctctaagtaatcaaatacagcaaaatttaaaacctattctgccaaaccataaacagttcaaaggtctgaaaccgtacttatgctttggtgaatgtatggttaaaatacatcactgtttcactccacgagaagtattaatcagagcactcaatacaccggcaaaaaaaaaagttcctttttaaatgaaagcg

SEQ ID NO: 523503 - DNA, 146 bp, Homo sapiens
tcctcttttcagtccagtccctccccttcactcactgcaagaccaccactgtggtgacttttctgcatctcacatgtagctttggaatccatggagtatgtactctcatgtctctgaaattcatccatgttgttgcctacttccgt

SEQ ID NO: 523504 - DNA, 233 bp, Homo sapiens
  misc_feature (36)..(36): n is a, c, g, or t
  misc_feature (65)..(65): n is a, c, g, or t
  misc_feature (113)..(113): n is a, c, g, or t
  misc_feature (126)..(126): n is a, c, g, or t
  misc_feature (173)..(173): n is a, c, g, or t
ccgggatgccaagggcatcagccaggagcagatgantgatttccgggcctccttcaaccactttnaccgggatcactccggcacactgggtcccgaggagttcaaagcctgcntcatcagcttggnttatgatattggcaacgacccccagggagaagcagaatttgcccgcntcatgagcattgtggaccccaaccgactgggggtagtgacattccaggccttcattgact

SEQ ID NO: 523505 - DNA, 969 bp, Homo sapiens
  misc_feature (734)..(734): n is a, c, g, or t
  misc_feature (826)..(826): n is a, c, g, or t
  misc_feature (867)..(867): n is a, c, g, or t
gtattgccaggtcctggtgaatccacatgctcgatcaattagtggcccttctactaggagtaatgtgaaatagatgatcatccctgttatcgttggcaggttgggctctagtcactcactaagcctagttcgatagccgagctacagtgatagagcatgagaatacgtgtgcgactccacacagtgtacgaaggtcatgatattggaatgacagtgttctatggcctcgagtggacattgagatgcactcggcgcttataagcattcgaagaacgcatgagctcaaacatattcatggatatgtcagtaagtctcctctttgctttggatgttatcatcgtacatactctgagtaatagaggctaatagatagtgctttagctggcgcagacattagttatctggtccagttctacgatacagcgacgtactagtatatgcgtctcgtgctcacagtgtggatctcttcttaatagctcgaaggatgaatctcgtttgatctctcagatagatgcaccgtctgatcgactgctgtggcgtgacgtggtattggggggtttcctacagagcagtctgactgtcctagcatagtggagctaaccatgagcggcagtagtgggcagatatccttaaatacagtgtcgaagtgttctatattatcaatggagtagtttggtatgcgataattgctgtttcactacaatctgtaaatttggcagtgcatctggtaaagncctttacatgcctaaagtataggggcaggactattgtgagtcagaactcactagtcatcgagtgtgttcgtaagcaactccgaatgatattntgcacgcacacaaatgctggtatactgtggagaaccgctangttgcacccagaattgtagctttgcagtcgagtcatcccagtttttatagaccttgtacaacaaaggctaagtcaagcatagtccttagggtaacggcaagg

SEQ ID NO: 523506 - DNA, 457 bp, Homo sapiens
ggtctcagctcctgagtggctgggactgcaggcgcgtgccacatgcccggctggttttgcagttttagtggaggcggggtttcgccatgtggcaggatggtctctatctctgacctcgtgatccaacccccttggcctcccaaagtgctgggattacaggtgtgagccactgcgcccggcccaggactttcatagttcgaaaaaagtcaatgcctagcttgaaaggacaggctgactctcttgtcaggggctagtgcagctggtgactttaagttgaagccagtgctcatttacaattcctgaaatcttagggcccttaccagctatgctaaatctactctgcctgtgctctgtaaacggacaataaggcctggatgatggcatatctatttacagcatgctttactgaatactttaagctcactgttgcgacctactgctcagaacaaaatattcc

SEQ ID NO: 523507 - DNA, 617 bp, Homo sapiens
  misc_feature (53)..(53): n is a, c, g, or t
  misc_feature (82)..(84): n is a, c, g, or t
  misc_feature (86)..(86): n is a, c, g, or t
  misc_feature (90)..(91): n is a, c, g, or t
  misc_feature (93)..(93): n is a, c, g, or t
  misc_feature (96)..(96): n is a, c, g, or t
  misc_feature (114)..(115): n is a, c, g, or t
  misc_feature (121)..(121): n is a, c, g, or t
  misc_feature (142)..(142): n is a, c, g, or t
  misc_feature (151)..(151): n is a, c, g, or t
  misc_feature (210)..(210): n is a, c, g, or t
  misc_feature (257)..(258): n is a, c, g, or t
  misc_feature (340)..(340): n is a, c, g, or t
  misc_feature (463)..(463): n is a, c, g, or t
  misc_feature (473)..(473): n is a, c, g, or t
  misc_feature (475)..(475): n is a, c, g, or t
  misc_feature (497)..(497): n is a, c, g, or t
  misc_feature (590)..(590): n is a, c, g, or t
ttatattgggtactcgctctgtcttgagagggctaggtcacggtgcagcctcngataattcttgtagggctgtagtcctatnnnanaaanntntancggggtgatgcccaaatnntactgnttggctgctgggtactacttngacctgcanggcagaatttgtgagaggagctgcagcccaaactcaagaatgggggtagggggaagaanagccagcaacatccttcctccagcttctccaactttccaactgctcnnccacagcccggatttctgttcctctctttcctccaggcctgcaccctcgagcttccagtagggtcaagcctctactgagctnggggaataaaaggggggccatccagtttcagggaggtaccacagcagggagggccggccggttcctgcccacaaacacagcaatcatgaagccctcgaagcatggtctcctcaggagggtgantttcccccancncactggaaaagaggcaagagtngctctggcctcagatgcacgttccaggctcccagggtgacagggtacggctagggggaggaggctcagtccgcccctgaagcctcctcctctnctgcctcaggactcagggagacgcaga

SEQ ID NO: 523508 - DNA, 300 bp, Homo sapiens
ggcaggagactgtggtgtcggtggacgaggtttccagccccagtacccccgagtgccccgagacatcccagccgtgcccttctccgggccagaagataaagaaatcctagcccggtagctaggtcagccgccccaactgacatccgcgcaggactaggataactaatctctgagcttgcggtcatgcctgcaaacgggccgggagctgggggcaaagtagtccgggcgctgaaggctcagtgcccaggatgctggggagtcctgcaccccagaggccgagggccgcctgaggagccatgt

SEQ ID NO: 523509 - DNA, 242 bp, Homo sapiens
cagtgggaagatagtcagtacgatgtgcggtatgatcgtagacaaaggtcaggagccaggccagtgaagccacggcgggaggacaccaacaggaagtcgagggtccaacaccaaggtcagcacgtccagcaacaggcccaacccattcactacgcaggtacactgcctccatgacagggctatggaagttagtccaaagggaagtctggctcctcggttggggggttgccgaagcttgatca

SEQ ID NO: 523510 - DNA, 312 bp, Homo sapiens
gttagactcagtcaggggtgagtttgaatctgcctcctgcaacctcaataatatggtatccatgccaacggaatgtggtctactcccttttctacaaagttcccccttaattggcagtatggtacagttaattggtttccagaaatgctgggttagaatatatgctctgttacttggcacgtatgtaccacggacaatacacttgagttctaaggactctgttactctcattcataagtgacaagagctgacacgctgatcaaggaacaaaccttccaactctaatgttcttctaactaactccctaaagga

SEQ ID NO: 523511 - DNA, 168 bp, Homo sapiens
atccagaggaggtgatggtagcatctctaacaacgtccttccctagttctcgaggccaccatgtaggaagtcttttcctcgatgcagatcatttgggcggagcgatggagtccttagtctcagtcttgaccgatgatgatggagcagaataagtgtttcactcgttcc

SEQ ID NO: 523512 - DNA, 433 bp, Homo sapiens
  misc_feature (166)..(166): n is a, c, g, or t
  misc_feature (174)..(174): n is a, c, g, or t
  misc_feature (194)..(194): n is a, c, g, or t
ctgcaaaatttagggggcaagatcatgaagacttatattcaaataggatatgctctccctcttggaaagtctttttcaggtgctgtttcaatgatacagacttgttttggtcttagcccctgtgggccatagtctatctctgagtctacgtgaacatactgtatgncattttgncaatatattacaggatacanctacccactgtgtatttcaaatggctgtagcctggagaaataaaattatcagaggtggctcaatcttaatgagcttagattttttttttcaaaggtgtgttatggccgggtgcagtggctcacacctgtaatcccaacattttgggaggctgaagcaggtgtattgcttgaccccaggattttgagaccagcctgggtaacatggcaaaaccttatctctacaaaaaataaaagaaaat

SEQ ID NO: 523513 - DNA, 854 bp, Homo sapiens
ccatcaccgcctgtgtcgctccgggagctgccgacggacggagcgcccccggccgcgacggtgcgccggctcgcggagcatgccgttctcaacagaagaagcactgaaggcgtgcgctaccgggcgaggacgagtcccgcactgagcggccaagcaatggccaagggtgctgacccccgatgctgtacgcggagctgtgctgccaaaagcacgccgagcggcttcacgctggacgacgtcatccagacaggcgtggacaacccgggccaccgtacaatcatgaccgtgggctgcgtggcgggcgacgaggagtcctacgaagtgtcaaaggatctcttcgacccccagtcactcgaggaccgggcaccgggggcgtaccaagcccagacgatagacgacagcaagaccgacacgtcaaacccgacaaccctgcagggacggccgacagaaccatggaacgcccaaaataacggtgctgaagcttcgcagggtgcgcacgggccgcagcaaatccagtggattctgactcccccaccccgcacatgccagccgcgggagagcgccgaacgccaaatcgaaagaaagcctcggacggagcgacaagacccatgtaccaacgcacatgggacagcgaagaccaggcgcgcccgaatacctaccgcagctcaaagaagcatgactggcaaagcggatacaaccgaacaacactacaatacagcatgaacaaccttaccctcatacgaaaaagccacgaggtcgccccgagatggcaggacttaggacaattggaccatgactgagacccgtagtccccaaggatagaggacacgaagacaagaagacacccaaggcaa

SEQ ID NO: 523514 - DNA, 153 bp, Homo sapiens
ggtatcagtactgtatcattataatttatatgcaggctccagcgcattctgtgtccacgagaagcggcgaatggcatggctttatttgtttttttatggtttggtttgggtttttttttttttttttgggttcccaagctcaatttcgaactc

SEQ ID NO: 523515 - DNA, 1304 bp, Homo sapiens
  misc_feature (803)..(803): n is a, c, g, or t
gggagctcagattccgcggctagaggtgacctgactctctgaggactcatgatctgcagattgtagaaattgtccccgcagcttattcaattcatgtcgtgaaccaatcagagtcctgtgtgactggagcagcgtgggtcaacatatgcctattcactgcatgtacagatattgagaaaatgggatcatgatctgtttgggtaacaggatcatgcctataagttcattgatgacatgatatgggactagtgcaaccccatcatgatgtggctgtcactggacatggtgtacctaactgggacactgcagaagaactagatgacccattacccatctccatgagaagaatagtccatcgcacacaggatacaatgaagaacgttagccttacaaagtactctgagatgatgagacagattcttgattgggacatccagtgaccaatgaagggaaaggctatgggatgacgaaacaggatttagatgacaagtcatactgtgaacaagtcttcaaaatcccagggatgcaagcacttgagaataaattacgccaaagagagtcaagaacagaggaaaacgctagatggagtaatccaagccagatagacaaactgccgtgacgatgattccaaagataccagagatcccataccattccccaaaggaagaagcatcaagatagcattagaatcgaaaagggaatccacaaagccagacagctaaaaggctcaacattggcaccttcacacatgggtgtgaacttgactaaatggaagtaagagcaatgtcataacacatgaaggnaaacccaataacatcgagatcagtaatccagaatgtcaaccaatgccacaggtgaacatggcaaagggaaacagggcacagctcgggaggtttcattagttaagtgtcattgtaaaaaaatataaaagaatgtcatcacagaggaaaaaaaaattggtggccgaactgtagttcaaaacaagataaagacgaacatggatacgtacaatggaagtgaaaaatatatactcaatgagacagtgatagtgctgaaaaaaaagacaacatattgttatccagctttagggcaaccactgagggaaggagataaccacaaaggtgaagagaatgatagtaaacaaggaaggaaacaatagtaagtgagaatcactgagttagtagagaaggaaagagtaaacaatgatatgaatatagaaaactaaaagagagtagagaatgaacataaaaaatctagagaacgagctagaaggagtgaataaatcaaaatgttagtaacatact

SEQ ID NO: 523516 - DNA, 101 bp, Homo sapiens
gcatacttcctgtctctcacaggtgtgcttgtgtgcaggtgtatgttttatccttgttgaaagccttttgtatcttctatatgaacatgtgggacgtgtag

SEQ ID NO: 523517 - DNA, 519 bp, Homo sapiens
  misc_feature (279)..(279): n is a, c, g, or t
gggcagatagcgaagacctagtgctggtactgagagacttctgggattctttccttgctagtctaagcaccgagggatggtgctcctaaggacgggaaaggtgacatgtcctgctctgctttcgtctctagacgcttcgtagctggtggtgagattctctcgactgttgacggccccagtctactcgcagccaggccaactgccgttctttggtaaggtattaagagtgaccgttgaggcgtggagatgggcgcacaggggggcgacgaacgggttcangatactggtccgagggtgcggaggccaagaagacagtcagagatcacgtcctcaatggcattagtaaggtgtagcgcatttgaagtataccatgtaagtatggacgaaaaagtcgcttagaactagtagtcgaccgatcgacatagcgggaatagcagacatactaacagtggtaagtaagacgttctactggtcatacgaagcttgatgatacagacaaatcacatacaacacagaggg

SEQ ID NO: 523518 - DNA, 218 bp, Homo sapiens
gcctggaaggtgcggcacctggcgtaccaccaaccgcggcttatgcccgttcagggcgtagtggactttcgggaaagtcgcgacccctattgttattttctaatcatcaattggttcggtatgagcaataccctgtaatgttcaatattttgaggagatttagttttaccttccggtgccctattccttttgcggatttgcttctgtttggtcccccc

SEQ ID NO: 523519 - DNA, 1207 bp, Homo sapiens
taaaaccccgggtaatccaggtttattataaaaaaagtgccacatttactctttatggaatgtgcgagcgccagcacgggccccttttctctccaagcacaggggcacgcaggcaaggggcacgaaggcaaggggcctcgtccccgggccaggagtgcaggggaagccgggcctccatataccatttcaccatacagccagaacccctccttcggggccgggggcctcaggctcgtgttcaaacttccgtggctcacagaaagccataattggagggggtggggccgtggagcaccttcggccttcagaaactctcaacaggggaacggtggtgacaaagggttcaataggacaaagtgctcaggctcaaatgtttcaacttgggtggcctccaaaggcctttcccgggacaaaagccctcggtgtccgggacaaaggggaagttcctccatatatggggacgggaagggatacatttaaccagtatggccatggggacacacggtgcccaatttcttgtggtgaccgcctatggagttcccaagatgtggtgcccaggagatggctcaaaaagatgtgggcagggggaaagggggcgaaaaatggttttcccaagaaggaaaatgcccccgggtgtcacggaaaacgcgggggaaaaaagcccccaaagtctcaagtctagggtgagctaacacagaatgggtggcccctaccaggcaagcatttccaaaaaacaagcgggcataaaagaggtctccaaggaccctcgggaaaaaactcccccagaaagagtctcaagaaaaagggagtaaccaccgggtgccccaaaagtgggggacggggagataaatctccacaagagaggcacacagataggaagaggggagaacccaccaggggcggtagaccacaagaggaaaacacacgaaaaattctctctcccagagggagtagcggaaccccagggaaggaaaagggggggccgcaaaccccgggacaccaaaaaaaggggtccaaaacccggggaaaagcccttcatagaaaaagcacccccgcgctgccggcgcagaaacaaccatggggaaaaaaagctgcgagaaaaaacaacacacaacaaaagagtaaataatgcagaaacagaccacctagcacagagcagcgacaacaagacgaacgcagggcgcccaaccgagagcaacagccacat

SEQ ID NO: 523520 - DNA, 460 bp, Homo sapiens
  misc_feature (444)..(444): n is a, c, g, or t
atgtatattcccaagtcatttcagcactgcttttagttcatatgaattctcaggagttgaaatacatatggacaacatcttttaaaacatgattacatacacagtatttacaacaaacacatttcattggacctaagtgcaatttaatattattcatatattaatcaaatattagtgcatatgtgaggtcattataaagtacgtggattttaaatcatacattacaaaagtgaacacaatatctatgttcaaactaaaagagtcaataccaagttttaaacacttgcacaaggtaaagaaaaagaatgaagatgcaagaaatgctatattgttatgagatacaatttatcaatataaaagtcatatatatgaaacttagaataacagttgtctcaaattaggaggaaacacagagtgggtactacacttccatagaacttagcnaaggcatagaaaatgg

SEQ ID NO: 523521 - DNA, 81 bp, Homo sapiens
actgaagacagtgccacttactactgtgcctttgggcccccccacttttactgggggatggtcgggacagcacaactcttc

SEQ ID NO: 523522 - DNA, 245 bp, Homo sapiens
gccacaccagactttcgaccccccaaccctctgaggaagatgggggcaagaagatcacgctccccgcctgttcccccgccgcttttctcctctcttctctcttcgctctcagctccccctgtcccctcagctccagacgtaggggaggggttgccacagactccctgcttgaagcctgcccttgcctaagatgctggtaatggccatggtacccccttccgggcatctactctggttttcggcca

SEQ ID NO: 523523 - DNA, 152 bp, Homo sapiens
  misc_feature (113)..(113): n is a, c, g, or t
cggaaacgtctaagtatagtggtgcttccaggtgcatactctactgcagtaagcatcaatgaccagtatactacgcatccatgagcagtataatagccctcaggcagagagtnggagtgcagtacgcatcttcaagtatacaggccagtgcc

SEQ ID NO: 523524 - DNA, 258 bp, Homo sapiens
gagaaaaacggaagagcatctttcactggctaacacacgactaaaggggaagtgaggaaacaggaagaacgtatggtgagggctgcggtagactcccctggagccaagcctatccagctaacaatgagctccctggggctggtcacagctggcgtcatgactgctgacacttgaaagtttttattgtttgtgttttgtgtttatgtggcgtcctccacagcatataggttacatacacgtcataggggcaaagggcat

SEQ ID NO: 523525 - DNA, 182 bp, Homo sapiens
ctcggtaccctcgtgaaagcacacccatttccaccgtatttggatcaagcataggcatcgtcacatgttcgactgactcgttgaccggaaccgactcttcatccttataagacgtacctggaacgttttggctgtattcgtactcatcctttcttcggcgaccgcttttttaaacaagctca

SEQ ID NO: 523526 - DNA, 944 bp, Homo sapiens
cttctgcccgcgcggttgggttgtttctaccttttcgccacagttgccttctctcgggggccctctggtgtgttacccgcgtttacttttcgcacctaacccctttgtgaaaggtgataatgttatacctggccctaaacgggtcaccccttgccgttgcccccattaagggtccccgtctggaccacgctgtgctacccctgccccttttcgctcgcggtgtaccccccctcccggggcgaccagggtttcccccctcccccttttgtttgtcccccggggacggatttcatggttgtgcggttccgggcaccctgtggtgaccggtcgcccttcattcctccccggccatggggggtaccccccgtccattatcaccaaccggggcctttaccacacgggttgagtaccaaccgcggctgtttagcaccttgcctggtctcataccaccccccccgggtccctccctcccccggcacggtattccagtcctccacctcgacttcatgctagtctgtccggcaagtccccttctaccctgtattgctcgtcgacgagtgcttcaccaccacacagggcgtgaagcctaaaggagttttcgtcttggagccgccaagaagagttgttgtgtgtcaagtcgaacacccacgcctcgcgttctctggcagctcccaataataggcccaccatcacctccggcagccacatattatagacatgaattttatccccccagaaggatcttgggagctctcgtagatataacaaacaaggccaccctacaatagcacatttcatcacccactcctctcctctcatagacaaagagagcgctaactcattcgccgtccacctttaaccgggtactgccacgaacgaccaccgctgtttaattcccccttctgtccctaccacaggcggcggatttcctccgcgacaaaaca

SEQ ID NO: 523527 - DNA, 175 bp, Homo sapiens
gatctgtgagtgagccgaacatgtatgtacctatcttttgtcttatttgagggcgtgcgtgagtgctggattggcgatagcttcgatttggtcggttgcttcttgtggatagattagccagtaaaaagtgtaattgcccttgaccagggcctcgacggcgagagatagctgcgac

SEQ ID NO: 523528 - DNA, 494 bp, Homo sapiens
  misc_feature (364)..(364): n is a, c, g, or t
cacgagggggattagctcccgatgtggtttgccaagtttcccaatcacacagtcgtgatcgccggttcgatttcgccgaataagcccgtaattccgtgccaaattgtaggacgatttcccgggatacattttccttgaaaacaatagtcctgttccgaagcggcggaagcggagaaggagaccggcttcgcgtagcgccaaaatctcttcacttcgcagtgctgcgttcaaacggagatatcgcgcttcggatcgatcggatcagttgcggcggttttcgatggaaaagcgaatgaggtcggatgtgcgcggtaaatcgagcttttccttgatgcgcccgcacgagttggcaaccgttttgtangcgatgccgatcgcatcggcgatgccttgcaggctcttgccttcgcccagcatacgcaggatctcgatctcgcggttggtgagcttgcgcaaagggtcctcggcgcgcacgctgctcattaccagctcgc

SEQ ID NO: 523529 - DNA, 411 bp, Homo sapiens
tagtatgtataaagcatggaattatgggctatggagcttataaaataaacacacacagttcctgccctgaagatgcttaaaactgaaggattatttatttgcatttatgaatcccacaaatgtttcataaaccataaaaattcctattttatttctgaaatgatattctatatcagactattctagattatttagatttaccagtccaatggattcaaatattgcttttagaaattcaatgccctcattttcactgtttttattctaatggatcaaaataactataagtcaaaatgtatgtgacacttctattgcatagtttttgatttgtgaaggagtacaagataactgtatttcttacagtctgaaaggaagtatagaggcacatcaaaggacaggactgagaagggc

SEQ ID NO: 523530 - DNA, 901 bp, Homo sapiens
ttttggtggacacaccaccgttacttcttgctgccaccgtgggccgcaaatccgctgtctattgtttcccgcccccctcttttgggggccgtctgtgcccaagggaatttccttccgtgtttcccccccgggggttgccctgagtgtgttccccctggagtccccgagtagtttctacttgccaccttagctgttgccccccctcccattggcgcgcaccacaggtggccaaattctctcgctgtctgtatgacccttccccggacgttccccctcgatgttcccccccacattcgctctcctacggtgtgaatataatctctcgctcaagtgttaacaacaggcgttaggtcgtagggcatcttataacaccacccaataagcgcggggctctcaatacgttgcacactcatactcgctttgccgcccccacgttccacacatgtggttgtggccctgcctttcgctgattcttcctcggggttggagtaagaaacctggatgctcacacacgcacttttcatctgcggcgccacacattttttgaggaacctattgaggcattcgacatacgcacgagaataattctggccaaccacggcggatcatatccccgggaatgtctacaaactcgtcggtgccctcatgctcataggcggtgctcccatgagaggacgcactgtcactccttgcccactgataagaaatcagtcgtgaggttgttaggttccataaggaggagacctcgaatatatcataccatctgcttgcatcagtcgttggataattcgggtgtcctgacatgatcttctcaaaaccaaagtgggcacattcctttcttgcgttttcttatgttttttttgttttgcaaacaaaagcaaacattttccccaacaaaaca

SEQ ID NO: 523531 - DNA, 468 bp, Homo sapiens
  misc_feature (158)..(158): n is a, c, g, or t
  misc_feature (362)..(362): n is a, c, g, or t
tagaggatctatttggcggcgccttttccactggtctataagaaacgtgacataaggactacgtctggattcgattctgactccccagcacccaattaaatggcagcaatgtcattcttttttttgggaaacaaggtctgctctgttgcccaggctgnagtgcagtggtatgatctcggctcactgcagactccacctaccaggttctagtgattctcctgcctcagcctcctgagtggctgggattgcgggcgcctaccaccacactggctaattttggtattttgggtggagatggagtttcaccatgttggtcaggctggtctcaaactcctgacctcaggagatctgcctgcctcggnctcccaaaatgtggggattataggcgtgagccactgcgcctgtccatggatcctttcaaagtctttaaatctctcccacatccgggcttcatcctcccctgcctgt

SEQ ID NO: 523532 - DNA, 144 bp, Homo sapiens
tatactgtcacgatagtaaggacatacttctggtggagcactgtgcggaaacttgcggatacactcggtgagctgcatgccttgaaaggcatggcctgtctcctcacttgagtgcaatgtccatcgaccaaaagccctgttctg

SEQ ID NO: 523533 - DNA, 617 bp, Homo sapiens
caagtaaatgtaaaagctggggtcgacccccaggctccctttaaagggtaataataagcctttcaccatacttggtgttcacaactgggacatattctgcgtgttcactctaagggtatctgataataacatatgtcctgaaacagtgtgttgcatatgacagtctggacaaagtcctctaatacatgaaagtcctgagggtggtctgtataaagagccaagtacggctggacacgttcctgagctagtctggccgttagttctccactcatagtgacatacgtgagcgtgctattcatgttttatacttcgtgaaccagcacatgtgcataacccagggtggcatgtccacagagtggaccctcactcgatggtgtaacccatgtcagtccaaagcaggacctttgcgcaaagtagtcggtcgggtccagttttggaataaaaccagtttcagagaggttcctctccctggcatttttgtgatgcatgtcatcatccaattcgttttctaggaggcaagcaccagcaggattctcaccaaatgctcttgctgtgaaggcatcggatatgaatatagaaagcttcattttccgcgcaaactgtttttgcgagttcct

SEQ ID NO: 523534 - DNA, 473 bp, Homo sapiens
  misc_feature (10)..(10): n is a, c, g, or t
  misc_feature (73)..(73): n is a, c, g, or t
  misc_feature (108)..(108): n is a, c, g, or t
  misc_feature (119)..(119): n is a, c, g, or t
  misc_feature (134)..(135): n is a, c, g, or t
  misc_feature (149)..(149): n is a, c, g, or t
  misc_feature (156)..(156): n is a, c, g, or t
  misc_feature (162)..(162): n is a, c, g, or t
  misc_feature (194)..(194): n is a, c, g, or t
  misc_feature (198)..(198): n is a, c, g, or t
  misc_feature (214)..(214): n is a, c, g, or t
  misc_feature (244)..(244): n is a, c, g, or t
  misc_feature (247)..(247): n is a, c, g, or t
  misc_feature (256)..(256): n is a, c, g, or t
  misc_feature (273)..(273): n is a, c, g, or t
  misc_feature (300)..(300): n is a, c, g, or t
  misc_feature (312)..(312): n is a, c, g, or t
  misc_feature (327)..(327): n is a, c, g, or t
  misc_feature (342)..(342): n is a, c, g, or t
  misc_feature (344)..(346): n is a, c, g, or t
  misc_feature (348)..(348): n is a, c, g, or t
  misc_feature (370)..(370): n is a, c, g, or t
  misc_feature (380)..(380): n is a, c, g, or t
  misc_feature (390)..(390): n is a, c, g, or t
  misc_feature (405)..(405): n is a, c, g, or t
  misc_feature (412)..(412): n is a, c, g, or t
  misc_feature (456)..(456): n is a, c, g, or t
aaaggtagtnattttctttaaattcatcctatccacttttgaccacttccccatgtacagattatcctttagncatacaaattcactctccacttccacatacatttnccccacttgangggacttttacaagnngggaacaatacagntgggtgntaaagnaatttaaactatttgtaaatgaaataaaaagnaagnagggataatacatagnggaaaaggtaccaaattgggggaatattgntgntaatctagntttttatttaacaaagnacctactaatgggctggggaggggggnaggagggaaggnggtagatgggaattncttcctatggttaanannnangcaactggttcagaatggatgncagtcttagnaataaaaggntcatttaatattttnactgggnttacaggggtggggactactggttacattattttaatggaaggntttataaaaacatctgg

SEQ ID NO: 523535 - DNA, 392 bp, Homo sapiens
  misc_feature (291)..(291): n is a, c, g, or t
  misc_feature (326)..(326): n is a, c, g, or t
  misc_feature (340)..(340): n is a, c, g, or t
  misc_feature (359)..(359): n is a, c, g, or t
  misc_feature (387)..(387): n is a, c, g, or t
gaattcggcacgagccaaacaccaagggccattgaaatggcttctaaaagggctctgggcagcagaatcacccggacatttgtttaccttacagatttcatggccccacctactaaatcaagctctcctcaaacagtagggtccaggaatatgaatttcaacaagtgcaggtgtatgccacaggtcccaagttgagaaacctggtcctaaccccacccgtcactagagagtgacggcagggttaatagggcgggaacattaaggaaaacttttaattgacagggaccaggngccaatcaggaagcagaggtgcgggtcgggcgtantgaatacgcgaggngaagagagggctccttccncccactttcacttgggggagacaacttngggtt

SEQ ID NO: 523536 - DNA, 217 bp, Homo sapiens
  misc_feature (40)..(40): n is a, c, g, or t
aggcagtactcattctccttcttagaccggcactacgtgngctcagcagctgcttttgcaggacaccagagcatggaccattccaaggcagtcctggtggtgcctatgggactgtcagcccccacctcactatggggccacacagccagcttatagtcctagtcagcagctcagagctccttcgggatccctgcagtgcatactatctcagccacgc

SEQ ID NO: 523537 - DNA, 290 bp, Homo sapiens
gtctaggctacatcccggacacggaatgggcaatcattcatgacaaacgacactaagagcaatcacaacaaaagcaaaaattgataaatgagatctaattaaactgaagagcttctgcacagcaaaagaaactcaacagagtaaaaaggcaacctaaagaatgggagaaaatatttacaaactatgcatctgataaaggtctaatatccagcatctataaggaacttaaatttacaagagaaaaacaacaaccccattaaagagtaggcaaaggacatgaacacttttct

SEQ ID NO: 523538 - DNA, 391 bp, Homo sapiens
gatctgcagctcctaaacctcgggtcagtccagcctagcctcagtgctcccgtgcgctgctagtcctctatcagcgctcgggccagctgatgctcggtctctcacgcccccgtttcttatcctttccttctcttttctttttatttttagaccgcgatcttgctgtgttgcccacgccaggtactgcagcgatgccgtcatagctttctccttgttgataagactcctgggctcacgcgatcccctttgtctcaaccttctgagtagcagggattctcaggtgcacaccaccatgcctggataatttatattttcagagatggtgggggtcttgctatgttgcccaggctggtctcaaactcctgagcttaagcagtcctcccacctcagc

SEQ ID NO: 523539 - DNA, 636 bp, Homo sapiens
  misc_feature (375)..(375): n is a, c, g, or t
  misc_feature (622)..(622): n is a, c, g, or t
cgctcgatctctataggcaaatggattgctgataatcagccaaggctgattcagtgtgaaaatgaggtaggtaaactgttgattatcacagaaatcccagaattaatactggaagaccccagtgatgccaatgagaacctcattctgcaagaaacatctgagatcgagtcgctgcctgcagatgggagcccagggctaaaatcagcgctatctacaagccgaaatttacgcatcaactgtgacacaggagagaagccagtggttaccttcaaagcattaagacacgagaagtgaacagagaccaaggaagaagttcttcttcaagagaggttgtaactcaaacctcaactcaagcaagtaactcccagttcatcnccattcatcacccttgagcctttccttctcttctcagtaggccagggtttccgcccccacatatggtatccccccgcttgtggcatttctatggctcaggttacaccttcccagctggtgcttctgtcccaggaacctttcttaagctacaagttactcttcagcaggaaacaggtgcaagctgggcagtcccacattctttacagtcagaacggccctttggaccaggccaatgaccagggacctnactacaggccttcc

SEQ ID NO: 523540 - DNA, 696 bp, Homo sapiens
tgcgggctatgtactatggctcggtgttaaattctgacgaggcggcttcctagtgtgtcggcggctgatttagaagtgaggttcaggctacggggaggattcttggcttcccctgtccgtgttccatctagccacacatgtgagccatggaatgtgtgcagagcccagcatgccccacttgaagagtgagtgaggatgtgaagatggatgcactctgtgcatgatgcctctgtgccccgcactcgctccaatcctgaatgtggtgctgatgtgacctgtgtgcagtagtgtgtgcacatgtgccagctgtgtggcatgcctgcagctgagggtgaggtgtgagtgccgccatgtgcttgatgattgggatgcctcaatcacttcatggatgcctgtgccctaatgtccttggcagtgtgccccctgccagcccctgagtgtccaaaagttctgtgacaccaatggggtcaaacttgtcccatgaggaaaggttgatatatctatgcctggacctagtcaggaggaaatagtcactagccaagagctaggagtacagttcaacaggctccaaaaaccaacgccctcaatgtctcccagaagatgattgagatgtacgtagcggacaaaacacaagatcgacaaaagccacgagtttgcacttggtggtggttgaacgatagacactggtctaggctg

SEQ ID NO: 523541 - DNA, 260 bp, Homo sapiens
aaaaaaaattttttaaattctaaggggggagaatttttaaattgggatttttggggaaaatttttaaccccttttgggaaacaaaaaaccaaaagggccttttgtttttccttgggcccaaaaaaaactcccgttttttaaagtaccctttccccaattttggggtggcaaaaattcctgagggcttaccctaaaaaaggggtggttttttaaaaaggggaaaagggaaaaaaatattttttaaaaacaggtttgcttcc

SEQ ID NO: 523542 - DNA, 101 bp, Homo sapiens
aattctcatcacttttcagtctcgttatttccagaggtctggcaatggcttctgttctcatttccctcaactctacttccatgaggtagagagcctggcaa

SEQ ID NO: 523543 - DNA, 1152 bp, Homo sapiens
ttggctcactgcaacctccgcctcccatgttcaggctgaggcaggagaatggcgtgaacccgggaggcggagtttgcagtgagccgagatcgtgccactgtactccagcctgggcgacagagcgagactccgtctcaaaaaaaaaaaaaagaaaataaagaaaagggatgaggagttcctggcatttttatttgtccccttttctccctctctagctctattaagacaaagcttttcagatttcacttaaacattaaccatagtttagaaattataattatcaccctatgacagaaggtaccctttcttggtacataattcaagctattaggaatttcttctgcattcactgggtttcatgaatgcaagtggtgtttgctaggtgcattctaaatttgacaaacatgagtgttgtcttggcctgcagacttaaaatagccacctgattataaaagaagtacaggtcttaagtgtatgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtctgcagctgtacttttcaactggacatgaaccatgtacttttatggcacgtagatattcacatcaaatttctgatttgcagaccgattttatttttagttaacaaataagcttatcaaatgtggcttttgaactaaagcgcttttaattaaggagttataacagcatgttattttgagtagctgttactaaaatctgttgtgatggaacaatttggagtgagcatctgatatcagagataaagagagaagcatgcagtgagcatctggaagttcttgtaaaaaaaaaaacaaattaaacattctcatttgaatgcatttaaaatttttttaaattgccaattcctaagctttttctttgttagttgtagtttgctttctcgactgtat

SEQ ID NO: 523544 - DNA, 160 bp, Homo sapiens
gctgtggtggagtagagtaaatagcagttctatcggacaacctaacataaccgggctatgaactatgtatatatcctactactaccggattcctactactcgaagttaaactccagcaccacgacctactactatctgctattgacacttctaaaatagg

SEQ ID NO: 523545 - DNA, 90 bp, Homo sapiens
gtggacacagccacatattactgtgcgcacataaggccctcgactacggtgacgacgtccgctgaatacttccagcactggggccagggc

SEQ ID NO: 523546 - DNA, 99 bp, Homo sapiens
ccctgccccttttttaggggcaatttaattaaaaaagggatgtccgctatatccaaaattacagctattggcaaataaacgagatggataaaaaaaaaa

SEQ ID NO: 523547 - DNA, 191 bp, Homo sapiens
  misc_feature (39)..(39): n is a, c, g, or t
tagcttacccttactgtatcactctcagagtctgtgctngtcagagtcagatgacttcctatctctatgtttctttttcttcttctccttctttctttttctagaaggattccttgtagggtcaggcttctcattctcctagctgttcttacaccatctttccttttccaatgaatcttctttttttcatt

SEQ ID NO: 523548 - DNA, 185 bp, Homo sapiens
cccccccctggggggggtcccccaaatgggggttgggtttgggggtttcccccccggggcaacaccctgcccctggtttttgggggcttttcttttggggggaattggggtttttttccccccaaaaaggtgttggggggggttggggggttttttttccccccccccccgggggtttggtatta

SEQ ID NO: 523549 - DNA, 140 bp, Homo sapiens
ctacccgcacgagaactgacgctggaccttcggtccgctgccggaatcatggagatcaagcgccgcggcagtcggtcatcggctacccggcgctggtcgaccgtggcgcgcattgcgacctggacgtgttcgacgacccg

SEQ ID NO: 523550 - DNA, 465 bp, Homo sapiens
  misc_feature (5)..(5): n is a, c, g, or t
  misc_feature (22)..(22): n is a, c, g, or t
  misc_feature (166)..(166): n is a, c, g, or t
  misc_feature (193)..(193): n is a, c, g, or t
  misc_feature (201)..(201): n is a, c, g, or t
  misc_feature (245)..(245): n is a, c, g, or t
  misc_feature (461)..(462): n is a, c, g, or t
  misc_feature (464)..(464): n is a, c, g, or t
aaaanggcaaagttatttgtcncccattttaagggaagagaccacccctcaaaattgtctttatgccccaatttctgccccccaaagaaagaagaagtaaaaactaaaaggcagaaatgaaatcccacaggcagaacaagcccagcgctgtgccctgggccctggnagttaaaagatcgaccctggcctaacnggttatgntatctatagattccagacattgtatggaaaagcattgtaaaaanccctgtcctgttctgtttcattctgattaccagtgcatgcagcccccactcacgtaccccctgcttgctcaattgatcatgaccccctcatgcagacccccttagagttgtgagcccttaaaagggacaggaattgctcactcagggagctcagctcttgagacaggagacttgccgatgctcccagccaaataaaccccttccttctttttaatnntnt

SEQ ID NO: 523551 - DNA, 866 bp, Homo sapiens
agcggagctgcgatgtgacgccgcgcgccccggggtcctcggcgcctgcgccctctacctataaagcagacgccgcgccgcgctgcgacgctgtagtggcttcgtcttcggtttttctacttccttcgctaacgcctcccggctctcgtcagcctcccgccggtctgtctccttaacaccgaacaccatgccttcaagttaagttgcagagttctgatggacgagatatctgaagtcgaagtggaaattgccgaacaatctgtgactattaagaccatgttggaacgatcgggaatggactgatgacacggagatgatgacccagtttcctctagcaaatgtgaatgcagcactattaacacaaggtcattcagtggtgctacccatcacaaggatgagcctcctcctcctgaagatgatgagaacaaagataagctgaaccgatgatatccctgtttgggaccaagaattcctgaaagttgaccactggacacacttctttgaactcattctggctgcaaactactttagacatcacaagggttgcttgatgttaccatgcaagactgtggcccactatgatccatggggcacgacactcctgcacgccgcattcggccagatcttttcaacttcagttcgcgactcatatggactccttttgtccgctttgtgacgcaaacgcaacggcaaggccctcgcagacgtggttaccggccgcaactgttgtcatactcccctcgctgagcttcgttgacacgcagcccaccgccgtgctacactggctcggacgtccctggacacactctggctcatccccctgtgtgtgtgcggagtgtgggttccctcatctatctaactattgt

SEQ ID NO: 523552 - DNA, 113 bp, Homo sapiens
acgacaagggcgcaccctatttatgtgagggacggatcggagaattgtgtagtgcgaataggaagatatcattactggcgctatgatgtggggacggggtgtttaaggggttg

SEQ ID NO: 523553 - DNA, 1129 bp, Homo sapiens
ggtggcggtgcagtgaggccgggcagggtgtgcggagtggacctgacggacgcacgggctggtgctggcctggtgagccatggagctgctggccctgggtgccctgtgtgggctgctgtggcctggtggtgggcttcccactgtgcacgaacaatgggagaacctgtggttggcgagtgttccccctggcggctcgggtttggacctgcagcatgcgggcactgggaccccttgggacactccatacacggggagcctagcatgagtctggtggcagggctaagcctagggagggcggggctgcctacaatccaccaacgttgaagcactacgacctccacacgtaaacacggacaaccagctaccccacttgcacagcggaccaagaggccaagcgaacggggaccagaaaaagggaagaagcaagagaacagaacaacacagagaagacaagagacacaaggggacgcatgacgaaacgcggcaggaccagcaggacaaataaaagatcgagagacacgcaacgagaacagaacaacagcaagccacaccaaagcaagaaacacgcaaagaagaacaagcagctcgaggaagcaccggaccaaccgtgaagaactccgcaaaacacagaccacagacacacccacatgaaccacaagaaagtcgagaaccggtcagcaatagtcacagctgcgcagcaggctagccaggtggcaaccggcaaaccgagcaaatgactaacaacgccagaccaacctgtgcaggactgcatcacacactgggacaagtaacaacagaagcgaggctcgcgccagttggcagagaacacacaatagagaacacagcggaacgcgcgccacccgggacgcagaagcaccgggacacccccagaccaaaacagtagaggacggggagcaccaccagacgacaagccaacagacccaccgcacccagaacgaacacggggccaggcagacagaccgcgagcgcagaggaactaaagcgcaagaacgcacagcagacgcagcagcaggaaggcgcacaccacgagacgacagcaaggcagacgcgagcacgcgaacaacgaaccacccaaccacgccgactacgaggaaggacggaacagcgc

SEQ ID NO: 523554 - DNA, 380 bp, Homo sapiens
taaaatagccgagcacattatgcatattctcccttaccaccccccaattcacttacaattttcttttggtcactctccctagtaaggcctcactctaatacaaaattttccatcctagccataaacacgatacaacaacaacaacaaagtcaggttctgtacattcaaataaagtaatgtctttcccaaacatcccatctgttcttcaaaactctccctaggttgccacactccgctctgagccagctggcactttccaacagctgggtaaaatcattactcattgtccagatgtatcagtcagataggattcctctttaactctttgccctctccaacctccatcaaagcaatgaagtggccccgtcggcctaaatttt

SEQ ID NO: 523555 - DNA, 911 bp, Homo sapiens
  misc_feature (127)..(127): n is a, c, g, or t
tgcgcgccggctgagcaaccctatgctgggtaatcgggttcctccgagccgcgtagaactggttccggggctggtgaggaatggagccggtaggctgctggggagtgcgggtcctccgtaacccggnagacttcgttgttgagtaacctggcggaggggggtgagcgtgtgctcactttcttgcccgcaaggggttggtgagggggggcctgaatgtaccgcattttaccacatacgggtttcttagatggctgattcagaaactttcattaggttctgaaaagaagtgttggtgcccaataagagagcaagggaaaaggactagtttgtggaacacacagcattgtgcccttggaagaaggctatcccccaaaaaaagggccaggtgtcctgtggaattggtgaccccaggaattgtgtacggtggcctccaagttggacatccagggtacgcactcgccccttcaggacactaggaatctgggaggaaatctggttggcttttatttattcccctcaaattggagagggaattaaaaaattacaacgctttcattttaataggggcttccaaagattttaagccttagaaggactttcaactcagctgagggtagggcctttagataaccctgaacgtgcgtggtggtccgtgtctggagtataatagctgaaaggggggagccagtattttctggcgccagtagtcacggctttcagtgttttgacattcatccttgggggggggccgtggacaccctggctcattggcttgtggaagaccctctggttttgtgccccgggtgggtggccgcctttgaccgcgacagggcgtggtcccagggaggcgtaaaacgtgtgggaggcgccaagcgtcacacacccggcgtgggcgggagacacccgagggg

SEQ ID NO: 523556 - DNA, 1040 bp, Homo sapiens
  misc_feature (1)..(1): n is a, c, g, or t
  misc_feature (553)..(553): n is a, c, g, or t
  misc_feature (558)..(558): n is a, c, g, or t
ntaacacggagtgctgggcaggtgttatatctaccgaatacggcaatgatgctaatctagtaggtgtgataggatgtttcttatgcaaactagattcgttaaaccaacaacagaggaatattcagaaacagaatgttgcgacccctgcctgctgtccaactcacttaggagacgtctataccacacctctattctaataacccgagggcaccgtcatcaatcctacctcaatgactatactccattataccagatgccttggaagcgactgaatactttctgtctgtctcgtaacatctgaatattgccacataacatctaacagctttatttatcaagagataccttagttctgagggtctgttttttttttcagtgtcatcattcatataaacctttattcttttttttttgaactgctgatattttatcactgtatcactatctggcagaaacctagaaggtcttttaaaacttcatacacattacactgatataaaatatagcatatagaataataactgctcatcaatagcatttgacgtcaggatcnccccnaattaagactcacattttctgatacatgtgaaacaaacatacttctctgttaaatggactgcttaatacttttacacaaagatcttcataaagtgtgagagaccatttaagtataataataatctgggttgctgccatttttcttcctctttttatcacaaaaggcaatctgtgcaatcctgtataatgaaggttagatcttttcttcttttcttcaaaatatttttttctggttctttgaccttcccttaagcaattgctcagtgctcagtgaactgagtttaaaaatgctcatcaccttctttttccaatcttgaaggatctggaagagacagcatcagcaaaattggtccctacagagctctgaaggggagtccgccccaagcatctttttctgcttctgagagttaccagttacccttggccttctttggattataaatgcgtaagtgcgagctctggtcgacgcggccgcgaattta

SEQ ID NO: 523557 - DNA, 205 bp, Homo sapiens
  misc_feature (199)..(199): n is a, c, g, or t
ccaacggcccgttgcaattcttgcacaatgaacaacaagagcctttccttgtgtgggtgaaccaggaggatcaccttccgggtcatctccatggagaagggggggccacatgaaggaggtttttcgccgcttgtgtctagggctgtagaagattgaggagatctttaagaaagctggacaacccttatgtggaaccagnccctgg

SEQ ID NO: 523558 - DNA, 115 bp, Homo sapiens
ctgacttgaggatcctcgtacgagcgctcgtacgacgcctctaacaccctccgtaacgagcgcctactgacgcctccgtaacgagcgccacgtcttcgtaacagcgcctccgtaa

SEQ ID NO: 523559 - DNA, 726 bp, Homo sapiens
gggatgttaaatatggctataaatcttaatgttgattgtcatcacatgtctgctgcaatggtaaaaaaaaaaaaaaaaaaaaaaaaaaaaaaaaaaaaaaaaaaaaaaaacaaaaaaaccaccaaaacccaaacaactataaactcaaccaaccttatccatgcccccaaaatccaccctcactggcccaatcccccctatagcgacccgtatcacaatacactgcccgtcttttaacaacagcccccctggaaaacccctgccttcccccacctaaacccccttaaaacacatccccttttccccacctgccctaatcccaaaaagccccccaccaatcgccctccccaacacttccccaccctaaatggcaaatgaaaattagacccctaaatattctgcaaaaatccctctaaaatttccgtaaaatcacctcatttttaacccaattcccccaaatcgccaaaaccccttataacccaaaagactaccaccaaataggttcaatttttctcccactttgcaccaaaacccccctattaaaaaaccggcccttcaacttaaagcgcccaaaaaccctcttattagccgaatgccccctctctaacccctcccccataattttttgcgcctcatgtcccccaaagcccctaaactaccccctaaagacccccccctttttaaaccttccccgatataacccctctaaccttctcaacgcgcgct

SEQ ID NO: 523560 - DNA, 330 bp, Homo sapiens
cgcctcatcaggatttattttaattaagactcacattttctgatacatgtgaaacaaacatacttctctgttaaatggactgcttaatacttttacacaaagatcttcataaagtgtgagagaccatttaagtataataataatctgggttgctgccatttttcttcctctttttatcacaaaaggcaatctgtgcaatcctgtttgcacctgtataatgaaggttagatcttttcttcttttcttcaaatatttttttctgttctttgaccaggtttggctgcagatgacctcatgttctttctctgatttctcattgttccacaagag

SEQ ID NO: 523561 - DNA, 330 bp, Homo sapiens
cgggcgcatcccggatctattttaattaagactcacattttctgatacatgtgaaacaaacatacttctctgttaaatggactgcttaatacttttacacaaagatcttcataaagtgtgagagaccatttaagtataataataatctgggttgctgccatttttcttcctctttttatcacaaaaggcaatctgtgcaatcctgtttgcacctgtataatgaaggttagatcttttcttcttttcttcaaatatttttttctgtgtttgcacaccacgagagcagagaaatttgctttcgggttataagggggtgggtaggggtttggt

SEQ ID NO: 523562 - DNA, 930 bp, Homo sapiens
  misc_feature (482)..(482): n is a, c, g, or t
  misc_feature (848)..(848): n is a, c, g, or t
ggtcttctgcggtttctgatggagccacgctcctagaccaagaatgtcggccgcccaggtcctgaatgaagggctggctctactacgatgccgggcagacgcttccatggtagagtgcagtacctgtagccgggtggcttgtagtcggacgccacagtaacatcaatccgcggagccgacgtggttccctaggtatcggaggtcacctctgcagacgggcggtgacggtgtggtgaacgcccgtaatcgttcaacagaagctgtgcgatgatcatgtgggtctcgcactactatccagagaatatccgtcatcacatgacccacttaagaaaccaaaggacatctaaagcaaatctccattataagggacagcgtctggcatccagtagccgaatggtttgtggagtgcagcggcaacggtgagctgacgagttctgctttgggagtgactgctcgcgcaagttcacctacactacagggtnccattactttatcaagcccggccttactaggactctttagtcgggcttcgcagtgccagtccgtatccgcataggcgtccttctgacatccgaggtttctggcgcgagcttggtcggttcgccgttggcctgcgttatcaccgagcagccgcgactatgtgttttgaaactggccgatcgggtttcacgagatttcatcaccatggatcatttcatcctttctatacgcttccgcttactcagttcctcctggttgcctaccagtgacgctgcccagtgttacgcccatcgcgggtgttccctgcgcgtccttccggctgagggtggcccccgttggaggtctgggccagctggagctggagtganttgctgtggtcccgcacccccctgctcgtgcatagcgggccctacgtcctcggtttcccgaatcgaagggttgcgtgtggtc

SEQ ID NO: 523563 - DNA, 867 bp, Homo sapiens
  misc_feature (1)..(1): n is a, c, g, or t
  misc_feature (553)..(553): n is a, c, g, or t
  misc_feature (558)..(558): n is a, c, g, or t
ntaacacggagtgctgggcaggtgttatatctaccgaatacggcaatgatgctaatctagtaggtgtgataggatgtttcttatgcaaactagattcgttaaaccaacaacagaggaatattcagaaacagaatgttgcgacccctgcctgctgtccaactcacttaggagacgtctataccacacctctattctaataacccgagggcaccgtcatcaatcctacctcaatgactatactccattataccagatgccttggaagcgactgaatactttctgtctgtctcgtaacatctgaatattgccacataacatctaacagctttatttatcaagagataccttagttctgagggtctgttttttttttcagtgtcatcattcatataaacctttattcttttttttttgaactgctgatattttatcactgtatcactatctggcagaaacctagaaggtcttttaaaacttcatacacattacactgatataaaatatagcatatagaataataactgctcatcaatagcatttgacgtcaggatcnccccnaattaagactcacattttctgatacatgtgaaacaaacatacttctctgttaaatggactgcttaatacttttacacaaagatcttcataaagtgtgagagaccatttaagtataataataatctgggttgctgccatttttcttcctctttttatcacaaaaggcaatctgtgcaatcctgtttgcacctgtataatgaaggttagatcttttcttcttttcttcaaatatttttttctgttctttgaccaggtttggctgcagatgacctcatgttctttctctgatttctcattgttccacaagag

SEQ ID NO: 523564 - DNA, 797 bp, Homo sapiens
  misc_feature (797)..(797): n is a, c, g, or t
taaaaaaacaaaaccttaattataatatagcgcaaaaaaaggccaggactgatgcagggaatccctgggaaatactcagtccctatcacttttaaaacctgatttgggatctctcgtgtctatgtatgtctttagtgagagcacaatactgtggcagaacgctgtgccaaatgttataggtaaggaatatagaaatgaatgtttggtgggtgaagggtgtctccagtgtgactattttataaccccatttttcacaaaatctccatcacttttaagtataggaaggatagcttggccggggaaaaacagtttcaacacaccgtgctcagagtagcagttctccctcaaaaaagcagtggttcagcctgcactggactggtactggcttgccaaaaggaggaagcatgcacagatacttatttctcccatagattggtgggagtatacgcagggatgtggggactaacaagatcaactcatcttattccccccgaaagacaagaagtctagagcatcctggtcacgccacaggtgttgggacacaccaaatgtggaaccaggaccctacgacgatacagatggaaaaccctacgtggtaactacccacgggggtaccacaggcgacattacctcaccggagtctcagaacggccacaccctgagaagataacggatagggagattaaaccagagggaacgagcaacacagacccaacacagaaatctccagggcatcaaaatagagacggagatataacaacgagttaacaacgaggcggggcagcgtataagaccan

SEQ ID NO: 523565 - DNA, 268 bp, Homo sapiens
aggcatgccccaattgcacatgggcaacgactacaggtgcactctcgtaactctgtccagggatagactggtgacaacggccccgtacagtctttctgctcatgccataaccacaactatcgagtgatactctaaatactaccagacaagctttcgagtctcggtactgatcgacgtgtacaatcgacaggagcttcactgtcttcttcagattcaagattggtagcagactgtttcttgaatgggccagaaccacaaatatcggggg

SEQ ID NO: 523566 - DNA, 487 bp, Homo sapiens
gagccatgatggtgccacttcaccctggcaacagagaaagaccctgtctcaataaaaaagaagagaaaaactgagtgagaactctcctcctctcataatcatagtatccacgttaggaagatgcttctggagagtaaccttaaacgtactgttgtgtgcattcttccttcaaaacctgtgctttttttctccgttttggtaacggtgagaaagggaaaaaccttcaccgtagaaatactgtcttgagattaagatacaaataaaacatgttaaacctccatctaagagactatggcaacttattaacaccagaaaaatgtaccttggttatggtctttccaaatatccagagccaaaccctgtttcagccttggttaataatacagagatcagacaatgtgaagcacaaatgtgctgcttctccccctcctggttcccattgtcagagatggcagaagaaagcacagtgagctggttcaccaagtcc

SEQ ID NO: 523567 - DNA, 738 bp, Homo sapiens
cctgtccagcgtgtctctcccctgtccccacatgtcttctaagctgttggagccggccggcgctcacttgtcttcaggaagctcggagcctttggtggagccggggagaggaagggtgggtgcaagagtgaaaggcgagagtgggactgcaagcgatcctgggtctggctcctggcctggagcaagatggctgagtgtgcgagctggaaggctgccggcagattcttcagagtgaggtccctccagatcactcagaacttcatcattccaaaaaaggagatccatcacatgtatccagacatgggcaaatggaatgcgttctcaggcatacgcttgactacatcggattcatccttaccctcaactgaaggtgtgaaggggaatgaagctgaccttcgagtacagagtctccgaggcgcatagagaaactaggtcgcgtcttctcgacacgctggacaggttggatttgattgcagactcctccatgtgtgaccagcccctctcggttatgcggaataagtgcatacagggacctgggtatggcaaactatgcatgaggaagcagaacaagtctggaggccacaaatgggtcgctacccatctggcaggcttggtgtgcctgcgtgtgggtgaaaaactaaaaggtgtcatttggggaactcattgcgcattaggctacggcacagggcttgaggcaccttagcttggtacctctgctgttctgaaaatgcggtcacg

SEQ ID NO: 523568 - DNA, 193 bp, Homo sapiens
catgctggctaattcttgatgtagtaagatggggtttaccatgtggaccaggctggtctcaaacttctggcctcaagtgatccacctgccttagcctcccaaagtgttgggattagaggcgtgagccaccgtgctcgacccctcctgaaagaaatcccaggcaggatcgagcacggtggctcacgcctctaat

SEQ ID NO: 523569 - DNA, 725 bp, Homo sapiens
taagggagcaaaaggctttatggataaatatgcaaatttgtctgtccacagggacctgctgtggaggccatgaccaggctgaaacctcccactgccggggttacagccaggaaatggccctgtgcaaaccctgccacaaagcccagccgtccaccacccgcctcatctctgccaatggtgcggggggcagggagaggcagaggcccgcctcaggcttcccaagcccgggggctcacggggggttccctcccttccaagggagtggcactgtgcccaggggagagccaggggatgggggcagagagagggaagacagaggctgcttgagaccctgagacagaaaaccagaggggagcacagagggcagcaccagatgacagatcggggctccaggggcctctcgggtgggccctgggggctcgaacaggcttcgggagacaggcacgagtaggagggccctgtccgcctttcttcctgacaaggttcgaaaggcccgtgtgtgagtgaactgctcccgaggtaaccgggaaacggggtggcgctgaagtcgccctgcaaaggcagagttccttcacaggtacaccacacaagacaacaccgagggggagggcccctggaagaaaatgacccgactgggaaggcacgccacagggctagggggctaagtagcccagggaggggactcacccacagagtcagagggcccaaagactgaacaaaagaaa

SEQ ID NO: 523570 - DNA, 329 bp, Homo sapiens
gcacgagggagatctggttcttggttttgtggtagattggatatatagagtatgagagaaagggaacagtcactgtctgtatgtaccattgcttactaaagtcctttacccagcacctctgtgtctaaatctggtctctcccggaaagctctcctcaggttttactttcagctacaactctgccttcctattaataaagatcattgctatctgtatcttttgtatattttccatggatatgttctgtcttaactagaatgcaattcttaaaagtagagaccatgtttcccccaaactccctcacacgttaaaaagttgctggtgcattt

SEQ ID NO: 523571 - DNA, 148 bp, Homo sapiens
gcttctccatgtatcggcgtgtaactggctgtcttttggcataattgtaacacgttatggcatggatatgcacacaggttggtgtcttcaaaaaggccaaccagataggcctcacttgcctcctgcaaaaccccgatagctgccccct

SEQ ID NO: 523572 - DNA, 108 bp, Homo sapiens
  misc_feature (68)..(68): n is a, c, g, or t
gtgatctagaggacctgatatgcgtctcacatgttcatctttttttctctttaaaaaaaaaatgtgtngtttttttggagagggggtctggctgtgtaacccagacta

SEQ ID NO: 523573 - DNA, 820 bp, Homo sapiens
ctatgcaagctgtacagcggatattcatggtgtactgtatggtctgagtgaatactggcgccacatcgatcttgtctctactttgggcgcatgtctatcatttggatatcaaacagcagggataaatctatttttgttaacagagatgtatatctcattgacattcgtttttattagtactctggtatagttagctgagatctgtgtaactctatggttcagttactatcatatttatgtagtgtggatatcctgggttcatggttaaatatctgagagaatggatgcacagtctgaattgtgcatacatccatattcctagagactattgagggtattgtgggtgtatactcgtaagtgggtgaaatttagatttttattaatagatatattatgtatgcaatgagggtgtactttattttagtgtgctattagtcactatttgaatgaatcattgcaaagattatatcgtgtttaaatgaagtagcttgtgatacactatagactcatggcactcttcaaaaaaagtgtcttattaattttgtattatggccccctccattgttgtgcctttggagagtgtgaactgacttaccccaatgtcatacctccagggatacaggcatttcaaacatgggtcctctacgtctaccgttcctatcaaatgattttacctcatggtgttggaccgggtgaaccccgcactgcttaaggacaccggctaatcctcttacttatggcttccggtgctgatgtgcgctggatctgcaccaagcacgcgagcgaggtcattcgccaccaccgggttcgaggaccaggg

SEQ ID NO: 523574 - DNA, 403 bp, Homo sapiens
  misc_feature (316)..(316): n is a, c, g, or t
cgcagtctgcggcgcttggctgctgggcacatttcctgcacaacaacaaagagccatctatcgagccagaatccccagagacagagtaagggtagaacagagcggacatgagcaactctgtgcaggacctggtaggacgtaggaacccataggaagagggctgcactgcactcagtgcccagccttaactctgaccagcctcgttggctcagggaccgtacctttcctcctcctggactgatcactgagggcgtctggctctctatattccttctagccatcacgaatccacgctgtcctcccagtcttgtatccnttgctcgaatgtttaaggaacccctggccattttagttcttcaaattttcagacaggagcactgctgtccatccactgcagctccgg

SEQ ID NO: 523575 - DNA, 1140 bp, Homo sapiens
gccacttctctgggacacatgccttctgttttctccagcatgcgcttgcttccagttcctgttcagggccagccctgcaaccctgctcctggttctcgtgcctgcagtggggggccaacaaagctcaggacaacactcggaagatcataataaagaatttggacattcccaaagtcagtacgtccaaatgacgaagtcacgggcagtggtgggaggttcaaaacagaattggaaaggacttgcatgggggtataaaaatatacctcattagcagcatccttctacaaggggtgcattttacttataagtataatggcctgctattgtgaggacaatccaaaaaactttttctactggggactttatacacccaaaggaatttggtgcaatttggcagccgtccgtggatggtaatcgcgggaataaggcatctggcctggaatgatgcttgcttgtaatctcaatcaaaaaacaaccgggtttatactatgtgaacatcctacgggtagaaataagtggacgccctgtttgtgttgggccacacccaaggttgatttcctctaaagaaactggggtggaattctgggtgtggctctataaaataacttttttaaacatgcttctacaacaaaaacacacacaccaacaaacatttgtggggcccggcctcgagaagtttaaaccctcggtgggcgggcccatgagtatagactggccaagtgtcaagagaccgggctagagggggggtcccaaaaaaagcggggagccgcgggcaaccagggtcgggcttgcaaagccgtacacacccgtatcgcgccggacaagctagcaccacaagcgccaaccagagcgagtagcaccaccagaagcgacaagcagacaccagcaaccacgcaccaagtacagaaacgcggcacgaaaagacaggaaagcagaaagagagaaggcaacaaacagccagcgagaagcgaagacacacgcacgaaagaggaaagaaacgaaagcagaacaaaacacagaagagacggcagaacagaaaagaggagcaacaggaaagggacgacagcgagggcagcgaacgagcagaagaaagaaagcgagggcagaaaaagagggaggcaaaagagagaaaaagcaaac

SEQ ID NO: 523576 - DNA, 521 bp, Homo sapiens
ttttttttgagacaggttctcactgttgcccaggctggagtgcattgatgtgatcttagcttacaacagccttgacctcccgggttcaagcaatgctcccgcctcaacctcccaagtagctgagattacaggcgcacaccaccacgcccggctaatttttggtatttttttagtagagacagggtttcgccatgtgggtataggctggtctcgaactcctgacctcgtgatccgcccgcctcggcctcccagggtgctgggatatacaggcatgagccaccatgcctggccccacataaagtttctgagcacttgaaatgtggctagtgtgactgagaaactgaattttcaatttggtttgagactgggcacaggggctcacgcctgtaatcctgacactttgggaggccgaggcaggaggattgcttgaatccaggagtgcgaggccaccctgggcaacatggtgaaatcctgcctctaaaaaaaaaacaaagtaacgagcccagcgaggttatgcatac

SEQ ID NO: 523577 - DNA, 447 bp, Homo sapiens
  misc_feature (26)..(26): n is a, c, g, or t
  misc_feature (35)..(35): n is a, c, g, or t
  misc_feature (44)..(44): n is a, c, g, or t
  misc_feature (193)..(193): n is a, c, g, or t
  misc_feature (329)..(329): n is a, c, g, or t
  misc_feature (337)..(337): n is a, c, g, or t
  misc_feature (342)..(342): n is a, c, g, or t
  misc_feature (394)..(394): n is a, c, g, or t
  misc_feature (403)..(403): n is a, c, g, or t
  misc_feature (435)..(435): n is a, c, g, or t
  misc_feature (440)..(440): n is a, c, g, or t
gagcacacatttaggaccagctgcantctggagtnggtaggctnaggaccactgtcctgcttgaccaggaggtgcacagagccgtagccaaccttgtctgtccaaccctgcctgcagtctcagccatgtggtacaccccattcctcctaccagagctcatgtgcctctgtctacactttctggtggccctggntcttcacagaaattgacattgcgattttcagttcttgtttgcctcttacttgattttaggcttcctgaggacaatttgtgtctaagtcacaatgacacttaacacttggaagatgagggattaaatgttggaaggncaaatganccaantggtgtatgggccaagtgtggtggctcatatcggtaatctccagcatttggnaggccaagncaggaggaccattttaagctcaggatttgggnccacnggggaat

SEQ ID NO: 523578 - DNA, 549 bp, Homo sapiens
atccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggttgggattcagtactggctttactggtccttgggggaggctgccaaattaaacatgggcctgcttggaaagcttttaatgggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaa

SEQ ID NO: 523579 - DNA, 575 bp, Homo sapiens
  misc_feature (561)..(561): n is a, c, g, or t
agcgatatggtctgcatgcgaacttggtatcctgtatccatcccagtcgttctataacccagctaacatattcgttgaacaccgagagggtgagaacagacacctggtcaggaatgcggaccacgggccaattcaggctcgcccatggcgtcatgactaccggcgtagtcaaggatctactcgtgtataggccaatgctgaggcaaaagaagacattttagattcatctgcagattccgagatagccttgcagaaggccctggcagttaagaacgagcccaagatccaagcaaaggcaggcgaaggggccaagggacaggcggagaccggctcggcgatacgcgaagcctcatagagacagagagatccgttgcgagctgcgtggcatgcgtacgtgagtacagggagcatgaggtcagaaagatgacaagaatggccacaggagcaagcggcacgcgtgcgagcgagaataaaggaggcaccttcaagagccgaatgcagaagggacggcaggaggatgaaggctgagagcaggccacgagaggaccgtcatggaacganagctccttcagaaa

SEQ ID NO: 523580 - DNA, 954 bp, Homo sapiens
  misc_feature (36)..(36): n is a, c, g, or t
  misc_feature (51)..(51): n is a, c, g, or t
  misc_feature (87)..(87): n is a, c, g, or t
  misc_feature (117)..(117): n is a, c, g, or t
  misc_feature (217)..(217): n is a, c, g, or t
  misc_feature (257)..(257): n is a, c, g, or t
  misc_feature (311)..(311): n is a, c, g, or t
  misc_feature (335)..(335): n is a, c, g, or t
  misc_feature (338)..(338): n is a, c, g, or t
  misc_feature (347)..(347): n is a, c, g, or t
  misc_feature (349)..(349): n is a, c, g, or t
  misc_feature (357)..(357): n is a, c, g, or t
  misc_feature (407)..(407): n is a, c, g, or t
  misc_feature (410)..(410): n is a, c, g, or t
  misc_feature (413)..(414): n is a, c, g, or t
  misc_feature (422)..(422): n is a, c, g, or t
  misc_feature (453)..(457): n is a, c, g, or t
  misc_feature (459)..(460): n is a, c, g, or t
  misc_feature (464)..(467): n is a, c, g, or t
  misc_feature (473)..(473): n is a, c, g, or t
  misc_feature (502)..(502): n is a, c, g, or t
  misc_feature (505)..(505): n is a, c, g, or t
  misc_feature (509)..(509): n is a, c, g, or t
  misc_feature (521)..(521): n is a, c, g, or t
  misc_feature (531)..(531): n is a, c, g, or t
  misc_feature (537)..(537): n is a, c, g, or t
  misc_feature (552)..(552): n is a, c, g, or t
  misc_feature (557)..(557): n is a, c, g, or t
  misc_feature (564)..(564): n is a, c, g, or t
  misc_feature (567)..(568): n is a, c, g, or t
  misc_feature (583)..(583): n is a, c, g, or t
  misc_feature (589)..(589): n is a, c, g, or t
  misc_feature (594)..(594): n is a, c, g, or t
  misc_feature (597)..(597): n is a, c, g, or t
  misc_feature (599)..(601): n is a, c, g, or t
  misc_feature (609)..(609): n is a, c, g, or t
  misc_feature (612)..(612): n is a, c, g, or t
  misc_feature (626)..(626): n is a, c, g, or t
  misc_feature (630)..(632): n is a, c, g, or t
  misc_feature (636)..(636): n is a, c, g, or t
  misc_feature (642)..(643): n is a, c, g, or t
  misc_feature (646)..(646): n is a, c, g, or t
  misc_feature (650)..(652): n is a, c, g, or t
  misc_feature (656)..(656): n is a, c, g, or t
  misc_feature (665)..(665): n is a, c, g, or t
  misc_feature (671)..(671): n is a, c, g, or t
  misc_feature (676)..(676): n is a, c, g, or t
  misc_feature (678)..(679): n is a, c, g, or t
  misc_feature (688)..(689): n is a, c, g, or t
  misc_feature (691)..(691): n is a, c, g, or t
  misc_feature (695)..(695): n is a, c, g, or t
  misc_feature (699)..(699): n is a, c, g, or t
  misc_feature (706)..(706): n is a, c, g, or t
  misc_feature (708)..(708): n is a, c, g, or t
  misc_feature (713)..(714): n is a, c, g, or t
  misc_feature (717)..(717): n is a, c, g, or t
  misc_feature (719)..(719): n is a, c, g, or t
  misc_feature (721)..(722): n is a, c, g, or t
  misc_feature (730)..(730): n is a, c, g, or t
  misc_feature (744)..(744): n is a, c, g, or t
  misc_feature (754)..(754): n is a, c, g, or t
  misc_feature (759)..(759): n is a, c, g, or t
  misc_feature (781)..(781): n is a, c, g, or t
  misc_feature (786)..(786): n is a, c, g, or t
  misc_feature (805)..(805): n is a, c, g, or t
  misc_feature (813)..(813): n is a, c, g, or t
  misc_feature (823)..(823): n is a, c, g, or t
  misc_feature (830)..(830): n is a, c, g, or t
  misc_feature (836)..(836): n is a, c, g, or t
  misc_feature (874)..(874): n is a, c, g, or t
  misc_feature (883)..(883): n is a, c, g, or t
  misc_feature (888)..(888): n is a, c, g, or t
  misc_feature (930)..(930): n is a, c, g, or t
tccagtttgaagctactatcgtgggcgtttagagtnatacaaatgacactnacaaaaaataaaagaccaagacacccagagtgagangcatgtcggggacgggggaggctggcagcnggggggccccggcggctcaccccagggctcccggaggggcgacgcctggcttcatccacccgggaggcccagggagcaccaatcacagcaggggctctgncccaggtgtcggcagcccaggcccagggctggggctggangggaaggacggaaagagggggctgagatgcaccccctggggagggtgctgagangccccccgccagatcactcgctantanagccaggantncctgggangcctccagaaataatatttaattaaaaaaaataatgatttggtaattttntgnttnnagtaaggntagggtgaaaggaaagagaaaggaggaagannnnnannaaannnntaaaanaaagaaaaaaaaaaattggaagaaagtgnagngggnagaaaatgtggncgtaaagaantgaagntaaagggaagggagntacgntgagatntgnnaagtgggagaggggntgtttncaganaanannnaaaaaaanaanaaaagggtgagtgntagnnnaagngagagnntanattnnnaagnaggggtttngggganagtgnannagggagggnnantganaggnttggganangtgannagntntnntggggggntgggaggaggtggntgggagaggnaaaanattaaagttaaaataaaagaanagggntaaaagaaaaaaaaagtanattaggangattaaaganaaataangatcanagaagtatgaggttagaagaaaaaggtgaagaataganatgtggagnaaaanagggaaggggatatgaaataatataagggaagggaggagagntgaatagagggagtaggaaaaggg

SEQ ID NO: 523581 - DNA, 851 bp, Homo sapiens
  misc_feature (36)..(36): n is a, c, g, or t
  misc_feature (51)..(51): n is a, c, g, or t
  misc_feature (87)..(87): n is a, c, g, or t
  misc_feature (117)..(117): n is a, c, g, or t
  misc_feature (217)..(217): n is a, c, g, or t
  misc_feature (257)..(257): n is a, c, g, or t
  misc_feature (286)..(286): n is a, c, g, or t
  misc_feature (295)..(298): n is a, c, g, or t
  misc_feature (300)..(302): n is a, c, g, or t
  misc_feature (304)..(304): n is a, c, g, or t
  misc_feature (307)..(307): n is a, c, g, or t
  misc_feature (309)..(309): n is a, c, g, or t
  misc_feature (312)..(312): n is a, c, g, or t
  misc_feature (319)..(319): n is a, c, g, or t
  misc_feature (323)..(323): n is a, c, g, or t
  misc_feature (331)..(331): n is a, c, g, or t
  misc_feature (333)..(333): n is a, c, g, or t
  misc_feature (340)..(340): n is a, c, g, or t
  misc_feature (344)..(345): n is a, c, g, or t
  misc_feature (349)..(349): n is a, c, g, or t
  misc_feature (353)..(355): n is a, c, g, or t
  misc_feature (358)..(358): n is a, c, g, or t
  misc_feature (407)..(407): n is a, c, g, or t
  misc_feature (410)..(410): n is a, c, g, or t
  misc_feature (413)..(414): n is a, c, g, or t
  misc_feature (422)..(422): n is a, c, g, or t
  misc_feature (453)..(457): n is a, c, g, or t
  misc_feature (459)..(460): n is a, c, g, or t
  misc_feature (464)..(467): n is a, c, g, or t
  misc_feature (473)..(473): n is a, c, g, or t
  misc_feature (502)..(502): n is a, c, g, or t
  misc_feature (505)..(505): n is a, c, g, or t
  misc_feature (509)..(509): n is a, c, g, or t
  misc_feature (521)..(521): n is a, c, g, or t
  misc_feature (531)..(531): n is a, c, g, or t
  misc_feature (537)..(537): n is a, c, g, or t
  misc_feature (552)..(552): n is a, c, g, or t
  misc_feature (557)..(557): n is a, c, g, or t
  misc_feature (564)..(564): n is a, c, g, or t
  misc_feature (567)..(568): n is a, c, g, or t
  misc_feature (583)..(583): n is a, c, g, or t
  misc_feature (589)..(589): n is a, c, g, or t
  misc_feature (594)..(594): n is a, c, g, or t
  misc_feature (597)..(597): n is a, c, g, or t
  misc_feature (599)..(601): n is a, c, g, or t
  misc_feature (609)..(609): n is a, c, g, or t
  misc_feature (612)..(612): n is a, c, g, or t
  misc_feature (626)..(626): n is a, c, g, or t
  misc_feature (630)..(632): n is a, c, g, or t
  misc_feature (636)..(636): n is a, c, g, or t
  misc_feature (642)..(643): n is a, c, g, or t
  misc_feature (646)..(646): n is a, c, g, or t
  misc_feature (650)..(652): n is a, c, g, or t
  misc_feature (656)..(656): n is a, c, g, or t
  misc_feature (665)..(665): n is a, c, g, or t
  misc_feature (671)..(671): n is a, c, g, or t
  misc_feature (676)..(676): n is a, c, g, or t
  misc_feature (678)..(679): n is a, c, g, or t
  misc_feature (688)..(689): n is a, c, g, or t
  misc_feature (691)..(691): n is a, c, g, or t
  misc_feature (695)..(695): n is a, c, g, or t
  misc_feature (699)..(699): n is a, c, g, or t
  misc_feature (706)..(706): n is a, c, g, or t
  misc_feature (708)..(708): n is a, c, g, or t
  misc_feature (713)..(714): n is a, c, g, or t
  misc_feature (717)..(717): n is a, c, g, or t
  misc_feature (719)..(719): n is a, c, g, or t
  misc_feature (721)..(722): n is a, c, g, or t
  misc_feature (730)..(730): n is a, c, g, or t
  misc_feature (744)..(744): n is a, c, g, or t
  misc_feature (754)..(754): n is a, c, g, or t
  misc_feature (759)..(759): n is a, c, g, or t
  misc_feature (768)..(768): n is a, c, g, or t
  misc_feature (845)..(845): n is a, c, g, or t
tccagtttgaagctactatcgtgggcgtttagagtnatacaaatgacactnacaaaaaataaaagaccaagacacccagagtgagangcatgtcggggacgggggaggctggcagcnggggggccccggcggctcaccccagggctcccggaggggcgacgcctggcttcatccacccgggaggcccagggagcaccaatcacagcaggggctctgncccaggtgtcggcagcccaggcccagggctggggctggangggaaggacggaaagagggggctgagaanaaaaaaatnnnnannntnagnanaanaaaaaanaaanaaaaatananaataaanaaannattnaatnnnaanaataaagaaataatatttaattaaaaaaaataatgatttggtaattttntgnttnnagtaaggntagggtgaaaggaaagagaaaggaggaagannnnnannaaannnntaaaanaaagaaaaaaaaaaattggaagaaagtgnagngggnagaaaatgtggncgtaaagaantgaagntaaagggaagggagntacgntgagatntgnnaagtgggagaggggntgtttncaganaanannnaaaaaaanaanaaaagggtgagtgntagnnnaagngagagnntanattnnnaagnaggggtttngggganagtgnannagggagggnnantganaggnttggganangtgannagntntnntggggggntgggaggaggtggntgggagaggnaaaanattggagtnagagtagagggggaggggtgggaggggggaaggggtgggttagggggttggagagaaataagagtgagaggggtgtnagttga

SEQ ID NO: 523582 - DNA, 231 bp, Homo sapiens
gaggtgatttgtccctcaccgatattgtctttctgcagataactagccagacccatccctttatttcagcccatccctttatttcctgtaagaaatgtttttagttaatctataatctatagaaatattgcttatcactggcgtgctgtcattaaatatgtgggtaaatctctgttcaaggctctcagctctgaaggccgtgagacccctgatttcccactccacacccta

SEQ ID NO: 523583 - DNA, 245 bp, Homo sapiens
ttgaggatgtctcagagcagaacgtgagactgttgttcgcacgctccttcctccctttcgcgaagcgtctgctctgactgacatgggcgactggcttcctctgtgtggcagcatgagctctttcgttaggcaaaatcgagaggtcccccagccctgttcctggtcctgacgtagctagcatagttcctggaactggggaatcacgtggggctgctgcacttctctccgtcttttccccaccacag

SEQ ID NO: 523584 - DNA, 158 bp, Homo sapiens
  misc_feature (5)..(5): n is a, c, g, or t
cttanaggcaggacactgtgcatgtggcgtgttgccccgatgtgtgtgatcattctgaccttgctcaccccactggcttaaacaataccattccagctggagtcagcctttactgccttgacgaggcatgtcacttacgttccccaaacacagaggcg

SEQ ID NO: 523585 - DNA, 334 bp, Homo sapiens
  misc_feature (74)..(74): n is a, c, g, or t
  misc_feature (275)..(275): n is a, c, g, or t
gtgcccgggtgcctagagtcaggtcctaccttagcgccaggctgtatgtgggggcaggaagtgggaggcccacngtcttgtcccttgcctctgagtcccaggagaagccctacccttttgctgctggaggccgcccatcgaggacctgacaggcgagaggtcaggatgaaggggctgagcgtggagccagggaggctggaggctccgttcaggaaacctcacctggggcaagggaggggccttcccagatggacagaggtcacagtgcccagtgnccccgcctgcacgttcccatgccgctctccctacacccccacagagaaactcgggccga

SEQ ID NO: 523586 - DNA, 891 bp, Homo sapiens
gactgtgtgcggtctacaacaatgtgttggttctgttgatacacatcgtgatcgtgtgcgcaaaaataacacgtagctgtgcccatatgtgttagcgaggataatgtcgatcataacactgcgtcgtgtttaacaaattctctccttggggagaaaggaatcgtcggtcttatgttacttcccatatgccgtatatgtcctggacacaagctctttgtgcacaccgtaaaagaacattgttgttgaggtgtttttgagagcccaggaccaagaaaaggtgtaaaggtagtcgcctgtccgacttgtttctgaacacccgttattcattcctggacaaccattttcgtttaaatttaaaaaagtacgccacttcccatggtaagttatgttcctcctccccctgccccaaaaaattttttttaatactggctttgtgacccgccccgaggtaagattcccaaaccccctaactcagcttgcttcttgcacactgaggataatttttcccccccacacttgatctccctggccctatacactccacaccccaaacttaaccctctgtgtggggtttgtgattttgatagccccaaatagttctcgtgctcggttgccaaaattggatatttagatcggtttttatataactgcacccacgaagagtgtgctctcccccttataattgtgtccttttttattgttgcactgtttgctctttgtttatcacgcaccgaattttttgcccacgtaatatgatatgttttcgctgatgttttgtttatattgggcacaaacatattcttcacttaaagaagtttttggagaaaactcactcacaaatcgatgaaaacatttttttcaaaaacccattgggattatttcttaaaaaaa

SEQ ID NO: 523587 - DNA, 251 bp, Homo sapiens
agacccctctctttgaggtcatcatttgtgcaatctctatggacagaaagggagttccactctcacacacaaacaacgctgatccataccttctatgatctgaagatacagaaaaacaaacacaaacataaaggcgtgtctgatgtgactcattcggagcctgaccactgtgggacctagatctggtgggtgcgttctgccacaagtttgaattcgaactgcaggatgtgcaccgcgcgtactagaatgtc

SEQ ID NO: 523588 - DNA, 502 bp, Homo sapiens
tatgacggtgtggaagtagacctgtaagtagtgggggggggcgatattcgagtcatgaccatttcgtaaataagaggcgagtaattggtcgttgaatgattcttactattgaataaccttcctggatttgtatagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcata

SEQ ID NO: 523589 - DNA, 507 bp, Homo sapiens
  misc_feature (62)..(62): n is a, c, g, or t
  misc_feature (145)..(145): n is a, c, g, or t
  misc_feature (354)..(355): n is a, c, g, or t
  misc_feature (362)..(362): n is a, c, g, or t
  misc_feature (388)..(388): n is a, c, g, or t
ccacctcagcctcccaagtagttgtgactacaggcataagccaccacacccagctaattttngtattttttgtagagaagggattttgccgtgtcgcccaggctggtcttgaactcccagactcaagcaatccacctgcctcagnctcccaaagtgctggggattacagccataccgggtgtcagagcatgttgtgagcacctctacctgggtgtccccctaggctacagctgctctcaaggtcacttcctctcacacagacaggcagtgaaactcatgctgaggactcatcttctgtacacacttttaagaacttctacttccaaagatacaatgaagttaataaatgaagcnnagcaganttctagactaggcttcacatagggtngcttgcagcatttagatgcatttctctagacaccacacctattttccaactgtaatattctgtatagaatgcaaatgttcagactttgcttttcaaaaacgttgtatggttcacagctg

SEQ ID NO: 523590 - DNA, 170 bp, Homo sapiens
tggcatagtccacagatgccagcatatctggtcccttaggaagcaggtgtaatggagagtgaagcttgctcaagatctgggttgagtatgtgtcaccgcatcaggaaatggcatccgtttaagggaaaggtttagatctgtcagtaggggataccgagactcgaatttcg

SEQ ID NO: 523591 - DNA, 479 bp, Homo sapiens
acccccggattggtgtacctgcatccttatttgaacgcggtcacagcgagcgccatcaccaacgcccagtcctgttcaagccattgcacaatgccggcacggaactggcttgaaaacgtcctggtcactgattgtggcacggtgcacgctgcatcacggtgctgaagctgcccgactgtcgcccagatgccttacgccgatgcggggccgcatcgcggtaacgggtaataatgacttgtgggttgatggtagattattgggctgttactttgtcagttcagcgttttaatctgacgcaggcttatgcagaggagaatgttttcatgtaacttatactaacattagttcttctatagggtgatagatttggtccaattgggtgtgaggagtccagtcatatgtctgggatttatcaggtagtgggtgttgagcttgaacggcctttctaaattggaggctgctttaaacgccgaatcggg

SEQ ID NO: 523592 - DNA, 552 bp, Homo sapiens
gagtcagcctgttatagttattgaacaaagtgaaaaagagactctcatgtcaaaaactggcaaattggcagactgtcctttatatacatgcagcgtgcaagctaaagtcagtaataacccatagaaaccaaagaacaggcaggctctatgatcactgccctcttgtctcatcatcgcgatgacaaggaccatttcactggtcatcaacgtttttgtttttcgtccatcaaaatcagcatgccttaacaacactggagaaggtgtggggtgaagggtcattaagggcacgcagtagccataatgccacaccctttgtgccagccactgcgcttctggaaacctaccccacagcggtcaaccaaaagacagcaaaggcttctggcactaagctggtcacaaacgcattactaattattgtgcacatgtggaacctaccatctaagcctcctttctaaggcgaaaattcccactactacatcttgccacccttctttaacttacacactttaggaaaaggatgatttttcagaaactagcactgctcattcaaag

SEQ ID NO: 523593 - DNA, 930 bp, Homo sapiens
  misc_feature (1)..(1): n is a, c, g, or t
ntggtcgctagtgttccctcgtggggttctggttgtgtgttttgctgctgctctgtggttgctctcttgttgttgtcgcgtcgcctatcattttgtgcgtgttctcattccgcgtacgccctgggggccggctcgcggctcccggctccccgccggggtctttaccgaccataatagggctactgctcagccggtgagacggcccccgatcttggtgccgagccgtgccctgttttttgtccctcccggttacaaatgtcccagatgtccggggttcggcaaagtcccctgggttctgcccatctcccccccgtcttgcgagtgtcaagggaactcccttgtaacaaagagcgagaatgtgaaaccacggggtcagaaaccggtgcacagagctggaatcacagcacccgtggggagagaccgcacggacgccgccgcatcatcccgaggtcaggatgtccgcccgaccaatcctgtgatctaaagttgtagacaagccccaagcctatcgtggagacgaacaacccccagccaggccatgggggtgcaggcgcccactgggacccccagtctttgcttccagagagtatgcagcccccctgcctcggttataaatgaggcgtgagtcggagcgaccgccctgagaacaaagggcgggaaaacgggcccctccacccctagccggcagattgtcgataaactgtatccaaacatgggggataaaccagcgagccagggggtgctccaaaggcccgaccccacacatggtgaccgccgcgcggacgcgatcacatgcccacacaaacaggggagatcaaaggacaataggtcccaccaaacacggaggtcacttccaccctatcatgtgaggcactgtccccccccaaagcctccgctccgtccccaccttcaaaaaatgtccacatgaca

SEQ ID NO: 523594 - DNA, 369 bp, Homo sapiens
agcacgaggggacgttgacccttcatcaacgcggagtgcgcgcttgaaactctgcaagttcaaataatgtgtgcgccccttcaagctggcgccacgaacttcaaacggcagaatatccttcaatgttgtattaattgtttcggtcacttgctgttgcaacgtaattgttggaacagcgacgaccacttgcttgcgctgctcatcagctaggtatgcgtatggcagtaaataagctaacgtcttgcccatccccgttggcgcttccgcaacaaaggctgtctcccctggtgtttctgacagttcagcctcagtgtaatgcgtgtaaatggcattcatcaacttagcttgctgttcacggtatgccaacgt

SEQ ID NO: 523595 - DNA, 225 bp, Homo sapiens
  misc_feature (201)..(201): n is a, c, g, or t
caggcgtgtaccgatctggtggttcccagcaagggatctattggctttggaagagaccgcttgagatagctccctagtaggatacgacacctggagtctggcttgctccgagcactcttcacctcgtcacccttgtgctgtcgagaacaatgttgagtgtaacgcgagatcactaaagcagctgcagcgcccggttctggngtgactgcgaaatgcaccgttctt

SEQ ID NO: 523596 - DNA, 914 bp, Homo sapiens
caattaaaactagaaatagcactctggtttcttttgatgaaaagagtgagctggtcaatgcaacattgggaaacggcagatgtaggtgagaagttaagtatttaatagtatcaaattgttcaaacatgctcagtataataactggattttaatggtgacctaaaaatggtattaaatattttcaactttcaaatgtggttttctttaagcaggagactgctattttagttgtgttaaatgatgaggagttttttttttttaaaatatggcgggaaaccttgtttggaacaatgaagcttatattaatggtggctctcaatagttcaacaaaattccagggagataggtaggtcatatatgatggcgagagccaaaatagcaaaacaaacattttaagtgtgtttcactaaccatttggtgtgtttccctaacacacttaaggttaatatacctaatatttatatgcatatctgaatttattacaaacaaccacagaaatctcctgcctgatatagttatggacgtgatctctaaatctggcgcatacaagtccttgcgggcatccacgggcccaattgatacgggatttggagccccagggcttggcccggccccctagcgtagagaacaacccaagatagacccgtgaagacagacgccactgcggcccctaatccccagcccaacggacacatccgtactcattttcactattctgacaccacacccttgtacactgcgcaacgaacaatcacaggtcctcaacatacccagacaccaaccatcggccgcaccccaacggccactacccagcaccgcgcaccgagaaagtcctcagcaaagacgacaaagcacgcgcgcaagaaacacacactgaccgacggacacgagaccaacacacttaccgacgccag

SEQ ID NO: 523597 - DNA, 133 bp, Homo sapiens
tcctcctcatcctcctcactgtcatcatcctcctcttcatcactgtcttccttcttggcattcttgccatcctaggcacgggggccaggaatggcaagaatgcccagacggaagacagtgatcacggggatcc

SEQ ID NO: 523598 - DNA, 423 bp, Homo sapiens
ttgtctagctcttcattgtatccgagctagtaggcaggtatctgtcatcccaggcataatggaggcaaggcaggaggatcactatgagctcgggagtttgagaccagcctgggcaacaaaacaagaccccgtctctaattaaaaaaaaaaaaaaaaggagggatgcggtggatcacgcctgtaaccccagcccttggggaaggccaaggtgagtggatcacgaggtcaggagatcaagaccatcctggataacacagtgacaccccgtatctactaaaaatacaaaaaatttagccgggcgtggtgacaggcgcgtgtagtcccagaaactcaggaggctgaggcaggaaaatgacgtgaacctgggcaggcaaaagctatgcagtgagctgagaacgagcaattgccctccagacggggcga

SEQ ID NO: 523599 - DNA, 176 bp, Homo sapiens
ctcagcgctcggtcccgggtgctgtttgcgtggccgtgcttctggcgttgcacactgtgtacgactgtcggggactcctctcgacgtcgacctgtccggactgacatgcttgggacctggcgcgtctgtttacaccccgtcgtgacctgggcctcccagcacccgtctctcctcgg

SEQ ID NO: 523600 - DNA, 193 bp, Homo sapiens
tcctgcttgatattgctgcggtggacttgtagggctggtcgctgcgccaatctccttaactccagctgtgatgtcttctggactgtctgcctatacgtagaaggtcctggagcttgttattatttcaaagaggttgtccctcattaagagatcaccagacttgagcagaaatatcaagggggtaccgagctcg

SEQ ID NO: 523601 - DNA, 156 bp, Homo sapiens
ggagtgttggggaacagcactcctcgtcagcaggccagactgccgggcgctgctgcttttcatgaggtcgatgcaggctgcaggtcgaggccaaagtcgatgaggtttctatcgatgccctcgagctggtactcctcctgctccaggatgaacatg

SEQ ID NO: 523602 - DNA, 589 bp, Homo sapiens
taataatcagggatctaaatataaaacatccttattacatttaaattatttcacaaaccacggctcctggttgacaagtaaaatatgaatattataaaaagctcaattcttcaaaggtatcagagttttaagtaaaaggcaggaaaagtcattattcggggccttatacatcttaacagaataaatatcacacttttctatagaaaatggcggaggaatatttttataatctaatgggtcagtatactcaggaactcattctccattcattacggcatgcataaagtaaaactggaagctcaccagggtcatcctctggaaacagctcacctttaactccaattttctctggagaatctagtggtacatcggtgtggattttagattctacttttggagctaaaattccatttttcggttgggcaaggcaaaccaaccaatctctgacaaggacctcgcttatcttttcacatgaaagagcaagttcacgggggcgaattccatctaaaagttcaataagctgtgtgatgctttcagaaaggtgaaaaatttacatttctactaaaataataacattatatttatttaa

SEQ ID NO: 523603 - DNA, 255 bp, Homo sapiens
atgtgatgccacacggcaacatgcatgtcagcacgatagcagccgaggacgatctcagcacctccttccccccaaccagggacaccagctcaacaacaatcaccacatcccagatatcctcatcattcagcctcttcatcttcactttcttgtctgccattctctcccactagatgctcacgctctatagagggcaagcagcattttgcttgtaacgtaccactgctagtagcatcgggtgttgtggccccacct

SEQ ID NO: 523604 - DNA, 205 bp, Homo sapiens
  misc_feature (140)..(140): n is a, c, g, or t
tctacagaaaaacagcagtagtactccagagtgaggtgtgagcgagatgagtgaaataccctaaaagaagaacatagcgagaagcccctggaggttcctcaggagaaatggaatgcaagacccatctatctctttctccnaaccctagtacaaagaaatctttttcccaggaggcagttgatgagtagcgatctttaagagaccg

SEQ ID NO: 523605 - DNA, 133 bp, Homo sapiens
tacttcctgggaggtggggcggggactacggaaaaggttcaaccaggctgtggcaaagggccccagtcccagccttggctgggaaggaggggcgacagcttaaggtcgactaaaaccaagtctgttttcctta

SEQ ID NO: 523606 - DNA, 469 bp, Homo sapiens
  misc_feature (191)..(191): n is a, c, g, or t
tcctggataccgcataggtattggagaaccactagcctaagagggaaagacttcaacacataaccttcaaagaaagctttccctgagggtatttcctaaataactttcaaaagttaaaaataaggatgggggagggccagtggggatcactttaacctattactcttaccctagctttttttttttgaaanagtctcaagctggagtgcaatggcgccatcataactcactgtagcctccatctccctgggttcaagcagtcctcctacttcagcctcccaagtagggactacaggcgtccaccaccacacctgattttttgaatttttagtagagacgaggtctcactatgttactaggctggtcttgaacccctgagctcaagtgatctcctgccttgggctcccaaagtactgggattatatgcataagccacagcgcccagcctgtcgctttcttttctttcttc

SEQ ID NO: 523607 - DNA, 224 bp, Homo sapiens
ttatcgatcttgactggaatactcctgtgcgatcttatacaacacaacaccgaaataatgtccaaattaatatatgcttaaaatgcagcaataaagctctccatttatgttcaaatattatgacagactcactccagagctcatgtgtctaaaagaaaaacaaaaagattaaaacaaaattatatatgcactctatatacctctgattatagaatgaaacttac

SEQ ID NO: 523608 - DNA, 228 bp, Homo sapiens
cttatcttcacgctataaaattgttcatctcaagcacagcatccatcttatggccttcatgcattgtaaatcttctcagtgaggctatcaaactcccactcatgcaaaacaacaggcatacacttaacctgacttgctccagtatgtcctttctgtttgtcaaacattgcacatttggctctttgtggcacaaaacaggcacaaacacacaccacaaccaacacaaca

SEQ ID NO: 523609 - DNA, 171 bp, Homo sapiens
aggcacaggtgccttggtcagagagtctacaaacactgatgattctcgtggaggctgtggttgctgacgaagacgggggcctgtgactttggccttgaaggggctgcccccaatgtggtagggccgcgtacttatggagataggtagctgccaggtgccatgggggtatag

SEQ ID NO: 523610 - DNA, 1835 bp, Homo sapiens
gctgtagtctcccgctgccgctgtccactgcgcgcttcgctctccgccgcccgaggcccgcgctgctcgccatgtccctgttgccaccgcacaccgctgggtcgcctcgtgtgctgggcaccatgggagatgtgtgtgctgcctggcatgtgactgctgccctgccagcgcctgctggctgtgctgcagcctttcttggagctgctgtgcacacctgaactgtgacacgtgcacttcagtgtacatgtgactgtgcagtcctgagaccatcctgggcgtgctgggcgctctggtgctggtgctggtgtgctgactgcagagttgaaaatttgccatcaaggccaacccttgggatgtgcaaaatcactaaagcctgacagtgtcctggtcccatgctggagacgtcattgaagaggctgcatgtgtccccaagtggatctcttctactacacacacctgaccacggcacccctggctggaagacgatgctgcatgcctgccagctggctgaaccaggagggcaagttcgtggcagcttgggcctctccagatatgctagctgggaagtggccgagatctgtaccctctgcaacagcatggcttgcatctgccactgtgtaccatgtcatgtaccaacgtccacaacccggcatgtgtaaaccgacgcccttccctggctccagccatcttgacctgaggttctatgccgtaaaacccttggctggggccgcgtgctggcaccgcccacctcagccagcactgaatcgcctctggcaccctaggcataacttttagcaccacgcaaacccggagcaccattcagcatctgtatacaccctccatttgtaccgacacggataggccacaagatgcacacatatcacagacaccgacggcaaagcagtgatttgaagcgagaagaaaagaaacaggaccaaacaagacgcaaaaaaaaacagaaacaatcaacaaaaaaaacgccacaatgaacacaacaacaaacagaacagaccaaaaccaccaaaaactaagaaacacgacaacagcgtgaaaccacaacactacacacacaacacaataacacctcatactcaccaacacgaaaaacaaaattaactcatacttatactaatccaatcaccaaatacccaactaataatccattctattattaactatttacttataataatcatattactattatctgatccattttagcccattaaccctcaaacgacctattctatatcatacctataacacactaactcacaccaaccacaccacgatcctaccatcactctgccaccatctatcatcgtctccctgcacgatgccactaggtaatgtgtatcgttttgtttctctgctgttatcactatatactttgtctttgtacgtaggtcgtgggtagggcgttcaggtcctcggcagtcgcccgacttgtcataggcatggcacggaaaatgtgagtggtggcgagtaagagtgggacgcgcgtactcgcggccgcttaactacctaatataaacactcatctaaatgtacatacgaagacacacactactccagcaacgatacaacaccacacccatctcagcacacacacagaagcctacactaccttgaaacacgtacaacacacaccgctacttccaccaccacacacataatcatcacctcacattcatcacaaatcatgatatccatactcctgacatcagacctactcaaatataccaacctccagcacttcttgcatccactctaaagacaactcactctacctctatcaccatacgacactacatcaaaccaacacttactatcaa

SEQ ID NO: 523611 - DNA, 101 bp, Homo sapiens
accaaatgacttgacggaggaggacgggccgggagaagttgattcaggagcttgtgaccctcattgagcagcgcaacgctatcatcaactgtgtcattggg

SEQ ID NO: 523612 - DNA, 549 bp, Homo sapiens
gatgcgggaagccggactctgggcgtcatgtactacaaagtttacgtggtcttcatcgcaatgacatgttcgagtcatggacgcatcgggcttcgtgagtgcctatagcccgcagggattaaagcctgcggttatccacagaagcaccacctatcatattggccacaccaactaaactgagctccgattccacaggtgtatgattatgctgggcaaaaacaaagttccaggtctacaaaagtttttccagaaagctgatggtgtgcccgtctacctgaaatcgaggcctcgctgaccaaatgctgttatcggatcaccatggcgctgactgtgggagggaccatctactgactggtcgccctctactatggcttcagctagtcctcaaaaataccaacagtgcacgcgtcagtgcctgtcagaggacgtggtatggttatcggcgataaacccgttgaagtcccttatacatcggtaagttaacattgctctctcatacactggcgatggcttcacaatttggccagaaccataggacgcatctccgga

SEQ ID NO: 523613 - DNA, 815 bp, Homo sapiens
  misc_feature (815)..(815): n is a, c, g, or t
gctggaatgctttttgtttttttctttcacttatataagggataatttttctttttctttttttctgagacagagtctcgctctgttgcccaggctggagtgcaggggcactgatctcggttcacggcacgctccgcctcccgggttcacgccattctccggcctcagcttcccgagtagctggggactacaggggtgcccgccaccacgcccggctaacttcttggtgttttatagtagaagacgggggtttcacctgtgttgggccaggatggtctcgatctcctgaccttgtgatctgcccgactcgagctcccaaagtgctggcgaattacagggctgtagaagccacacgcagcccgggagggcagaaacaccgaaatatggtacataacactctatacattcggggacataaaattctcaaaaagaccccctgtgacactcgtctccacgacgactctgaaggtgccgatgtgttacaacttggacaagaacccggtaccctcataagggggccaaaactcccaaatagcatatacataggcgacacaggtgacttccactatggtaccacaccgcacaaaactgacccccgactgctgtgtggaacgacccacctgggaccaacagatcccttcacaagaccccctcaacaacatggggctagactcggccaacgaccgctgtctcatcttacaacacggaattcccatacaaccaccacgcagggggactaaatcaccacaatttcccactccacaagttgacacccgaaacgggccctaccccggcgccacaccatccccaggggn

SEQ ID NO: 523614 - DNA, 162 bp, Homo sapiens
ttcagccttttcagggtggaagaaaatacctttttttttccccttctttttactctcactggctgaaaagctctcaagggttggaaggggggttgggaatcctgcatcaccaactcacggacgggtactgaggcctgagacaggccaagagcgacggacagg

SEQ ID NO: 523615 - DNA, 462 bp, Homo sapiens
ttcattagatcatgccttctcagtatggacgagcctagtgtgttggtatttgccacttgatgcacgttccctatagccttcattagatcatgccttctcagtatggaagagcctagtgtgttggtatttgctatcttgatgcacgttccccattgccttcattagatcatgccttctcagtatggaagagcctagtgtgttggtatttgcacaaacatttgacttagtcacatgaacggtatctgttatatcaaccaaatacaatggattaagaatgacaacgttacctggcctctgctcgagctcaacttctgctgaaatgcagagaaaaaccacacatcctatttgatgacacaacatatctgatatctcattagatccacatcatatttctatttattgagtcacacagatcacataacaatgtacattaccgtcgacgcggccgcgaatttagtagta

SEQ ID NO: 523616 - DNA, 654 bp, Homo sapiens
  misc_feature (109)..(109): n is a, c, g, or t
  misc_feature (111)..(111): n is a, c, g, or t
  misc_feature (113)..(113): n is a, c, g, or t
  misc_feature (623)..(623): n is a, c, g, or t
taccacactctatagatagtctgaagggattattagtgccagccagccagctgctgtgtagtcagtgctctttctttgtagccagagatgtatgacttgggaggctccngngnacagcatcactctatttgcaagtttgcttgtaatgtctgagacttgcttcaggaaatgtaatgtcaaaatataatacatcctttcccaggaaccatcattgacataaaatagcaggttgagcaggttggcaatgtagtatttgtgggaaattgaggaaagaatggttaactgtccactggaggttgagaaagtctcaaagaagtgagaattgaattgagttgcagggaggcgagaattgagttgtagggaggcaggcataggaatgtgccttctaggtactaggatcaggcaacaaaggcatattcaagactgtctagtcctctgccacaccttgcctccactaactttccctgaaggggcgctgtctgctactgtcgcggacacaaaggctgactatggcctggaaacttgagtacagagacaagagcgcttttctgtacacagctaggtttctgcttgctacccaggaaccggggataatcactagtgaattccgccgcctgcaggtnaccatatgggaggtcccacgcgttggatgca

SEQ ID NO: 523617 - DNA, 293 bp, Homo sapiens
ctgctacctgcgttacgtgattgacccttaccaactggccgaatttgaggcctatgccaaagtctggatcccgctggtagagaagttcggcggccagcatcatggctacttcctgccctcggaaggtgccaacaatatcgccctggccatgtttaccttccccagcctcgcggcctatgaagactatcgcgagcgctcaaaaaccgatgccgagtgcattgccgcgtttaaactggctgaagataatcgctgtatcctgagttacgagcgcagttttttcaggcctgttttcg

SEQ ID NO: 523618 - DNA, 1788 bp, Homo sapiens
  misc_feature (274)..(274): n is a, c, g, or t
  misc_feature (324)..(324): n is a, c, g, or t
  misc_feature (1786)..(1787): n is a, c, g, or t
ggaggtggggacccggtcgggataggctgcagtggaaggaacgggggatggtgagtcggagcaccgtcggtgtggccaggagaagcagttcctggccgggcggctggctgtaggtatatcttcatctataatccgcgactgtctgggccgcggggatagagagagggtagtgcgtgaatccgtagtaggttgcatggaacagtgatagattggagaaaccagttagttgaatgtatcaaagaatggatggaagtgtcgtatggaaggaaggttnatataagctcagtgtgctcgcaagacggtgggctgactagctattgtcantataaaatgtcttcgaggggagatctcgtgtaaattagctgggccgagtcactttggcgttggggtcctagtgtcccatggtaccaagtagttggcgcttgggctcttcggtgtcgggctggtggggggagaaccgtaggctgcgattctaagtctctgggggcccgactcgaagttgcctcggtgtgaacttgcacacaagcaccttcgcattgaacccccctatttgtttagccttttctttacccattgcttacttctaaaacccttaggtttacgccatattagcctccgttggagcataattccgaagttatttctaccaccttttgggtactctaacttggattgcgccgctctagaaagcaatgggtaatttttgtctggtggcatccaattgcggcgaggatgcgttttcaaccaagggcaaggtagattccacattcatacggcttaaatttgcgaatggggcctttgggccttggtaacttcccaagaaatttggttccttacttttcctttttcgtggcccccagtttttgttttgtgggcaacgcgcgccttgtttgtggacccagccagggttacgttaacgattatgttctttcctttgggcaacgttcggtttggaattggtgccgcataaagttgtaagcgtgtggggtatttggtgtcatgacccgaatttgttggtgctactcggcgcggcgtcacattaatttcgatgtttgcacccccgattcccagttggaaacacccccgcggagggtgtagcccttggttggggaggtacatatataggacgaatttatgaggggaggcggggtgcgattcataatataagaatatcccacttgctcgtgggtgggaccacctatgtgtgttttagcgcggtgtctaaacacgcggggctttaatggtgtggttataacaagaggtggtgtctcgctaacaatgagatggggaggagcggtactatgtatatagagagggactatagcgactttgtagaagaggagaggtgttatatacaaaacgcgtgtttgtgtatatgtgtggacaacaagtgtgtattggtagcgggaatacttatgtgtgggagagagaaccaattatctcttggtgtgggggaggggaaacaatagtggggcgaagaaaccctcaaggaggagatgtattaataggcgctctagggagagaaactaaacgtaataagagcggactatcagtggctggtaaacagagagcagactatttagtgtgctagtgagaacatgtgttactagcaatttattgaaatagcatagcgtcgagctagtacggatgtactatactacgaggcgtagtagtgtatgagtgtagttggtagtactagtaatacgacgagtaataatgagctgtagagatagttagactgcgaactaaatgagtaagatggataggtaactaagtctatatacgnng

SEQ ID NO: 523619 - DNA, 109 bp, Homo sapiens
tccacccacttagacttgtaactagggtctttaactgaccaaaaagcgagaaaaccgaaattaccgagcatcctgtacaatgtgaaaaccgtattctaagccgtaccta

SEQ ID NO: 523620 - DNA, 503 bp, Homo sapiens
atataatcgaagccttcatggataatttcaagtgttaggcccgagggacagtgggcatgaccatctttctcccattattaaatggttggtggggggatgccagatcactcatgagtactcaaagtcagacactcttggtccttcttggtcattctagcagttggccgagtagaccttttgatacatgggttcttaatgttactatcatgttgtgaggttgggttgtaggcgttagcgtgtcgagctttgcatttacagactgtcttcgaccatatttgttcccttgccacaacagatatattcagcagtcgtcatctcgtagtgacagctgttgattgttagattggtaaagacccttgatcttgactcaaatgtgtacttcttgtcattgtcaccgggtttgattttctgaactgatttataccatgttacatgaggctctgggtggacagtgatagttactccaaagcggacattatcatctacataagctggcttattat

SEQ ID NO: 523621 - DNA, 841 bp, Homo sapiens
cctccaggaatgttcttcgtttgggggaaactggaagatgaacggtcggaagcatagtctgggggagctcatcggtactctgaacgcggccgaggtgccggccgacaccgaggtggtttgttgctccccctatctgcctattatcgaacttcgtcgccggtcagaaccgcttagatcccaagcgattgcctgtgaggctgctgcgaagatactgctactaaaatgtgactatactgggtgcttattacatggtggtagtatcatgtccctgcgtcatgcatcaaatgcatctgctggtagtccatcgtggggtgcgtcctagggcgtcactcagcagtagaacggcattgttctttatcgcgggtagtctagaagtgaggcatgtatttgtggcgaggaacatgtgagtcccaatgcgtccttgcgctagacgggacctcgagacgttaactctgcacctgacacttcgtggtgatgaatgtctacgcctgaaaacgggtaacgcttggacgatcacctgcatgaaaggttttgtctcttacggagccagacgaacggtcatcgcatgactaacgtgagatggatctggtagcctatggctcgatcgctggccctattgcagtcctgttgtgtggccagttggtccatggcaagactgctacagcccaacaggcccaggaagtcacgagaagctccgagtgatggctgaagtccaacgtctctgatgctggtggctcatgagcaccgtgtcctttattggaggctctgtgaactggggcaacctggaaggagctggccagacagactgatgttggatggttccctgtggttggtgctacca

SEQ ID NO: 523622 - DNA, 1211 bp, Homo sapiens
  misc_feature (573)..(573): n is a, c, g, or t
gcaggatgggggcacctgcagcgcgggcgtggagctcttctatgacgtggctgtcgcgcactaagtcctgggtggggttcggagatcctgtgccggtatcaggaatatctggcaagcatcagagcctgctaggtgtgctggcggtgccaggcctcaataagcatggggatcactcgtagaatgatcagtcggagaatcgagagccatactcgaggttctagcttacccgcgacgaatagggacatatagcgatggctaagaatgacgttacagtctcctgtagacagcgatactccagacttacaccaagtaccaccttttgcgccaatggtactgtgcttgctcgtgatgtatgggcattgtacaaaacgtgagaggtattagtcgtggcacatggcgatattcactcaaccgtgcgcatgatatcgtgtgtgatgtcaatctacagtagtacctgtgcgtggaaagaaatggcgtcaccgggagctatgtgcgacttgtcgccgtaccatgacgtctacagagggatagtgaaatggatacattacagccgaaagccgtacacgaaagcanattctcatgggggcaggcctgcctgacagaaagggcctggtatatctgtcatgacagacaccaatggccccacgtgggacctgcgtgtgagatagaggactccggctagacccgtcgctagaaggagtgaatgaaaccccacggctctaaacgggaagcatccgactggcaagcgtcgagcgctcgccaagactaacggggaagcccttgggggagctggacccacatacaaacgattgggcgccagtggtgagcgaatgagggacaagacagcccaactatgggttgaatatgtcggcatcttggacccgggactgggtgcacggcgtagactagcgacggcgaccgtgacttcgtgaggaagacgagagttgagagtagggagccccgttaatgaacgcatactcaatgcccgggtgaaaattggtccaagactttttcacacggaatgttggcccccgccgaagtggaaaggccagatacctcgtatccgagtatagacaacagaaaagcagagggtcgaagtcactggctttaaaagcccttgtggcattccagagcaataaagggtcacctggggaacttgggaactttcattctaatcctgataagaaggtaataggaccgtggtgggcccg

SEQ ID NO: 523623 - DNA, 140 bp, Homo sapiens
cgttggtaacgggcggaccggaggtgaagttctgccactcgacgttgtaggtggcgccggcatacttgccgtccttcggcagatacttgtcgaggagcttcagctccttgatgacgacaccggtgatcaccgtgtttgtg

SEQ ID NO: 523624 - DNA, 659 bp, Homo sapiens
tcctcctgtggcagaaaccatttgagacatgactttacttgatgtctgaagcgttattatggggtactttgttagggaggaatgcctttcgcaagtaatgtatccattccgctgattgatgggtagggctagcggatggagcccacggctccctttgcacacacgagcagctacttctaagccatatcgactgttttgcagaggattggtgtgtgctgcctcaggaggggagggctggtaggagggggggagaggtctctgtcctactgctctccagagggcatttcccctatgcgcccttctccacacagggcccaagccacacatcatcaccacttgcctccaaagtacccaaggagggtaactcgttggagtgagcagtgccccctgtaggggagagcctgttaaatttgcgggggcttccaaagagtgtggggggaaagccccaaaagatattggggggtttcgagtacaccctttgtgggggggcgccctttgaccccaatttgggcgccaattaccgccaaaaaatggttcccagcggaaagttattatgccccccctctttggtggattgtgagcccccccactaaaaggcaaaagagaaaccagaacgggcgatacggggctcaacccgcaaaaaaaagggttacgcggga

SEQ ID NO: 523625 - DNA, 344 bp, Homo sapiens
agcagaggctgcttttattttcacagatgtcttcgaccccacataagcaaggacactgtatgttacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttaaaaaaaaaa

SEQ ID NO: 523626 - DNA, 109 bp, Homo sapiens
gaactgggtgatgctgtgttgccatctgcagcagtgaagaggctgcagacagtcacatagcctgggcccaccccgtgggcctgcagcagtgttgagtggtgcacactgt

SEQ ID NO: 523627 - DNA, 413 bp, Homo sapiens
  misc_feature (1)..(1): n is a, c, g, or t
  misc_feature (326)..(326): n is a, c, g, or t
natttcttcatttttcaatggtaaaatacacgtaacataaaattcaccattttaaccttttactaataagtgtacagttcagtgatattaagtacatttgcattgttgtgcaaccatcactaccaccaacctccagaactcttttttgtcttgcaaaatcaaaactctgtccccgttaaacactaactgcctgttctccttccctcagcccctgacacctaccattctattgtccgtctctatgcatatgactcctctaagaaactcaaacaagtgcaatcatttgttcttttgtgactgtcttttttttttttttttgagacagngtcttgttctgtcgcctaggctgggagtgcagtggtgcggatctcagctcattggcaacttggcactccggggcttcaggtggattt

SEQ ID NO: 523628 - DNA, 109 bp, Homo sapiens
tacctggtcctgtgcagaagatcctcgaatgcgcaggctgaagcgcaaaagaagaaatgatgaggcagagtgtccaatgtaaacctgctagcttgttgcacctgtggag

SEQ ID NO: 523629 - DNA, 608 bp, Homo sapiens
  misc_feature (214)..(214): n is a, c, g, or t
tctcacaggtgcgaagtcccacgaactgttcgtccatcatgggatcaaggccaatatgaataatgactaaggctgagatcatttaaggctgatgttacgtccggatcaaagttaattgatcaacaagtgctgtcatctcaatgacaatatctgaatatctgtcattatattgcactcggtagttatcagtgcatgtagcctataaatagccacngcaggtcagcttgactaaatcattcagtgtcatgtaggcatgtaacatgcatggctcagcaagttccgcgctgacatacgagtcatattcaggtcatagctcaactgctgtgtcatagcgattccgtgatccacgaagtaatgtatctcgaacaatgctagcagccatgtatatgcatttctggtgcatctattatgaaggctatgcggcaggtcaatatggtcgtacagatcttgagactacggtagtctcagacataacgcggtatcatgaatagcacgacttgatataacaaaatcgatccggtggattctgtcttctgatctgcctgtacaactgcactctctatgacactgttgcagtttcacaagcagtaggctatgtacagatcaat

SEQ ID NO: 523630 - DNA, 436 bp, Homo sapiens
gacgcgcgctcccgggcacccaatcgcgttgagctttgccgcgacgagtgcgaggtgctggagagcgacctgtgccgccaggagtacaccatcgcccgctccaacccgctcatcctcatgcggcttcagctgcccaagtgtgagcgctgcccatgcctgagagccccgacgctgccaactgcatgcgcattggcactccagccgagaggctgggccgctaccatcagtgctataacggctcaggcatggattacagaggaacggcaagcaccaccaagtcaggccaccagtgccaccgtggccctgcagcacccccacagccaccacctgtccagcacagacttccctgagcttggagggggcacgcctactgccggaaccccggagccaaattgaaggccccttgtttttacgcaggattaaaacgtacgcatgg

SEQ ID NO: 523631 - DNA, 958 bp, Homo sapiens
  misc_feature (102)..(102): n is a, c, g, or t
gctatcagttcgcactgggtttggcgccaggacagaggtgtcgagaaacgtatccctaatagctatcatgggaatgggataagcagtcatatcaccattgtnatgtctatggggacgcgttagattgcggggtacaggtcacaacgcaattgactggtgcgtatctagatctatgaaattgctgaagtggttcatgacaaactgataccatatgaaaagaattatttggtacgcgagggttgatggtcgatagcgaaaaaggggtgttcccttgaacaaaggtaatgcgttggatgcatgcggataagagtggtaaaatgctagaggggaagtaacgtaggtaatcgtacgatattgagttatctacttatgtgtacaagttgtgaagactcagggaagtaacatattgtgagttattcaatgtgaatgacgcacgtggaaaacaagtgaaacttataatacgaaggcaacagtggattatcagggtgaatgtctcaagagtcggaagtggtggctgtacgagactagtgagacatgtctgaggggatagtgaaggaggttgggaaaaggtggatatctccaatgtaaatggggaaggacccctgatgtaggcgtggccactgtggtggctctgacagcgactggggatggttgggaacaacgctaaattagtaagaggtatagttggaaccattgggactgaccgcgtgcactgtcacaacaactccatctggtcaagcacagaagctttgaatggaaaccttgttggaaggatgcgccatgggcgttaactttggaaaactagttagagtaactacactcgatcaacgctaacgggttcgttgcacaatgactgggtggaaaggggaggcccccctggggtgcgcatgtgacataatagtccgggggcacagggtggaaggcccgcaagggaggcctaccggggaccactttgaaa

SEQ ID NO: 523632 - DNA, 277 bp, Homo sapiens
tttttcccctaaacccccccccccccttttttaaaggggggggagaacgggttcccaaccgttttttttccatggcccctttaggtttggggggaaaagcggggtttttttaacccaggcttgggaaaccccccaaagggaaagggaaatttttttgggcccccttgggttttttttttgggggggggcggttttaggtttttgttttttaaaaccgggcctttttttggggacccccttgccccaaattttggccccgatttttgggcccccttta

SEQ ID NO: 523633 - DNA, 268 bp, Homo sapiens
gcacagacgtattcctctagcacacgcagctggatcccagcccagcctttgccacagtctcttctagctgtagcatctccacagcaagcacgaagacatggggggatccatcttcactgccactggccacgagatgccgtccctcacgtaaggacaaggtgtgcagtctgaggataccacagctgtgggcctggagagacagagagggggtgccaagccgttagtgaagcccaggatccactgcaggctccaggacagtttagtcatg

SEQ ID NO: 523634 - DNA, 192 bp, Homo sapiens
atctgtgtcttatatggatcttcacttggaagaaagtttatcgtccttctcagaaggagattagacacaacatacggtaaagccaaaagcaggagcttatagatttgcatgaaatggaaggcgttcttcagaacttcttcataacccacgtgacatcagcacttccttttcccactggtattttctacactt

SEQ ID NO: 523635 - DNA, 257 bp, Homo sapiens
ggtttgagggctggaatttaattaacctcgccttcaaggtgtacaataatagaaaaaagttgcaattccttgcctccactgtgagacaaaccccagccacatcttcggcacacaagaaatttcaaaagcctgaaccgcagcagccaggcgtttctccagaaaccttcttccacaggagctttctacacatgtccagaatctcgccactcgggcacgggattgtccccagccccgggatttctcctaagacgcgtgcc

SEQ ID NO: 523636 - DNA, 703 bp, Homo sapiens
tgtatttaacatctttaagagcatgatcataaagagctatttttgacaccccccccccccatttttttaacttttagagttaataagggtttaatatctcttctgtccatatggttcttcaaaggaatgaggtgtttaggtggctggaaaacgcatttgtaggaagttagattgcgaatttagacaaggtgcggttattcactttgacgatatgtctcatttccgaacgaatgccttgtggaacccaggtgtgggttctactcagtgccatcagatagactggagtcttctctcgtaaggtcaccaattactatagtaatttcggatctctgaatttcactttaaattattggcagtttataacagacctctagaagttcttaacacactcgtgctcaccatttattcactttggacggctatttcacagagtgaatctactgggctgattttaacacttctcattcaattgcccccattaccttctcagcggaccagcaagactgcttcgggggcaccacggctaaactgtggcttcacacctcagactggcacttgtgcttacccctttcgtctaaaatctttgtgtctaacattacacatctaaaccaacacattattcaaacactgctggtggttctcccccttccaggggctcggcttcaaaacgttctcagccgtgctaccccttcaagggttatta

SEQ ID NO: 523637 - DNA, 159 bp, Homo sapiens
caaacatagtatggaagcaaactttaattttatataacgtatgctatggagagctaagacaatttaaggactacttgttttctatttttttttcttaataaaatggaatccactgtgttagaatacctcttgataccatgtagcttcatagttggttgc

SEQ ID NO: 523638 - DNA, 194 bp, Homo sapiens
caatagatgcttatgacaacttttgacaagatctcgcttgctcaacgtttggaaaacaagaactcaatgaggtcaagagaaatttctgcttatctcttcaaaggcaacaatcgctggaaacagagtgtagagctgtgcaagaaagacagcctttacaaggatgcaatgcagtatgcttctgaatctaaagatac

SEQ ID NO: 523639 - DNA, 109 bp, Homo sapiens
agtgtcttcaagagcatgaagcataaagccaaggcaattcaatagggtactatcctcaaaatttatgtcttcctttggctatgggcacagggtaagaaaatgcatggca

SEQ ID NO: 523640 - DNA, 252 bp, Homo sapiens
tggggtttcaaaagtaaatcagttggttttatatataaaaaacttataaaaaaatataatgtgagtgggtgtgttttcttatacattattatttgtgtgtgaataccattatatatttttcatcgtgattaaaactctcctataaaaaccaaagttaatagtttggcaataggatatacttataattgtgggtgacaaatctttataccgcgcggcgctgtgttttcccaaaaaacattcacctttatagcc

SEQ ID NO: 523641 - DNA, 479 bp, Homo sapiens
  misc_feature (45)..(45): n is a, c, g, or t
ctacttatgaattttagaatagctttttctaattctgaattaaanaaagtccaggaagttagtaatttaaatcagtatgttcatttcactctagtgaaactactatatgttgtaaattagttaaaaatggatgttcagaaaagaattgaaatcaggacaaaaaattacagatgctagtgaggttgtagagaaaaaggaatgcttatacgctgttagtgggagtgtaaattggtccacccattgtggaagagagggtagagagtcctcaaatatttaaagatatttgacccagtaatcccattactaggtatatacccgaaggaatataaattgttctattataaacacatactcacgtgtatgttcattgctgcactattcacaatagcgaagacatgaaatcaacctaaatgttcatcagtgatagactggataaagacaatgtggtatatgtacaccatggaatactatgcagccgt

SEQ ID NO: 523642 - DNA, 537 bp, Homo sapiens
gcgtgtgttgaaatggcaccacccaagtgagagccgtcgtattcctgggtagaggaatgaacaatacatcgcaggttgtgactggcttattcctagcgcttcatctaatatggaacccgcaatactgagtttcaatgcgaagaactccctttccttggtctctgggaacaagtcactgctgaatctatgtgattcgctcttcatttctcatattccatatgaattctcatgattcagtaatgtgtgatgatatgtctagatttcttgtgctgccatattgcccatctcagaatgattgggcaagctgagaacatcattagaccacatagattactctatcattgtaatgaaaaatattcattacaagcaaatgagagcctagtatatttcaatcagtgtttgccttgccatgtactgagatacggatgacgagaaataggtcgaatgtctctgcactccgttgcttctgggatgactcccatggttattacatattcccacgttgataacatattttcacatttattaacgtgtccg

SEQ ID NO: 523643 - DNA, 185 bp, Homo sapiens
atccgactctaagatgtaggctttattattttttcattcgcagagaaggaaactcagggtcatttaatgatttgtcacacaactaactatacagcaggttagtattacagaagaaatctaggattctctcctactaagactcctgatatattgggagtgagtacttacagcatcattgtacacat

SEQ ID NO: 523644 - DNA, 1618 bp, Homo sapiens
  misc_feature (1287)..(1287): n is a, c, g, or t
  misc_feature (1369)..(1369): n is a, c, g, or t
caggacccatgtactatgatgttgctgctaccgaccacgggtcttctatatgagtaggaatgcttgtcctgtcctcgttcttctgtcccccccgacgagttgttgggggatagaatatatctatgctcttggcccgtcagccacacacatgtttcctccgggcaatatttttcgtcccacacaccactgtgtcacacataatgtattatatggggcctcttgggtgcagccaaaagacaacaacgaagcgcgtgtttcttcccctacaaatttagtatagggcgactaaattgttttatctctctcgcccacaatgaggtttttaaacaccgttgtggttgtcctcgttggagatgcacaccaagaacccacaggagattttttattaaaaatgaggttcttgataaacaaagaaatattccttctcctcaattatttatgtggggaaagttttgaagagttcctccccacaacgcgccccaacagaccgttttcctttattaatggagaggatttcatataatatgagaaagtggcgcgcgcccacactaataaatggtggggggatgaggaacaccttttccacaggtttgcgtctccccacatgttaattgtaagtgtgtcgcccccccttgttttatgttccccccaccccacagggtgtgccttttatatgtattatgcccccccctccccttattataccccctcggtggcgccccacatttgtccccacggtaataaccccccactttatgaaagaagaccttttcacagggcccacagtttttctcgtggagattttctctgggaagagagcctcctcgccccctcgtggtgactaaagaaatatacagaaataatagctaagatatacatttctggggagacaccttcggagagagaacacacatacgcccacgacagacccacgcccacggaatacacgagaggagtggcccacggagagcccacagagacaaaaagtggaggaacaaatagaaagctcgagagagacacacaccccttatatgggaataaacaacatttgggtcgcacacacacaatatagcccccccgcgagagcccccactatagctcgtcggcgcgttagagatataatgagcactctttgaagagggggagcacacagcgcacgagctgtataaatatacctctataatgtacagggggttataacaccgtcgagaccacgctcctgttgattacacacggtgacacacaggcgcacacacacctgcacatgaaatgttggggaggagaccncacacatgagagatccaccttggtccctcctgccctatatgtttctcctgtgtgcacacacaggtctacacacgatgtctcncctcccttatggagaatcttgtcccccttcccacccctttaccattaaacaaaggggaaccacttgaatacttttcaaagggaatatataaccgttttgggtttaatagtttccagtataataccattttccataccctgtaaatttatatttcgtgtaaaagaagatttactgctatccccggatgttcggacttggtgcccctgatgcatttggaaatccaataaacgtattactggaaattcccca

SEQ ID NO: 523645 - DNA, 477 bp, Homo sapiens
cgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccattttagccgggatggtctcgatctcctgacctcgtgatccgcccgcctgggcctcccaaagtgctgggattacaggcgtgagccaccgcgcccggccggcttgagcaaattttaatcatgcttctcctctccttacagacctctgaacctaaacttggttcaaccccaagtctaagcacgcactaaggtacagaacttgccccattaacagctcattccaacaactaccacacaaagagaaacatttctggttgaaccaccccaatcatgctgtctgccaatccccacctagatgtccaggttct

SEQ ID NO: 523646 - DNA, 396 bp, Homo sapiens
ttacaacccacgatcacaaggtcaagtcccacgataggccttctgcaagttgaggagcaaggaagccagtggtggatcagtccaagtcccaaagcctcaaaagtagggaagccgacagtgcagccttcagtctgtggccaaaggcccgagagcccctggcaaatcactggtgtaagtctaagagtccaaaagctggagaacttggagtctgatgttcaagggcaggaagcatccagcacaggagaaagatgaaggctggggaagactcagcaagtcaagtccttccatgttcttctgcctgctttattctagccatgctggcagctgatttttggaggagtggtttgtctgcagttgcacacatctgtgatcgtggggttgtaagggtaccgagct

SEQ ID NO: 523647 - DNA, 311 bp, Homo sapiens
gagacaagatctcactctgttgcccaggctggagtgcagtggcacgatcctttagcctcgatctgctggactcaacgatcctcccacctcagcctctcaagtagctgggaccacaggcatgcgctactgtgctgggctgattttttaattttttagagatgttatcccactatgttgcttaagttggtcttgaattcctggactcaagtgttcctactgcctcagcctcccaaagtgttggaattacagatgtaagccaccgtgcccagctctgatttacgtgtatttctgtccccttctgtcgtcttctc

SEQ ID NO: 523648 - DNA, 437 bp, Homo sapiens
aaagatggccatggcttattaaccaaagtcaggcactgggcactggggaaccatgggaggcacggccaccatttcctgtgctatcatctgagccccacctggcacacctgtggggcgtttcacggcaatacctgttcactgaacaagtgaaccagtgagaatgctggctcttgttttttttttttttttggagacagagtctcactctcgcccaggctggagttgtgtggtgcaatctcggggacctcactgcaacctctgccacccaggtttcaagcaatttctctgtgcctcagcctctccttggagttccctggaatttcgggcgcctgccaccgcacccggcttaattttggttttttcagtagagattggttcatatttttggccaggctgttctgaacctcgtacctcgttgttaccttgcctttggcctc

SEQ ID NO: 523649 - DNA, 1417 bp, Homo sapiens
gtcgttcctcctatttgttgcatgttttcttttctttctgtgctgcctgcttgttttcttcacgcgtcgggagttttcctccgcggtgttttttcgtttttgtcgtctacgtgctgttgttggcggcagcagcgctggtgtttgtctgttccctgtctgttcctgcttttgtgtgcaagaggggagagccctcttcgcttctctctgctttgttttggtggtgagccgccccgtttgtgtctcttggctccacgtgctttgtttgttgggggggaaacaacttatagtcgtctcgttctcttccctgtggggtgattgttggcctcctgctgttattttgggggcttggtgcgttgttgtgtgggaaggtatgtttttggtgggttgtgcgcccgggccgtagtggtttgtcgctgcgatcgtggtgggtgtgttactgctgtgcccgctgggttgtttttgtttgtgaagccccttttgattgtgccgcgcgtgccggtggtggatgtgttttctgccggcgttgtttttcttgttcacccccctccgtgccaggggttgttgtgtttcgctgctgttttgtagtagtggcccccccgcgctgttgtgtttttgtatatttgctcccgccccccgtcggggggggcgctggtgtgagagggttccgcgcgtttctctcctcccccccccgcccgtgtgttgccgcgccgctgtctgtggcaggcggcgcgccccgcctcgctgtgtgtcgctcgcacctctgtgtgtgtctctcggacacaggggtagttggcgcggcgcgggtgttttttgttctctactccgcacctattagccgccgctcgcttgttctctcctccccctcgttttttgtttgttataaagagagagtgttgtggtgggttctgtctctcctctcctctcttctttagagtcgccgcgcctcttttattttccccccccccgctgtagagagagagaggcgctctctctctctctcccccctcccgctcgccgtctctcctccccgcctcttattctcttttgtttctctctctcttgctcggtgtgcgctctcccctctctcggcggttgtgtgtggggtgttttttatatattcgctgggtgtgtgtgtgtgtaaatatatatatcttctttttacctcttgtgtgtgttctctctctatagatttgagaagagaaaacactctctctctcttcttgtggtgtgtgtgtgtccccctccctctctccccccctccccccgccccgcgcgcgtggtgtgttaaatgcccgcgcgcgcgggggtgtgtgttaaaatttttctgccccccccgactgattttttgtgtggtgccccccccctcttttttataaaaaaaagataattatatatattgtgttgtttattatgagga

SEQ ID NO: 523650 - DNA, 194 bp, Homo sapiens
  misc_feature (189)..(189): n is a, c, g, or t
tgctcggtaccggtgttcctttgtctctactaaaaatacaaaaaggtgcagtggtgggcacctgtaatcctagctactcgggaggctatgacacaagaatctgcttgaactcagtgaggctggagtttacatgtgatgccaaaattgtaccacctgcactccaccatggacagcagatgtgaaactctngcctc

SEQ ID NO: 523651 - DNA, 128 bp, Homo sapiens
aacgatggtctcagctggaaagctgggggaaggtaccagttatttacccttccataaaaacttgggaggtctttagtgaggtataccccttcaggcagggctaggagagagattgacacaatacagag

SEQ ID NO: 523652 - DNA, 1016 bp, Homo sapiens
acgcccgctctacgtgctcgttctcttcgcgaccgttgcgcgcgagccccgtgttcccacggcgggcagcagcggacggcggcggctgtgtgaacgcggagggggcggaggggatgcccgcggcggcggaagaagttaccgggaaatggctggaggcacggtgtctgacgccgctcggggttgttgttcactcaggccgcaagaagcttgatatgacgcctatggtgacccccccagaaaacttcctcgagatcggatgtgagcaacccgaaaacgggtgggtgtgtcggccgggggccgtttcaccactttacgaaatcgggggtcccgggacaaattcttcctatttcagggcctgaaaggaaatcttacttgtagagaggagggattacgggtggacttttggaatttgcgcttgccgaccggttgaccttttacgcaaagaggacggcagtaagcaacggctcgtatgtttcccccgcgtctccccctgtggggaaaagggcggtttagaggcgtacaggctttccttttgtaggcagcgacgacattgaactgggcaacactatttctgaagtgacccacttcttatttgggcggcaagatggaaaacccagggcgctggcgagccaagtttataataacaagccaggggtcgcttggatccatccctccgtgggcacagaaccgcacgcggtttgtctctccacttggtttttacccgggattgcactctttcatttgattaaaacggctattaacctccacttcttaaaaattaagacagttgccttgaaaatttttggccaaggcacgtcgtgccaacaacagcggttgctttattacgttgacttgcaacaggaccgcatgtgaaagaacgttctaacgtttaaagcattgctgcacagaaaaccgtgttattacgatgcgttgggtatactaacactccatattccccgtttggatttgttatgcgcggtgcacagcagtatcttggttaagaaaaccctacttcg

SEQ ID NO: 523653 - DNA, 294 bp, Homo sapiens
actagcctactcattaagctggcaccacagccgtggccatgtgtcagaagaaaaaaaaactggatttcaaacggggtgtcctaaatccattttattcccacccctgttgtttctttatcaagggacaacaaaataggtagtaaagattcagctgttttttaaaagacaaactgaaaggtgtactgagtccaggaagccctgacatgatgctacagcagagcagtgtgtgccattctgggttggactgctctaatgcatctcaaaggggactcaatcttacttgggcttatcgag

SEQ ID NO: 523654 - DNA, 851 bp, Homo sapiens
ctaatttttttttctaggatactattaactgcaattcttaatttaattcttattttgtttattcctataatataaaagtactatctaaccttgtatgttgatcttgtggcattgatgaacttctatattagctcaagtaggtttcactttatttattactttattttatttccattttattattatttcttctctttgagaccagagtctcactctgtcacccaggctggagtgcagtggccggatctcggctcactacaagctctgcctcctgggttcacgccattctcctgcctcaacctcccgagtagctgggactacagtgcgcctgccattgtgcccggttaattctctcggtcacttcccacgtagcagacagggtttcacccatatttacgccaggcatggtctcgatctcctgaccttgtcatctgcccgcctcgacctcccaaagtgctcggcgcttacaggcgtgagtcaccatgcccagcctcaagtagcgttccaactgaatttcttatactttcacaaataccacattatggcaatacacgcactattccaccttcttctcctaatctgcgcgcattgtcctcgattctttctagttgtaacttttctggctcataccttccagtacaactggtgactacgtgctatacagtacggaaattctcgtccctgtttcccacaacttgcagaataaaagcccccttaatcattccaccagttaagttatttaaagccttcaggtgtgcagttttataatcttgggtacatgagccctaacctctaaagctcaagtaatcctcctacttaatgtcttagaattggtaccttgcttgccacag

SEQ ID NO: 523655 - DNA, 213 bp, Homo sapiens
  misc_feature (40)..(40): n is a, c, g, or t
taggcggacccgcggtatgtttacggtgtctcatgctcanattattcacagattcaggttgagataatgcaggtatattgagatgttcacacagattctggtcttgcataaaatcatctttatcaacctagacactcagaagttcaatatttgaaattgtattggcatgtcacatctctaaggatcacattgctccgtaagacataaccgcgg

SEQ ID NO: 523656 - DNA, 1046 bp, Homo sapiens
gcgggtggaggaggagcagcagaggagtgccagtcctggcccagtgtaatgccatgctccgagaacagctggaccaggcaggctcggacaaccaggctctgagtgaggacatacgaaaggtgaccaagtgactggacacgctgccgcaaggagctggagcaccgggaggcggtgtggaggcgcgaggaggagtccttcaacgcctacttcagctaacgagtcacagtccgcctgctctctcctctggaggcaggtggtggggttccagtgctggctggtcagtcgaggtgaagatgttcacgtgagtagggaccttgcgtgcgagcttgggaggggagcttggacccaggtacgatcacgagcgtgtccagtgaggctgggcctgggactgagcaatagtggtctactggcctggccataaagagccggaggccagaggcagccctggacgaaacaggccctgctgcagagtcccagtctggaggagacagcctgcggtgacaaggtgctccgcgagaaggacctgtggcgcaggcagcagaatgcaaagcgacctggacaagggctgacctcagtgccagagtgaccagagctgggccctggcagttgaacgcgtcttgagaagcagaatctggagaaggatcacggtcaaaaaggacctcactgagaagctttgaggccctgggaatccctgtggctacagtgagcaggtggcccttgtagacacgaggacgcgagaagcgggtcatggcagacccttaatggatcttggcacaggccggtctggcaggaagtcttaagagcggggtccagctttatcgggctctgagcgcgaccgggaatgtctaaaggcagccctggggggctctcggacacgaaaccagtccaaccgtagagcattgactggcgagtacggaccacggaaggtctacacggctgtcagctacaggaagcaagtcactcgcgtcaacgcaagcctccagcattcggataaggagagctggacgcacacttcagataaacgcaaagaccagaacacgcagacc

SEQ ID NO: 523657 - DNA, 967 bp, Homo sapiens
ataagaggctgtgtaatatgctaatctgtgtttcaccatccggatgattctcatagtgctcgaacagccatgaatgagggctaatgacaggcgctagagatcaactagcgactagacgcgtacgtcaccgtctcgtgcacattcttcatacatttctaagtctgaactctctaagatcgtgaactagacgtattagctgaggggtcataatgtatgcgcatcagcatactgtgagctgacaccaacacccctagaacatttcagggcaggggtgtcttcagaattgtagcgcgagtttctgaatctagcaaatcctccttttacccgtcgaagtgtgtcgaatgcccgtgactctaccagcgcccataaatgatctctagaaggactgttagtaccaggtctgtttttcaactttgaagctataagagacccgtgatatggtaatatgagtggtgcatagcagaggtctcggaaccaaaatattttctgtgcactttaacgtttcagtgttaaaaatgtttcgtaacacgcttgcaacttcccttatggcattaatcttgttgagggagagagacagaatcctggactctccaaagtatttaactgaaagtatggggccctggccctgacgcggcccatgtcccacaaggtgctggctcagtggggtgctttggtgtgctggatgatatgttgatctgtatgggtaaggaccaatgacaggcaagcaaaaaatggtttaagcttggtgttaacttttcttagtgttaattatagttaagcaattcaaaaatgctccaagaatgtgaaggaccttttgtccagctttcgaaatacacaaaggcgttttgcccgacagaatgtgggaggttaactgagacatttgttgatgcgagagggacttaatgtcggagatttaaggccggaatgagaacgggggattggctgttacaatgggaacggtttggaa

SEQ ID NO: 523658 - DNA, 152 bp, Homo sapiens
actggatcaacgccggccctctttatctcgcaaaggagtgcttgtggagatctggatcttttctccagcaattgggggaaagaaggctttttctctgaattcgcttagtgtaaccagcggagttggatgcagtcagcggcgttggatgcagt

SEQ ID NO: 523659 - DNA, 849 bp, Homo sapiens
  misc_feature (90)..(90): n is a, c, g, or t
  misc_feature (92)..(92): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (126)..(126): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (151)..(151): n is a, c, g, or t
  misc_feature (161)..(161): n is a, c, g, or t
  misc_feature (170)..(170): n is a, c, g, or t
  misc_feature (178)..(178): n is a, c, g, or t
  misc_feature (191)..(191): n is a, c, g, or t
  misc_feature (209)..(209): n is a, c, g, or t
  misc_feature (223)..(223): n is a, c, g, or t
  misc_feature (233)..(233): n is a, c, g, or t
  misc_feature (236)..(237): n is a, c, g, or t
  misc_feature (239)..(239): n is a, c, g, or t
  misc_feature (241)..(241): n is a, c, g, or t
  misc_feature (251)..(251): n is a, c, g, or t
  misc_feature (260)..(260): n is a, c, g, or t
  misc_feature (275)..(275): n is a, c, g, or t
  misc_feature (280)..(280): n is a, c, g, or t
  misc_feature (302)..(302): n is a, c, g, or t
  misc_feature (331)..(331): n is a, c, g, or t
  misc_feature (346)..(346): n is a, c, g, or t
  misc_feature (353)..(354): n is a, c, g, or t
  misc_feature (374)..(374): n is a, c, g, or t
  misc_feature (380)..(380): n is a, c, g, or t
  misc_feature (399)..(399): n is a, c, g, or t
  misc_feature (440)..(440): n is a, c, g, or t
  misc_feature (452)..(452): n is a, c, g, or t
  misc_feature (454)..(454): n is a, c, g, or t
  misc_feature (810)..(810): n is a, c, g, or t
attaaaacattttcacccactctttgagtactttgactacgagtccagaaagagcatgagttgttatgtgcttagtaatgttctggattntnacacagaaattntntctnaagaccaggtggattncataatgaatttngtntncacgttnattcaagatnagccagatnaacctgtngaagaccctgttncagaagatttttctgatnagcagagccttttnggccgcttcnttnntntnctgcgctctnaggaccctnaccagcagtactttnttttnaacacagcacgaaaacattttngagctggtggaaatcagcggattcgcttnacactgccacctttngtttttnntgcttaccagctggcttttngttttnaagagaattcttaagtggntgacaaatgggaaaagaaatgccagaagattttttcttttncccaccagactntnagtgctttgttcaaagcagagctggcagaattgccctttagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcatgaacctctgaggactcagtgtgcccttgctgcatccaaacttctaaagaaacctgatcagggccgagctgtgagcacctgtgcacatctcttctggtctggcagaaacacggacaaaaatgngggaggagcttcacggaggcaagagggtaatggagtgcc

SEQ ID NO: 523660 - DNA, 225 bp, Homo sapiens
ggtccggttacgtggctgagcacaggagtttgagattagcctgggcacatggcaaaaccctgtctctacaaaaaaataaataaataaattagccaggcatggtggcacgtgcctgtaatcccagctacttgggaggctgagacaggagaatcacttaaacacaggaggtggaggttgtaatgagccaagaagccacggtcaacccacaagccacggtcagcccac

SEQ ID NO: 523661 - DNA, 998 bp, Homo sapiens
agcagatttataatctgataaaactgaactaatgtgttcttgcaacagaaagcaggacattgcgcgcaaactcctgctgtaaatccttggacttgtgcttggtgtgtatgctcggaattactgaaagataactctatcatctccacataactccataggtgcagcgtcactaatacccagaccgatacgacgcacaagagcagaagagtgcgcacacaagccgccacggagtgaagaacatgaaagaatacgccgagcaacgaataacaccaccagaagacacaagacactcgcgcacaccataagcgagaccacccgacagcgaaactccaaaccacaagaaccatgactactcagaccagccagcgaacaacacataccaaacccggagatctaagctcaaccaaacacaaacgactgcaccccaaccaggtaaaacacgcccggcatccccaaccctacaacgccggcgaacgccacgcacaccatacgacgcatcactcccaccgaaccacaaaaaaagaagaccctgcaaaccaccacaccagcagaaaaccccgccaccacccacccaacaacagagccaagccaccacacaccccacacacaccaccactcacgaccaagcacagaagcccaccactccccagacagcaacagaccacaaaacagacaacaggacaccacgaacaaacaccgcgcaacacacgacaggccatgcaacacgtccccacccacacaccagcacggtcgacccacgcacaccgacccaccacacaacacacaacacagagacaccaacccagcccaacaaacacagaacaacgacaacacaacacccccgacacagccaccacacccccccccaacgccccacacagcgaccaagacacagacaccacaccacaacaacacacggagaacgcacacgcgcatcagaacagacccacgcacacaaccccagccaaccgccctaccacagcgaaccgaaacacaaa

SEQ ID NO: 523662 - DNA, 103 bp, Homo sapiens
aagcttaatagtgaagatacctctttacggactccacctatgatctccctaaagcccatgtcgaatcccccatcgctgggtcaatagtacttgtgggtaccga

SEQ ID NO: 523663 - DNA, 124 bp, Homo sapiens
actatcttctttcttaacctcttgatgcgtttctcctgatacagctgaagctggacctcacttaccctgggctctttaaccagggcatcccggttggcattgcgcaagttctggtgtgtgtcat

SEQ ID NO: 523664 - DNA, 223 bp, Homo sapiens
atacatctacgtaaagtatcattataaataggcagtacaggaatacattaaaagccaacagaatgctgagttgtatgattttcttaacaggtacaatttacttttcagcaccctgtacagccatggaaagagtaactaccataatccaaccaaaaagactacaaagctctatattggctaggggaaggggtgtcaaatcatgcaatgagtgtaggtagatccg

SEQ ID NO: 523665 - DNA, 939 bp, Homo sapiens
  misc_feature (785)..(785): n is a, c, g, or t
aaacgttatcttggaaatcatcattctcagtaaactatcgcaagaagaaaaaaccaaacacctatgagtgagaacaggctacttatccttgatttttctaggcaacccaacctacggcctttcatctcatctcatccttcaccccatcagtgagaaaaggaaatttttgtttgtagaagaaatgtgctgttttattctgtagcacatcagtacctgtgctaatttgagaatcataactagcgtagatccaacccagaaacaaaccccaagttcacaaaacttaaaaaggaataggcaaattctagttgaaactgtttcagacctcagctcactatcagcccagaacatattatgtgcctcatcgatttaaatgttaccgttaggattggtggacactgtaagtctagagaatagctaattgaataagacttgaacatctaattgaatttcttgaacaaaatgtatactcagaacagaaaatatttcagaaatctatgacttcataatgtcactggctctgaaacattaacacactacttttccagttttatttggctatatttatttgacaattggatctcttttatagaatgtgtactgtgctataacttaacaactaaaacaacatttatttgttttttccagactgggaatgtcagaattgtgtcattgtagctagcatatatcaagatacttttcagctattgcttcaaatgctctatttttccctacatgccctttagtagaactgtttccagtgcttttcctataaccaataattattngcattatggttatttttatccccgttcgctcttaccgtcccccaaatagaaacttctcaagggcaaagttgggataatgtggttctctctgccagacgttatgcctggacacataagaaatctctcagtgcatgtgaatgttagtgaaaggatg

SEQ ID NO: 523666 - DNA, 124 bp, Homo sapiens
tggggggatgctgagattcgccattgcactccatgccgtggcaacaatgagcaaaactcagtctcaaaaaaaaatgtaactgatggccgggcgcggtggctcaatgcctgcaatccaactattt

SEQ ID NO: 523667 - DNA, 249 bp, Homo sapiens
  misc_feature (4)..(4): n is a, c, g, or t
gtanttagaaatcccttgagctggtttctcaaatcatgaaaataataaatataactagctgttagagaaatgaatgagcctacagatgataggattgttcatgtgggtgtatggatcggggtagtccgagtaacgtcggggcattccgggataggccgaggaaagtgttggtggggaagaaaaggttagaatttaacgcccggattaatattgatagttgaaaattggactttttgggcggtagggttt

SEQ ID NO: 523668 - DNA, 292 bp, Homo sapiens
  misc_feature (32)..(33): n is a, c, g, or t
  misc_feature (61)..(62): n is a, c, g, or t
  misc_feature (155)..(155): n is a, c, g, or t
aagtgtgggctgggcttggtggctcacacccnntgaatccccaggctttgggaggacgagnncagtggattacctgaagtcaggagttcaagaccagccagaccaaactggcaaaacccccccattactaaaatacaaaaattagctggacacgngtggtgcatgcctatgatcccagctactcagtagactgaggcaggaggatcgcttgaacccatgaggtggaggttgcagtgagccgagattgcaccactacactccagcctgggcaacaagagcgaaactctgtctc

SEQ ID NO: 523669 - DNA, 721 bp, Homo sapiens
taaaatcagttgggatccctttcttttccagcatggccattttggaaaaatacagtaattcttctgtatccattggcacctctgattctgctctacgggctttcccgggcacggggatggaacttcacccatactctctgttcttcctataagtacacgagtgaaataaacagtgagaagaagattcaatcgtaactggtgtcaacagtatggtgaagtgatcattctctggtaaaactggtaaataaactatcatcttgggagatatcttaaggtgtcaacgtcggcaacttgaagaacatatattttcaacccgggggtcaggtacattccttaaaactaattactgtccttctataataaatatttcttaacccaaaaaaaaaaaaaaaacaaaaaaaacaatctgggggggccgggcccaaaagagtctttaaccctcctgcggcgcgggccccagagtgtaactgaaactggcacacgtggtcccaaggaccctggcaaggcatgggttggttcccccaataaaagccgggcgccggcgctgtgcaaacccaaggggccgcgctcaggctatacagcggccgggacaataatcccgcgggaggaaagaacacaacgacaacagccgcacaacaggagtagaacaaccagcgtaccacgcagcagaagacacagcacaatacgatgatcgatcgaccaactgagccgatatgtcacg

SEQ ID NO: 523670 - DNA, 377 bp, Homo sapiens
  misc_feature (29)..(29): n is a, c, g, or t
aatgtggccaaggctggcttggtggatgncttttaaaaaaagtttaatgcgctgaaggttcccgggcccaaggataaattttctgccccgggggatgccgaaaaaaaaaaaaatgtgaaattttgtgctgagtgggggtttttttcaaaggcccggattgtagaattttagaaaaagatggggaagatgaagaactttattccctttggtcagatgccccttgggggcttgaatgaagctttccccgaaacccaatttgccaaaaaaaagtttcccttttggcctcccccccccattgggaatttttaaaattgggtcccgggggaagctttggcccttgtttttccccttttgggcctttaaaataatttttttta

SEQ ID NO: 523671 - DNA, 233 bp, Homo sapiens
accgctatgcggcattaagggcacattatcatagaagaggtcacaggatttaaaaagacaggcggaaaaaaatctcatattaggcaaccagtattatctcatcccaggcaaacccaggtagtatctgctcagcctgccgctaacagattctcacaatcaccaacgtgtgctaagggactgtccccaaaggtcagattcggtgctacccaggtaggcatctattatcaaggtcg

SEQ ID NO: 523672 - DNA, 189 bp, Homo sapiens
gagatctctggtgatgatgtggaccagtggtgttcaaggtagtgttgactttgaggattgggggggtagtagtgagtcaagttgggtgataatgggatgttggctcagaggtcagtacaggataggcctgtgggtgtgttcaatggaaggaaaatggaagggagtgtattccattctgctgaagggaag

SEQ ID NO: 523673 - DNA, 187 bp, Homo sapiens
gcaagtatttctgtgggtgctgggacttcccgtccgcggcgtggaggttgcagaggaaagtggtcgcttattggtcagaggagcagcctgctcaccctctccaggttggggctgtgtacctcggtgaggaggagctctacatgacccgatggccaggacaggccagcagagaggccactccgtctgg

SEQ ID NO: 523674 - DNA, 370 bp, Homo sapiens
ctccagagcaggcttaaccatgcagcgactgcgcccatcaccagctgtacagatcctgctcacactccccaaccacccacacacagagaaacaacctgttcaccactcctgggtgcatgatcgagggtgaagcatccaccagcacttcaaggggtccatagtatctgtccttttgctgcctcaaagtccccaaagccttagagcacaagcgtcagtcgatggttgccaatcatccaatgcacactatcactgggacaacaatgcagatcttctgggttttgatggaacttgctagtggggacatgcaactgatgcattatataccctgtgagcacacttgtatctttgaccttccatttgcccctgcccc

SEQ ID NO: 523675 - DNA, 888 bp, Homo sapiens
gagggtctcgccgccagtggaaggagcacgcccacggtgagacatggccgaggagcatggtcttagagaggtgtgatactggagctggagaccaatggccgagacaccacacggccgacctgtgccgggagaagctggtggtgcgactggggccagcccttctggctgaccctgcatttgagggccgcatttacgaggccagtgtcgaccagtctcacgcttcagtgtcgtgaccggtccagcccctagccaggaggccgggaccaaggcaccgtctatccactaagagatgctgtggagggaggcgtgacctggacagccaccgtggtggaccagccaagatgcacacctcatcgcctgccagttcaccaccccggcccaacgcccccattcaggcctgtactcggcctcaaccacaggacggcctccactgcgcctacccaggggaatccagccattgtgacatgggcacactctcaatcttcgctccttcaacgccatggttgcaccagcgcgaagtgactgtgtaccctggtatttccggcaaccaaggcagacccgcaacgagatatgtactcaacccccagacacgcgctatatacctccacaggggctccggcacacacgtttcaatcgagagaacccgcttaccctttggcgaaattaagaggtggccaggatctcggagaccaactggggcctcatttgccacactcgtgctatggcatccctttccttagcactggtcgcaagacccaccagtttccttgatccatacggcccggaacaggtgcacctgcattcccgtgcgcagctcgccccgtctatactcaggcaccatggtgtttgtcgcggggacgggccaccctggaggcgatgaccagggat

SEQ ID NO: 523676 - DNA, 926 bp, Homo sapiens
tttggaaaaaaaaattctcactttgtcacccattctggagtgcaggggtgtgatctcggctcactggggcctcttgcctcccgggttcaagccattctctgtgcctcaagcctgctgaagttggctgggcactgcgaggcgcccgcaaccacaccggggctgatttcggtgttattaagcccagaagaacggggtaacgcctcgatcgtcgaggcgggtctcaaactcctgaacctcatgtatctgcgctgcctcgagctcccaaagtgcgggtattcacaggcgaggtctagaattactttgaactcatccagttcaggaaatctaggtgacgtttttaaaaaacgcagtttgggaatagcataaaaaatataacttccaggatgtcaggtgtgatgcagaggacaccagaggttatctagatatggctacgagacaacgtctctcccaaagatgacggagtatggtattcctaataacagctctatggccgggtggggttaccctaagttagctttacagtctccagtgtgatatgttcccccgaacacaaaattagtttgtcgggggatctcgtcagttcaggactggttattactcagttccaaaatggttacctttttttaagagcttcactggttctctgtactttgtcacttcttttttctccagttgacataaaacctacgcggtgatgaaagcgtcaggtggtttatcacaaaaatggcttcctacccacccaaagtgctctgcgttgtgaatccctcttatggggccgtgtgcccctctcccagccaccttggagggcggatactcgaaaaaattgctgtgagcgcgcgacaaacgagtatgacagctgcggggtacctacactgagcgtgtgatgcgtgagacgagtctgagcccaaaaaaaagctgcgccatgg

SEQ ID NO: 523677 - DNA, 243 bp, Homo sapiens
tgctgggattacaggcacacgccagcacaccaggctaatattcatattttaagtaaacatggggtttcaccatgttggccaggctggtctcaaactcctgacctcaggtgatccaccccccttgacctcccaaagtgctgggattacaggcgtgagccactgtgcccagccagtgtggctctctattggttaccctgtggtatcctgtattctcagctcatctccctggtgggtcctgatccc

SEQ ID NO: 523678 - DNA, 348 bp, Homo sapiens
  misc_feature (341)..(341): n is a, c, g, or t
ttcattaggcaaatttatgcgtagaactaagatactatcttggataatcagctatcaccatgctctgtaggtttgtcgcctctatctatacatttctttcccactattatgatacatagacgggtgtgctcttctacctgttcttaggttgctcgtctggtttcgggggtcttagctatggctctccttgcctgagttaaactagttaattcataatgcataaagtatagggcgttagtccttgctatattatgcttggatataatttttcatcttacccttgcgacagtatatctattgcgccaggcttcaatatctatcgcctatactttatttgcctnacttaat

SEQ ID NO: 523679 - DNA, 100 bp, Homo sapiens
taatttctccccaacatacttatttcattaactgtggagaaattaagacacctacagctgttgacccacttctatctgcaccatgtttcttctctgacat

SEQ ID NO: 523680 - DNA, 218 bp, Homo sapiens
  misc_feature (174)..(175): n is a, c, g, or t
cctcagcctcccgagtggctgggattacaggcatgtaccagcacacttagctaattttttgtatttttagtagagacagggtttcaccgtgtttggccaggctggtctcgaactcctgatctcaggtgatccacctgcctcagccttccaaagtactgggattacaggcgtgcnncccacttgacctgaaccctgataggctttactttgaattgcaa

SEQ ID NO: 523681 - DNA, 206 bp, Homo sapiens
ggcaatctgaccagatagctgaatacagctgctaagttagagagtgctctctcaggcgggctggtcgcggagctggtctgtctctccgcagcttccctgtaagtaagtaaccggtggggtgggtggggtctctcggtcggagcattcctcccccgtcccttcgaggggaaggcgtctgtccaaacacgtccaagctgtccccaggc

SEQ ID NO: 523682 - DNA, 215 bp, Homo sapiens
ctcggtacctcgaatagggagtatgtgaagtagatagagaccgacggattactccggttctgaactcagatcacgtatggactttaatcgttgaacaaacgaacctttaatagcggctgcaccactcgggcatgtccgtgatccaacatcgagagtcgtaaagccctattgttgatatggtactctagcaataggattgcgctgtgtatccctag

SEQ ID NO: 523683 - DNA, 276 bp, Homo sapiens
atatccacaagggactcacagccagcaggtaaactctcccttccctaacgcagaccaaacccgggaaaatcacagacagccttttaacagctcctctttctcggcccccttcttctgggaaggcagtcaggaggtttaagctcttcgggagctcctccttcttccggtcactcatctgtctctcatcagccgggcgatcggggtcatctctgatgcggggaagtcctcccctgggtctaagatcttccccatgatcttcaggtatggctcagcgct

SEQ ID NO: 523684 - DNA, 220 bp, Homo sapiens
  misc_feature (55)..(55): n is a, c, g, or t
  misc_feature (69)..(69): n is a, c, g, or t
gaaatccaaaaaaaatgacacaagaagtgaagggagaaatattcatggaaatagntagcttaaagaaanaaacaatcaaaagttcaggaaactttagacacacttttagaaatgtgaaatgctctcaaaagtctcagtgatagatttgaacaaatagaagaaagaaattcagagctcaaaagcaagatcttcaaattaactctgtccaacaaagacaaag

SEQ ID NO: 523685 - DNA, 686 bp, Homo sapiens
gagttgttcctgaaaagctggattagctagtccccacggggaaaaccttcctgctgctctccatcactcagtatacgacatggaccgaacaatatctgactttggactccggacgccctcagtacatctggcgtggtacatgattgtcttcccgcgatggggacgagggttcatctgactcgtggcatggtggtaatgagcgatgagtagatcctggagaagtgtcgtgccattctacttagtcatggcacattggatacgtagagatgggatacctaaggaaggtcccgagccgttggaccgatgtgatagtgacccatttcgtatgatcgttctttgctgcgagactatagcagacacaagtctcgcctctcatcgctagagttgcatgtgtgtgccttgaacacccagactatgagcacttcgtgattgtcccgtctgtcataacaccgctggtacatttgcatggccctagatcagttgctgcttaggagtgctgggtgagactcctatggacgtgtccattgaccacgagtgtcgacaggggttacgtgtgtgacgccttgatgccgtgtgcaccttcgtcatgataagcacctacgataaatgttcagtccgtgaaccttcccgttatacagcctggcacactgggccttgggtggaagaaccatgatgtgagaggacag

SEQ ID NO: 523686 - DNA, 302 bp, Homo sapiens
  misc_feature (40)..(40): n is a, c, g, or t
gtccgggcgacgtgagaaaaattggcagatgttctacatnagcgggcgtcattcatttttgcattatatgcaaaagcgtttcttatgaatacccgcttctctgccgacggcgcggcggctactctggctgcgggttgatgacgggcttcggcgccgtcccatcccggccgcatagagagaaaacgcataaacctcgcggcgcttagcaccaaatagcagatatttttcccaggccgcgtgagccgcctgcggagttgattgtcgctccaacaccagattaaccgttcaatttgataaccggt

SEQ ID NO: 523687 - DNA, 143 bp, Homo sapiens
gcggccgcctactactactactactgctcgaattcaagcttctaacgatgtacggggacatgacccacttgcactgtgagtgtttgtcctcgcacaactgggacaccatgcatttcaataaaaacatctctgcggtaaaaaaa

SEQ ID NO: 523688 - DNA, 777 bp, Homo sapiens
agcggagtatctctcttgtggtgcctggaactggacatcccgcttatgtaggcagcttacgggcaagctccctgcctcatgctatgagacttgtgtttgtggggacactagcttgtgtattcagggaaggggaaagagtgtcaccaagggcagaggtgtccaggccggatccagggtgcctccgactgttagggatgctaggctgctagtgtggtgctgccccatagccacagggtcccactctgatctgtctctttcaggactttgcagcgtgtacttggtttagctccttctagccagcaggagctgacatggacccgaaattcctcgggtgccgtgcctggagctgccagctagctccgccttcgggagcggcaaacaattcttcgaggacattctacagcacagagacagagtttgtcgttgcctctgtcccatctgcacctcgagtcagcagagaccccgccataggtagtatctcatccatggcaagtgactgtggacacagtggagcaagtagaacttattagaccttggggacccggatgcagcagatgtgttcttgccttgggaagatcctccgacgacccccagtcgtctggggtggacaacattgggaggagctgagcctgcggtgcctacatcagacaggaacacatctaggaactcctcctccatcctcctcgaacgtctccaacaaagtgcatagcccagatccaagtgatgatggagcagatacgcccttggacacagcaggaatgaagagggaggacaggg

SEQ ID NO: 523689 - DNA, 313 bp, Homo sapiens
  misc_feature (133)..(133): n is a, c, g, or t
gactcctggtcgctatcggcgaggttatttcgcttgttaaagtgtttaccgagtgcagggcatattggggaattacctgggtggggcggaacggtcagcgttaccagtagtgtgattacgggggcaatttatnaatttcattcggatccacggtgcgccctcaactagtacccgctgagaattgccgggactttagaaacctggggccagaaaaattttccacaaagttggggaaaattggtttttgccacaagtgtggagaaaattccccctttgggggcccccaaggggggggaaaccccttttttttttt

SEQ ID NO: 523690 - DNA, 427 bp, Homo sapiens
  misc_feature (423)..(423): n is a, c, g, or t
atcacctgaaccttgggaggtcgaggctgcagtgagccacccaacctggatggcagagtgagaccctgttttaaaataagaaagaaaaattaaaaaataaaaatctagctggtcatggtggccagcgcctgtggtcctatcaggaggctgaggctggaggattgcttaagtacgggaggtcaaggctgtagtgagccatgattgcaccactgcactccagccgaactgacagagtgagaccctatctcaaaacaaaaaaataatctattgtcatcccttgatatccacggtgtattggttccaggatccctctcacatagcaaacagtatatatatatctgcagatgctgaagtcccttatataaaatggcacatttgcatgaatgtatattgttatatataataaatttttttattgtcatnttcc

SEQ ID NO: 523691 - DNA, 267 bp, Homo sapiens
  misc_feature (166)..(166): n is a, c, g, or t
  misc_feature (214)..(214): n is a, c, g, or t
cctcaagatgaatttccagtgtgaaagcatcatgaaagtgtcaaagaatgatgcattaaagccaatctggtgggagtaaaaataatgtgccttggaaaactgtgtcagataattcagaaagtggcttaagtgaagacaaagacccgatgacatggctgcatatgantaatttaaataaattttttcataaaatttgagagccaagaatgagcantatatctcatttttacataatatgtgattgagtacataatttgtaatacatat

SEQ ID NO: 523692 - DNA, 349 bp, Homo sapiens
catcggaccgggtgtttcttgagggtgctgcgggagggaagacttggggcgtcctgtaattagcacttccaggactgttttggtggctgaaattaggggtgacagtggccttgttatggtggatttcttcttgagggataagaacaagggtctttgttaatgaaggaagtctctgattgaggggttggaatctaagggcttcagggtgaccatggggtcacgacatcttgagaggactgatgttaaatggggaacaatgacatgaatgtctgttactcttttgcttcgggggggagacctatgtttatttcaagaggacttaaggggcagtgtttgttaatggggaggt

SEQ ID NO: 523693 - DNA, 980 bp, Homo sapiens
ccattttcatgtcccgttcgtcgccctgtcctggcggttccgccctccttgacatcgtgcattgcaccttgtgatttctggcctgagtaacccgtccgagtggcgttcgtgcctcgtcccgtgccggtgtggcttcaatgcctctttcttccagtggattcgtctcaggcgtacctctctttggatcagagcttgtgtgtttttgtttcttgggttcttggatgtctatgcctctacgcgtatgcgtcggttctcctttcctatctgtttgccccgtcatcttgcacccgtctttctccctctggccatggttctgtttcgcttttgggtccatttttttgtctctccgtttgagtcgtgattaccctctcaggtgtaggatcccttgggtgcgagtaagatagtcgttgcctttttgtccactttgcgcatctcgtttctatgtaacgttagccccgtcgattatgcaacgtgatcccatgtctcgcatgacgtttcatgttactccctcctttcttctcacttagtcatttttgattggcttatattatggagcgtgtcatctacaggatcatgctttggcatattacatattcaatgtctatgaatcagtacaaccgatgtttgtttgagcgtagaagatatcctaccatataattcgttgcccaaatttgggactattgagagagataggggatgctattaattacaccagcatcctaaacggcattaaaacctagacctgtcccaggccgatgcctggaaatatgttctttctagttgtgggtaccctgatctagcttggtttgtaattgtgcattatctgactgcatatgtttctgtatgtgtagatgtgggctcctttgttaagtggggctcatggatccgaaggctctgaggaagtgtggcttgctagtctgttacgttaacatgcttttctaaaattggcttcacgtgtaattcatttactcctgttaccc

SEQ ID NO: 523694 - DNA, 464 bp, Homo sapiens
  misc_feature (333)..(333): n is a, c, g, or t
tgtggtgatctagaggatcctttgggtgctttctattgagtagaagctcacaacagaacaaggcagaccctccctctagttttctagatacagagcccctgcagaacgtgaggcctcaatgctgattttcgctggatctcatcacagtgtgaacagggtaaaaagcagtgaagctctctacttgtgcctcgttgtgagcagtgggtcgtcttccacgggctgtccctgaatcctgggctttgagggacaaagagcttgctggaaatagtgatcaccctcgtgatgacaccaggtcaacaggcagctgtgggctcacttaagatgtaagccggncgggcgcggtggatcacgcctgtgatcccagcactttgggaggaccaggccggcggatcacgaggtcaggagatcgagagcatcctgggtaacacggtgaaaccccgtctctactaaaaaatacgaaaaag

SEQ ID NO: 523695 - DNA, 660 bp, Homo sapiens
gttatagcatcaccacacttcttggtactaattgctgtcttagcttggctgctataacaaaataccataaactgggtggcttagacaacaaatatatttctcacagttctggaggcagggaagtccaagataaaggtgctagacaattaagttcctgatgaggttccaaggtgctagctgattcttcttcatggtttgcagatgaatgccttcttgctatatgttcacatggtggagggagaaaccatctctcccttatttcttattgtaaaggtactaatcccatttatgaaggttccagcttcaaatgccatcacactggagattagattttcaacatgtgaatttaatgggggacaccagcattcagtccctagtgctctgatagagtattcattaatgtcatgtatttgttaacatcttgtaagttatttgggctttgatgccttaaaagaagaccctggccaggcatgctggcctcatacctgtaatcctagcactatgagaggctgaggtgggcagattagttgaggtcaggagttcaagaccagactggccaacatggtgaaaccccattctactaaacatacaaaaattaggcaggcatggtggcgcatgcctgtaatccaagctaccccggcaggctgagggcatgagaga

SEQ ID NO: 523696 - DNA, 288 bp, Homo sapiens
cttatccataaggtgtgtccagggcgcagattattgaaagccaggagtctgagatcagcctgggcaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtgggcacacattatggag

SEQ ID NO: 523697 - DNA, 481 bp, Homo sapiens
  misc_feature (356)..(356): n is a, c, g, or t
  misc_feature (414)..(414): n is a, c, g, or t
  misc_feature (456)..(456): n is a, c, g, or t
  misc_feature (472)..(472): n is a, c, g, or t
cttgggtgaactcggcgaatgggtgattcgcgatgttgcttccacacctctcattccgggcattcgcaggtccatgaggaccacatcggcctggggagcctgcctcacggctccgtcgccgtcactggcctcaccgaccacctcaaggtcatcagcggcctcaaggatctggcgcacagccctgcgtacgagcgtgtcgtcgtcgacgagtaagacgcgaacgggcagcatggccacatcctatgatgtctatcgtttgcgatccgtcgcggcaccactgtggtctattggaaacgggcggggatgattatcactgcacgggatgtccacatggacgtggaacagattgtcatcangaccgtagtgaaggctgccccaagtagctcgacacgctcggtgatccccctaagcccncgggaatgggcactcggcccaccagtccatccaccgatgtanccgttcgtcgtcctcnggtaatgca

SEQ ID NO: 523698 - DNA, 150 bp, Homo sapiens
  misc_feature (135)..(135): n is a, c, g, or t
ggaccaacaggaaaagcgagatgacaaattggatgaactcataagcttcagaatatctaagcaaaagtagaattcctgcctttaggaagagtaactttctttggaaaagcatcagaaatggcaaaagtcacaccnattatccgaaatatg

SEQ ID NO: 523699 - DNA, 166 bp, Homo sapiens
cgattgatagatgttgtcacagtagattcgctggaggaaggatgtgagctataactgagaggaacctagcaggcctaccagagtcatctggacttatgcaactttctacccccagatggggcagatctcctgaatcatgaggctatgcctcaccaataagcagcca

SEQ ID NO: 523700 - DNA, 1192 bp, Homo sapiens
gagatgatgttctcttttatgatgagtcaccaccaccaagaccaaaactgagtgctttagcatgaagcctaaaaagttagctgctatcaccaaagttaagggcaaaaggccaggttcttacaaaaacaaaccctaaacagcattaagaagaaacaaaaggaccctcaggactatcctggaggtgaaggaacgtgtagaaacaaaacacgcatgtttcttcgtcaagctgagcgatgaattgtgagcctgtccagtgaccacaaaggatgagaacaatctatgcctactctggaatctcgaggaattctcagataaagtcctaaaatgcggtgtcaatcacatcacacgagcagtcctgtagcatgaggcccgtagcgctgtacgaattgcaaggaatctgctcactcttagaggccccactgggttgaaacatataacgacactacaatgtgggtaacgataactagatgactaacacgatcacgaggacagtcgacacgtttgcccgttggtccggttggaccagtcgcacaaagaactctttgccgtccttaataacccgcgacgtgttcaaaagcctagactcggggaggacccttgtcggtctcaggttggaaagcaacgccatgcagcgttaccccaacttggtgcattgtatgaggagtgtctgcacacgaaggtcacgcttttcaaaattgttcacgcctggtcgagcgaaaaatcaaggcacaggccatttcctcccctattgggaacccatgaactttcccctggagagccaaaatgggcaccttggctagtgttaaacttggtttgggccccttccttaaccaacaagtagccggcacatctgggggaaccggcgaaatcgccttcaatacagcgaggcacccacaatggacacttggggggttcccgcaaaaacgcaagttagggggaacgagtcaaaggaaacaaccccgtccatggtgtcttacactctacaataggaatggggtacaggcagagcgtacacccacacttgatctgtagaagcaatatttatcgctctaggaagcaacgccatgatcgcgtctgtttcacgccaactttacatgcccccccctgacataccagcttctctcgaggcacgaaccaaattcttgtcgccccaacatgcaggtaacccctttgcccttggtgggccttctca

SEQ ID NO: 523701 - DNA, 296 bp, Homo sapiens
aggttggagtgcagtggcgtgattatagctcacgtgtagctttgaactcctgggctcatgtatcctcccttctcatgcctcccaaatagctaggatctattagcatgcccagttaagttcttgtaaaaattttcttagtagagatcaggtcttgctttgtcgcccatgctgatcttgaactcctaggctcacgcagtcctcccagctcagccttcgtgctgggattacagcgtgtgagtcaccaagcctggctttatataccatttttacaaacggtactattttgaagagtaatg

SEQ ID NO: 523702 - DNA, 239 bp, Homo sapiens
aaaggggaaaactcttgagctgtaagagtgaaggaaatcctgttggctgctgcaacatggatggaatcagaggccattatgtcaagagaaagaagccaggcacagaaggactaatatcgcacgttctcactcctaggtaagtgctaaacacttagggggaaaaatagataacagagcccgagaagggtgagagagacggagggaggaggatgcagagaggtgggttaaaggctgcacac

SEQ ID NO: 523703 - DNA, 944 bp, Homo sapiens
  misc_feature (167)..(167): n is a, c, g, or t
agagatgtgtgccacacttcatagatctaaccttacattgcagcacttctcctcaggctggacgggataggggaaggagcgtcagttttacacgatacaataagccttttcatggacagatagactatatttactgcctactacaccaacgtaccagctgagtgcangcgtcagtgtgcacggacgtctaccttgccacggaatgtgttcccacagtttattgacaacgtagcaatattacttccagaatggtaggcatagtatatctatattaagagaaacaaagcagcacctatattactacactagtaaataccaggcattactctcaactagtgtaatgacaaagtgttccgactatcctagcctataacttcgacccatgtgtagtgtcaattcagtcattaatctcgaacttctagcaggcaccaggaacaccccagggtatcaatactcctacaataaagctatggaagggtgggttggtccacgaggggcatcttccaaagtcgacttgtgtcatcctaaagttagacctttgttgcttaacgtggacgaaatcgccgtctaaccacgagcgtccactctaagtatttccatggaagagtgacttctacacggtaacgccattacgtaacaataagcgatccataagtagaagcaatattccgataattcattaaccacatccaccatcatcaccaaaaagggccacatccggcgttctacactcagataatcgtgccttaagcttcagcactcacggaagatatctatataagaacaccgaaccataattgcagtgctccggggacaggactcctcgcaatgtttccccaccttaacaaccttaacatgtgccgaaccaagatcatattttacacccggacagttaccccgttgcctctcacgttagggtcgtgactcagtgctggcttgaggct

SEQ ID NO: 523704 - DNA, 526 bp, Homo sapiens
  misc_feature (29)..(29): n is a, c, g, or t
acgttgaaagaatgtcgatgtcgggtaantgagtgttcgcgaatttgcgcgaagcgattacgtggcgctaatacgaacgctacgtgaaacttcgtgaaatgacgtcgtgaagaaattgaaagtatgactgcgttcgagtggatgttgggaagtttcgcatgtgaccagttagagtgtaaatcgtcatttactacatatttgaacgtatgttgttcatctagaggcgagacgcacgggattggactaagggcaagtaaaacggaagaagatggtgtatacaaatgtgattgtgaaggctgtgacgcgtatatatgcaacgcgcggtgaatcgtgcgtcgcgacacatttttaataaggataatgagaaacgataagggtgatttgattggtccaagaagattaagaccgaggccaggaaaatatgtcaagcaaggcaaaccaagaaaaatcaaagtctaaacatcgggggaccaaggacagcagatgtggaaaggaaggaataaaaatgcccaagaccaaaaaaaaa

SEQ ID NO: 523705 - DNA, 172 bp, Homo sapiens
  misc_feature (80)..(80): n is a, c, g, or t
  misc_feature (156)..(156): n is a, c, g, or t
ccccaaggcgaaccccacggaaagccccacgagcgcacacccgacccgacccgcccgcaaccggaaacccgacccgccanacacccacgggaaagcgggcggcaaccacaaagcacacgccggaaggcaaccaaaaccggcggaaggccgacagancaaagccgggcagggc

SEQ ID NO: 523706 - DNA, 91 bp, Homo sapiens
aagaacccagcttgatattgtttgaatctgtgacagtacacactttggtgaaatttcaggagccatagccattgaaatggatgaggggacc

SEQ ID NO: 523707 - DNA, 325 bp, Homo sapiens
gatcgctaccgtcaggacctccagttgagcaggacactagggcgtctccaagcagagtaccaagccctggcctccctggagctccaagaaggcgaagatgatggctacttccgggaactgctggcctccatcaacagcttgatgaaggaactaagatgaggctgccatgccgagaccaggactggacggatgctgctagtgagagctttggtgggctcttcaggggacatcaactacgaggaggacttaacctgctggggcatgagtgtcacctgggcagagcttgctaggtcattaaacagagacatgatgacaaaaaaaaaaa

SEQ ID NO: 523708 - DNA, 199 bp, Homo sapiens
agaggatcttcagaggcaccaaggaggtgtgagcatagatgctgtgtcacttctgcattggggagtgtgatggttaatattgagtgtcaacttgattgaattgaaggacgcaatgtatcgtcactgggtgtgtctgtgagggtgttgccaaaggagattaacatttgcgtcggtggactgggagaagcagacccaccct

SEQ ID NO: 523709 - DNA, 498 bp, Homo sapiens
gacgacagcataacagcatcaacaaaaaggtcctcacaaaaaccccatctaaaggacatcaaagaccgaagctagataaactcatgaaaatgagaaagaatcaactaaaaaacacagaacactcacaaacccagagtgcctcttctcctccaaatgatcgcaacacctctccagcaagggcatagaactgggctgaggctgaaatggatgaactgacagaagtaggcttcagaagatgggcaataacaaacttcactgggctaacggagcatgttctaacccaatgcaaataagctaaggaccatgataaaacattgcaggagctgttaaccagaatgaccagtttagaaaggaacataaaggacctgatggagctgaaaaacacaacctgagaatttgcaacaagtataaatagctgaaaggaagaatttcagagcttgaagactatcttgctgaaataagacaggcagacaagatcaggtcgttgttacacattct

SEQ ID NO: 523710 - DNA, 148 bp, Homo sapiens
  misc_feature (93)..(94): n is a, c, g, or t
  misc_feature (121)..(122): n is a, c, g, or t
acctcgaggtgtctgtcctcccggagcaggacccatacctccaggcgagcatctgaacccatgtgagcagcacacactgcccccagtgcgagnncatctgacctgaactggatgcagcacnnccacaatcccagtgctgagcatcttg

SEQ ID NO: 523711 - DNA, 931 bp, Homo sapiens
  misc_feature (22)..(22): n is a, c, g, or t
  misc_feature (143)..(143): n is a, c, g, or t
  misc_feature (176)..(176): n is a, c, g, or t
  misc_feature (179)..(179): n is a, c, g, or t
  misc_feature (187)..(188): n is a, c, g, or t
  misc_feature (190)..(190): n is a, c, g, or t
  misc_feature (196)..(198): n is a, c, g, or t
  misc_feature (275)..(275): n is a, c, g, or t
  misc_feature (282)..(282): n is a, c, g, or t
  misc_feature (301)..(301): n is a, c, g, or t
  misc_feature (314)..(314): n is a, c, g, or t
  misc_feature (323)..(323): n is a, c, g, or t
  misc_feature (391)..(391): n is a, c, g, or t
  misc_feature (395)..(395): n is a, c, g, or t
  misc_feature (437)..(437): n is a, c, g, or t
  misc_feature (464)..(464): n is a, c, g, or t
  misc_feature (479)..(479): n is a, c, g, or t
  misc_feature (482)..(482): n is a, c, g, or t
  misc_feature (489)..(489): n is a, c, g, or t
  misc_feature (525)..(525): n is a, c, g, or t
  misc_feature (527)..(527): n is a, c, g, or t
  misc_feature (540)..(540): n is a, c, g, or t
  misc_feature (571)..(571): n is a, c, g, or t
  misc_feature (573)..(573): n is a, c, g, or t
  misc_feature (587)..(587): n is a, c, g, or t
  misc_feature (614)..(614): n is a, c, g, or t
  misc_feature (665)..(665): n is a, c, g, or t
  misc_feature (672)..(672): n is a, c, g, or t
  misc_feature (675)..(675): n is a, c, g, or t
  misc_feature (677)..(677): n is a, c, g, or t
  misc_feature (696)..(696): n is a, c, g, or t
  misc_feature (699)..(700): n is a, c, g, or t
  misc_feature (712)..(712): n is a, c, g, or t
  misc_feature (720)..(720): n is a, c, g, or t
  misc_feature (726)..(726): n is a, c, g, or t
  misc_feature (737)..(737): n is a, c, g, or t
  misc_feature (742)..(742): n is a, c, g, or t
  misc_feature (746)..(746): n is a, c, g, or t
  misc_feature (754)..(754): n is a, c, g, or t
  misc_feature (764)..(764): n is a, c, g, or t
  misc_feature (770)..(770): n is a, c, g, or t
  misc_feature (790)..(790): n is a, c, g, or t
  misc_feature (854)..(854): n is a, c, g, or t
  misc_feature (861)..(861): n is a, c, g, or t
  misc_feature (864)..(864): n is a, c, g, or t
  misc_feature (898)..(898): n is a, c, g, or t
ctcccagctctacaaacagggngggtaatatagctccttttggataaaagtagaagcctcacattcacctttaatgttatttcactttttccaaaatcaatttcctggcaccacacaaaaaagaacactggtaaatgtataanctgaaatgaaggaaacacatgctcacgagtgtntcnctgccgtnntngttttnnngccatatacatggctctccagctctcgtggggggccagggggttctgtgtgctcttcaaagcctttacccattgggnctctgtncatctttccagcctggggngccaatatttgcnccacaaggnccaggcaggagggcctccagcacgcgcagcctgaccacactgtgagcagctcacttggcaagggtgangggngggggtggcgtcctcctgatgtggcttccttccagcctttancacccctggggggctcctccaaggagnaggtggttagatgtnttnttgtgcncacacatacggcagggtggaggaggatgaaccggancncagcccatgcttntgcccccaccctggcaccccaaggttttttntnaggcaacaaggagnacacaaagtgagcccctgtacacaggngggtgggatatgttcatcttccacagggaggccagtgctggggatgagganaaaggcntangnccagtcccagctctgaaantgnnttggtgagtcanccatcagncctaangcttcctggangaganaagnagataggntgttccaganaggagntgtgtcactaagggccaggncaccccatctctgggtcacgcttggccacggcttcatttttggcttcagtttgtttactgaaangaaggcngangggccctgtgagacagaggacactgactcaggtnggtgagtggccctcactgtatagagtacatggc

SEQ ID NO: 523712 - DNA, 390 bp, Homo sapiens
  misc_feature (217)..(217): n is a, c, g, or t
  misc_feature (280)..(280): n is a, c, g, or t
  misc_feature (337)..(337): n is a, c, g, or t
  misc_feature (371)..(371): n is a, c, g, or t
ttaaaaaatcaggccgagcacggtggctcatgcctgtaattctagcattctgggaggccaaggtctcttcaccaatccttccatatcagtgtgcgcccccatacctactccttcaccctatttctcctccccccatctattcacctcactaagagacataacctcaaactgtcctatatgctctgttacttcctcccttaaagacagcataaaaggnaagaatgcacagattaagaaaaggacggggatattttcaaggggcttcatttttaataacctnacttttaaagatcctggtaaaattcttaacaaccagggggtgtcccaactgttcatngccctcggctccaccactcacagcatttatagtncacaatattttagggcttt

SEQ ID NO: 523713 - DNA, 423 bp, Homo sapiens
cacggacgacgagtcctggagagagagtcataagctgagttctggagatgaggtttgtctggctcgaagatctagagacaacgggtcgtatgcgctgaggtctggagaaaggggcatctgaccgagggctggggaaaggtttgtctgactgagttctgcagagaggttcgtctggctgaggtctacagagagggttgtatggctgaggtctggagaaagggttgtatggctgaggtctggagaaatgggcatctgaccgagggctgggtaaaggtttctctgaatgagttctggagagagagtcgtgtcggtgaagagccgagagaaggtttgtctggctgagttctggagagagggtcacctggctgaggtctggagagatgactgtctgccagacttcatgttctgaggaaggggaccttt

SEQ ID NO: 523714 - DNA, 244 bp, Homo sapiens
cattggtccgagagaaattaggcatagccgccgcagtactgatcatgtctatttccccctctgattgatccccacctccaaattatgtcatcaacaatccgacttatcaccatccagtaatgactaatctaactaacctcaaaacaaatgataaccatacacaatactacagggcgaggctcatctcttttcctattatccttgatcattttgagtgccacaactgattactctcggaccagtg

SEQ ID NO: 523715 - DNA, 121 bp, Homo sapiens
  misc_feature (8)..(8): n is a, c, g, or t
  misc_feature (46)..(46): n is a, c, g, or t
  misc_feature (100)..(100): n is a, c, g, or t
ctcatttnatgtggaaaattgaggcactgagaggttaagtaaattncccacggtcacacagtaatttaatttacaacagtaataacacattagatgagancacagtaggacacaattttaa

SEQ ID NO: 523716 - DNA, 710 bp, Homo sapiens
  misc_feature (18)..(18): n is a, c, g, or t
  misc_feature (65)..(66): n is a, c, g, or t
  misc_feature (71)..(71): n is a, c, g, or t
  misc_feature (78)..(78): n is a, c, g, or t
  misc_feature (122)..(123): n is a, c, g, or t
  misc_feature (132)..(132): n is a, c, g, or t
  misc_feature (135)..(135): n is a, c, g, or t
  misc_feature (140)..(140): n is a, c, g, or t
  misc_feature (143)..(143): n is a, c, g, or t
  misc_feature (150)..(150): n is a, c, g, or t
  misc_feature (164)..(164): n is a, c, g, or t
  misc_feature (179)..(179): n is a, c, g, or t
  misc_feature (199)..(199): n is a, c, g, or t
  misc_feature (203)..(203): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (272)..(272): n is a, c, g, or t
  misc_feature (274)..(274): n is a, c, g, or t
  misc_feature (276)..(277): n is a, c, g, or t
  misc_feature (390)..(390): n is a, c, g, or t
  misc_feature (430)..(430): n is a, c, g, or t
  misc_feature (512)..(512): n is a, c, g, or t
  misc_feature (621)..(621): n is a, c, g, or t
  misc_feature (647)..(647): n is a, c, g, or t
  misc_feature (678)..(678): n is a, c, g, or t
gaagtgaagctttgcaantccattgtccaataggaaaaataatatatctctctgtacagataaannccttnaaaaaantaaatctcttttgaaacggtcttttaaacgtctccagcctgttnngctcccccnaangggtnttnctgtccntccccaattgtgantctggtgaatgggantatcctcataggggttctcntcanggaataccaccgggtttnccaangngcccaaataatgccattatcataaccattaggagtagatgcttntnannaagtgccacctgggtaataaaccccattgagagggccagcgtgacacttgttcatccaccaaccagatccatcctgttcagcacagttgccttcaaacttatcattgtcattntcccaggtactgaactgcatgccattatgggatgtgaaanacttgtcactaggatcatcgccaaaatcaaagccatcaaaggcatctccagcatccccaccagcgaagtaggcatatgttangcggtacttgtcagcttcaggtcccaccttgaacatggcatagtctgcagtactggttctgccattccagtcttccagttccactcttaatgcatatgggatggcagantgtgtgcttatcaaatgaatcttctnatttcccagccaaaattctgttgtgccagtnggagacagatgtccaaatccttctttatattg

SEQ ID NO: 523717 - DNA, 880 bp, Homo sapiens
tggattggttttcaaatttttattttttggaacaaaaattaaaaacaagtgattttaaactaataaacacgagtggtatattattctagaaccacgtggttttttttaaaagaatttattaaatttagaactccttatagtccgtgtgggtgagtgctttctatcaacatttatattattctctttaccatttttatctcatctcactctccaaggcttggcataagccaaaaagaattctcctcggttaacagggtgaagtttacatttagggaaattacctccactatagcacactgtgaacaaaacctacagaagcgtggctccatagtttaattatttctacaaagaacaacaagaaagttcgtgctccgagcccatttgtgggtttgggtgtggtataccagtgtggtccattagcgtgagactcaggagagagaagcctaagtttaattacaacaagaattatacccttctgggacggggtgcaagaggatgtggcatttcaaccaaaactttcatttaagaacgagaaccaacagagttcacaaaccgttgggtgagcccaagagctctcaaactcgggggtaaataggtgattctaaaaaccaaaacagtgttaggtggggtctcacaaccgagaacgtggtttttccactgtggtgccaaatttttcccctcgagggaatttaatttccccaattccacaggaaagagaagcgggaattagtgctttcccaaagccctgtggtccaattaaagaaaaatgtgcccttacaaagcaaaatcccatcaattaggggttaagaacaaaaaaacaaaaaggaaacgaacacgaggggttgaaacgcgattggtgcgccaaaagaaaaggcggcgg

SEQ ID NO: 523718 - DNA, 430 bp, Homo sapiens
tggataatgtagttggtactggtgtacatgcagtcctggacccataagttattgtttagtcaataggagactcaggcagtggaggctagtgcaggagaaggaatcgatatcatggctgagttgggaggtaacaatgtcagctggggtgtgtacaggcggagtgtgcagtgtgtgtgaggatggggagcactggaataggaatcgccagtcctagttcctagcctaggtctgccactcactgctgtggtgagtcaggcaggcgatttgctctctgtgggcctcagttactcatgtaggggggggacaataggaccaggtgatctctagggtgatcgtttcttagtctgtaccaagtggacttaagagaatctggatctcctgggggagatcccaaaaggggaagccagtacgcccccagcgaggggtaccg

SEQ ID NO: 523719 - DNA, 653 bp, Homo sapiens
cgcccttatttttttttttggccggtctcagtctttaatcggggcaggggcctcacgcacgcgcgcacgtacacacactcaggcttcagaatctgtgttgaaagctgcgatatcgacactctgcacgtgctcctcaaactgggtgatctcctcctccagcaagtctggtccccacctggtcgtcctccaccacacactgaatctggtagcttcctggatacctgtagcccagtgggcaccacgcttgtgaatgccccccagaccagccctgtccagctgggatatgatgcgcacacagtgcctccagctgagccatgtccgtctcatcatcccaaggcttgacatccagcaggatggaggacttggtgccaccagtgcaggcttctgggccttacttctccgcgtactgccgaaggccgctcctcccgcagctgtgccgcctccttgtcctcctcctcatggtcacgggccaaacaggtcaaggtcatcatccatcgtacatcctctgcgggatgaggcggagcactctgggctggggggctaccacttggcgcaggggaagatacgtgctgggcatgtggtggccgatggcccggtaggccaggagagcacttctccagacacgtacagccagagacctccaagcttggaga

SEQ ID NO: 523720 - DNA, 203 bp, Homo sapiens
ggctgagtgaagagtatgcaatgagcgatttgtaggtctgtatagtcgtaggcagatggagcttgtcataattatgccctcctcagggatagtaccacaggcacaggggtcaggctcatgtgtttggtcagggggttgaggacatgagtgtgcaggcgtcattatacgcatagccgccctgagttatagagatgatactgcgg

SEQ ID NO: 523721 - DNA, 123 bp, Homo sapiens
ccgagcggttcaacggaactttctacacttaagtgtcacatggtccaatctaactccttctcagtgtcagtttaacctatattagatgtcgataataagtggctcacgcctgtaatcccagcc

SEQ ID NO: 523722 - DNA, 661 bp, Homo sapiens
tccattgtcttgtgggcagtgtttgtgtaggtcagtctttgggtcctcttatctttggctccggtggatgtgttttgcgtttccatgtatcatctacgggtcttgacgtgacctcttgggtccctttggtcctcttgggcgctctcctattctttgtcctctctgcatgtacacatgtcgtgtgcttcttgcacaccctgctgtgcttttccccgttggcgtccccttccagggttcccaagagtgcatgacttgatcttccccagcttaacctgtgggattttgttcgcccttggccaaacgacggttgcttgtcaatggcatggaaagagcatatgtggcacgagtcttcacgattggacagggagaatttaagcggttcacgtgggcgtccgacgcgggtctgggaacatcgtgtcccgatccgctcacatcccactcctcaactccttaggacgcataacctaccttgtcttttttgtgtcaaatggtgtcggtattccaggtagagtcagctctttgacataatagaatacttgaaaaattaattgtatgatgtatgagaagacagacgtctcctagttttgtatcattgttgtatgactgccatgagttccaccagtaagccactctagttttggtctctgtgacatttaaatac

SEQ ID NO: 523723 - DNA, 917 bp, Homo sapiens
ctctttgtagagaggagctagaatcactcctggagagttaaaagtaactgatatttaatttcagatcttcagtattggtcagcgatgagaaaggtgcttgagctttattgtactgggtagtaacgacctggctcttcgtagatcctgtgtgtaatgctggtagtgtactgtgaagtacttccatgggttcggtagtgcggtagaacagcaaagtccgtgtgtacttcgctaggtgtgcgatcctataagaagcgggatgtatgaggcagagaaatgatggtaaggaaagtgcaggattaagcggaatgtatggtttcgaaacttaattatatgttgatgcagtgactttagcatggtctccattttgctagaagtctgctgtggtcctgcttgtgatgacggggagatcaataggacagaagctagtctaggagaccgatgatgctaagttctgcttatgtgttcccagtgtaacctagtcgttatcccagctattcaaacgcagcttcctatcttgtagagattggccataatttacgtggtgtccagtactgattaataaaacagcatctgggttcaggtaaaaagaatcatgtcagcggcattaaaacttgggagcgccgcatgcagtacacgagtaaattgtagaccctctcgcgaggtgcgtgcccctccggcagacagcgggacttaccgaccaggaggatgccgccgcacaatgctgggtgtgcccaaaaaaaaccgggggccgggttgcgacacacacggggctcggctcgtgcgatccaaacagacgggtggttaaccgcgggcggaggacaacgacagccataggggcaccccacacacacggacacagcacgcgggcaacaaccagaaaacacggtcacgagagcgctagctcagctgcgatcggg

SEQ ID NO: 523724 - DNA, 2826 bp, Homo sapiens
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523725 - DNA, 611 bp, Homo sapiens
  misc_feature (150)..(150): n is a, c, g, or t
  misc_feature (155)..(155): n is a, c, g, or t
tcccccagttcgcggcgcaccagtaaggcagcatccagtaagcggcagcggtccgcctgctggggtgtatgttgtgttggcctggggtgggggtgctcgctttgtcttctgtcctttggttctccttccataatgctcctgtacccagtncttcngacccaggctcagagagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523726 - DNA, 980 bp, Homo sapiens
  misc_feature (852)..(852): n is a, c, g, or t
  misc_feature (873)..(873): n is a, c, g, or t
  misc_feature (936)..(936): n is a, c, g, or t
  misc_feature (968)..(968): n is a, c, g, or t
  misc_feature (973)..(973): n is a, c, g, or t
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaaggaacctgtacccgaatncttgaaggccttacaccattntacccgggccttgaccaaaggggttacctggccaaggcccaaggcccccccgtgggctttgcnggtccctggcttaatgccacattgcccttgcnggaancaaggcc

SEQ ID NO: 523727 - DNA, 352 bp, Homo sapiens
gcacaatctattgaatccagtacgacgaactcgcagtgaatcatcactgcaccactgctctctaccctgcgcatcagcccgaaactctgtctcatacaagaagcgaaccgtccatcacagactcgatgccataatccgggactcctatcgaccatgactgaaggaacgttggccctgagtttcatgggactacaacgaatgctcactatactatcatcacgaaggagatccaatctatctaactgtctgcgatcgtctttgaccagcctctacatagcttgctcacaaggctaatcaccagtaacatagttcctggcagataactacacatgggtttacctacatgtaggct

SEQ ID NO: 523728 - DNA, 826 bp, Homo sapiens
  misc_feature (575)..(575): n is a, c, g, or t
  misc_feature (671)..(671): n is a, c, g, or t
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctgtgagtaccagtgggcacccagcgggaccgcctcggggaagcaaaggttgggggagggcgaancgaaaacgatacactttgcccagactctggcagcccagcctcctctgaggatccacggggtgatcagcgcgagctgccgtgtcttgagcatcctgnggtgcctgtgacattggcatgttagtggagtttcagaccaggggtcaagaggtctgggtttaagccttgcctttgatgggttgtgtgcccttgagctagtggcttccccatttccgtgcctcagttttttcctctataaagtggattgaatgaga

SEQ ID NO: 523729 - DNA, 120 bp, Homo sapiens
  misc_feature (100)..(100): n is a, c, g, or t
gactgaggatcccgtgagctcctggtttaatcatcttatgtatgtttgggcagctatcgtcattgaaattgcttcttgatttctattctggatagttcantgttagtatgcagaaatgct

SEQ ID NO: 523730 - DNA, 172 bp, Homo sapiens
ctcggtaccgcttctgcttctgctcagacttggatttccttttcttctgcctgggtccccttcgccggatgtgcttcctgcttctgcctcagggcttgggtccaaatactcaactgccactcggccttcaatagagcttaatacataaccctacttgcttcctgcttctgcc

SEQ ID NO: 523731 - DNA, 129 bp, Homo sapiens
taatagggttggctcatcgcatgcaggcgggcccccatgaaagggtcaggcctttgatgctggtattagtgaacgttgcaccccggaaactctccgggagaagtcgggaatccccataggcaacgacag

SEQ ID NO: 523732 - DNA, 3475 bp, Homo sapiens
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggaggtcagcgcctggtctgggccgggaggggcagggggatctcacctacagtggtgatgggggagctccctgctccctgcttctcaggccccacccctcctccttgttcttgctcttctcagcaagccttttggtgcctggtgcagatctgcgacaagtacctcccaggttactacagtgcagggctggtgagtgtctggaggctgggtgcatccggggctgtggcgtttcctccaggctgcaggcaggtccttgccttgccccaccctggccttcccggcttctgcccacagggccggccagttctcccctgatgggggcacagctgacttggccctcttctcatggcttgtcccacctgcaggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggtacttctgtggccctccaggccatgaggggctggggtttctgtggtggctaccaggggttctgtcatatttctggtggtccatggacaaaaggtacttgttgggtggaggtttcaccataagcagctgggggctggagaaacaggcctgattttagttctgccaccaacccagagcctgctctccctgccaagatcctgagactgatagcagctcatgtactttcacagggcctcagtttcctcatctgagattggcagtagatggggatgggggctgtgagtctatcctgatcaggacaggctgagatcttgggtctgaccaccccatgctctctactctccacccctgcaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523733 - DNA, 331 bp, Homo sapiens
atggcagcatcttgagcacatgcagcagcagcacatccaacccatgcaagcatggcaaagcaactggtccttgacgcaaaatcaaagaccaaccctggaactgtctttccatcagatttcttgttaactgaggtaataaatcccgatcgtcaacaagaaaaagggggaggggtgacaggaccgcaacagtctcctcaacgcatgcatcataagcatggccaaatcatgcctcatcaaccacagcatgttccattgctagggacgccagtggctccacgccaatgtaatccccaggcactttggagcagagccccaagatcttgcatccacc

SEQ ID NO: 523734 - DNA, 3296 bp, Homo sapiens
tcggagtttgggtgtgtttgggaggagggagaggagcaggcaggaatggaattcaggatgcatgcgctgattaggcttgtgagtaaggggctcttttctgatgtggggctgagtgaatagaagtcctggacacggcagtggggcaccctcaagaacagcagatctagggtacagattttattcttttggatgcagagacaggagaaagggctgaggcacagctggcttccaagccttccccaagaaccatgaaatccagtgagaccgataaggcaggccctgccctggggagctactgctttggggtgacaaagacatttagtgctagaggagggctgatgctgcagctgtggaaagcttcctggagaaaatgacctggaaggtttctgggatgtggctgaggaaggagggcgagggtgcagcctgtgctgggatggccaggagcatgtggagtatgtagccaaaggcggagccccggggcctggagtgctctgctgtgggctgagcctttagctgaagctcgctcagcaggactgggcaggtggatggaggagcctggtgataaactctgggacgaatctggaactgggtttggggacagagctctcagcccgtgactgccctcacagtcttccccaacccccacaggcaacaggacctgtaccgaatcctgaaggcctacaccatctaccggcctgacgagggttactgccaggcccaggcccccgtggctgcggtcctgctcatgcacatgcctgcggaggtcagcgcctggtctgggccgggaggggcagggggatctcacctacagtggtgatgggggagctccctgctccctgcttctcaggccccacccctcctccttgttcttgctcttctcagcaagccttttggtgcctggtgcagatctgcgacaagtacctcccaggttactacagtgcagggctggtgagtgtctggaggctgggtgcatccggggctgtggcgtttcctccaggctgcaggcaggtccttgccttgccccaccctggccttcccggcttctgcccacagggccggccagttctcccctgatgggggcacagctgacttggccctcttctcatggcttgtcccacctgcaggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggtacttctgtggccctccaggccatgaggggctggggtttctgtggtggctaccaggggttctgtcatatttctggtggtccatggacaaaaggtacttgttgggtggaggtttcaccataagcagctgggggctggagaaacaggcctgattttagttctgccaccaacccagagcctgctctccctgccaagatcctgagactgatagcagctcatgtactttcacagggcctcagtttcctcatctgagattggcagtagatggggatgggggctgtgagtctatcctgatcaggacaggctgagatcttgggtctgaccaccccatgctctctactctccacccctgcaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523735 - DNA, 3311 bp, Homo sapiens
aattaagtgattgcccaaagtcgacacaatgaataaatggtagaagctaggacgtggatccagatctaatgcaaaatgtggctttaaaatactccatactctctccccagattgggatgtgtcagaagtgagatttaaatatgacctctgaatagagatccatcaggaaaggaagccctttcagtgtgccttgggatgcccaagtggccagacatcctgatgtttggcagctcacagactatccagtttctcgtttgagcttggggaggtggcttgcctcagttccccctgcaatgcaggttttacactattgctactgaccccttccgtgctcccccgaccctgcagagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggaggtcagcgcctggtctgggccgggaggggcagggggatctcacctacagtggtgatgggggagctccctgctccctgcttctcaggccccacccctcctccttgttcttgctcttctcagcaagccttttggtgcctggtgcagatctgcgacaagtacctcccaggttactacagtgcagggctggtgagtgtctggaggctgggtgcatccggggctgtggcgtttcctccaggctgcaggcaggtccttgccttgccccaccctggccttcccggcttctgcccacagggccggccagttctcccctgatgggggcacagctgacttggccctcttctcatggcttgtcccacctgcaggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggtacttctgtggccctccaggccatgaggggctggggtttctgtggtggctaccaggggttctgtcatatttctggtggtccatggacaaaaggtacttgttgggtggaggtttcaccataagcagctgggggctggagaaacaggcctgattttagttctgccaccaacccagagcctgctctccctgccaagatcctgagactgatagcagctcatgtactttcacagggcctcagtttcctcatctgagattggcagtagatggggatgggggctgtgagtctatcctgatcaggacaggctgagatcttgggtctgaccaccccatgctctctactctccacccctgcaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523736 - DNA, 218 bp, Homo sapiens
catgctaggatactgcaacacggtatcactttcatgtcaccaagatttaagatctgcttaacatttccgcaagttcattagtatctccaggctcaagatattcctgtatgattggtagttaaagtcttctcaaactgccctgttcatccaaaggcaaaactacagtttcataaacacagttctcctgatcatcatcatagttaggatctttcacatcc

SEQ ID NO: 523737 - DNA, 2637 bp, Homo sapiens
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523738 - DNA, 1257 bp, Homo sapiens
tgatgcccagttggatggctgtccagttgaggactacacaggtctgggagaacacatgtgtctctgtgtatgcgtccgtgtctgtcagaccgtctccctcacaccgggctgcctagcagggggtgctgagcagtctgatgctgacacctgaaagactccacttgatatagcgcctcctcccctgcgttctctctccactcccgggagtggagagagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523739 - DNA, 710 bp, Homo sapiens
ggtcgagctcgtaccatatggtggacgaggtatggttgctttgtttttttggaaagtgctaacaaagcccataatctctaaagggactgggtgtaatgactgaaatataaacagcataaagtatataaaaattacacttctaaatgggatagtcaaaactttttaaacagatgtcagcaattctgtaacctgggcaatcattacttacaagtatactttatatgctggccagacaattaagataattcagtcttagtgtagccatttctttactatctatgtgtaaattaccacagtgacgggtgaaagctccaaaactctaaagctagacccaaaacagctcataagctactctgagacaaataccacaaacagcaggtgcccagaatttctagtgatgtctcggtctattgaaagacctatacagttaatggaactgttccttagcccttctcagagggctgattttacccagattaaatccaattccaatatggttttttcctttatatcagcccagaatttagagttatggattggctttggtcagtaacagagttagcagggtgagtcagcagcctctgaacccctcaggtaggaagacggtcgagggtacttaaaaaagctttattactagaagatgaatgagataccttacaaaataatatattcagttaatactgaaacagggcccattttatcttagatat

SEQ ID NO: 523740 - DNA, 2755 bp, Homo sapiens
gccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaggcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 523741 - DNA, 1265 bp, Homo sapiens
  misc_feature (131)..(131): n is a, c, g, or t
  misc_feature (300)..(300): n is a, c, g, or t
  misc_feature (733)..(733): n is a, c, g, or t
gcagaacacaggagggtgtaatatcggacgccttctaatatgatcgcccgggtgtgtcaaggagatcaacagcccaaattccgtgtaattacgtgggtgccatgaagaatgcgactatctccttggtgttntgaggtgccgccggcaactttacagcacggcatcgactggagacagtacaattgaattctttacttcacaattcacatacaagaaatgctcggtggctggatcactgggacagtcgtagtaggaccatgaggctcgatggatacatctacaagagaccaatcttttggncctatagcttgacactggcgaatgattcagttcttggagtcggtggagacgatggtgtcacgaccatccacgattgtgctgaatgtgccatatgcctcatgcgagaactggtggtccgatcttacgactgtctcttacagtcagagcatctaggctcgcagggagattgtggaactggcttcttggatcgtcgacgtggtgcgcctgactcaagtagcggaagagcttggtcgtccatgaggggcctagaggatcgctgggttgggtagttgctagcgagacaccctgttcagaagggtactagtagcgtggatcagcactttcccactttgaggatgcttttcgctcgcgcattggcgtttgttggagtcgtagtacacaaccatttttggcacccaaggaaatgtaatttggacttgaccttatacgattnggcaacttgcattggaaatggataaccggaacgggacgttgaatgcggcgtccttgacagcgatgcgcgctaggttggacaatgggtgcctttaacccaccgcggcctgcatttcatacttattgactttagactcttgtggcaaagaacccaccaaggtcgcgcgcttatcccacccttagctctctttatgggatacagaggcctaatccggtcttcattacgaaattaaaggactgggcttgattcgtagaaaacggttccctttctatagacgaagtatacatagggacacaaatacagagacaccctctcgtaggtcgacgcatcctctaagtgacatcggggggtggcgcgagaggaggcaaaggaaggggcgggtcctttggcacccagttgcgccccccaatgtgtgaccgaatatacgcctatggattgtcccccttgaagcaccccgagaatcttctcctttgggctcacgcaatcgcttgtggccataggaatcggtcgccgggagttcgtcccgcataat

SEQ ID NO: 523742 - DNA, 894 bp, Homo sapiens
ggatgactttcccactgagctctacctccctgttgctgcggatgcgacgatgcatagggtggtctgggattgccttcccgcgcgctggttgcctgaataagtcccctgttgcggcctgcatggatgctcgtatcgcgagccacacgtgtccatatgtgaaaaaggacgcttcggaggtggccacatcaaggatagagctcttcgggactgtgaaggatgacctctctatttagctggagtaccagaagacacctgtcagtccatgtgcggcacctgcccgcggtgacctcggctgagagagagctccagcagatccgcgattagacgatggtgaatgatcatgagatcagtgtggaaagcaagcaccagaccctgcagggcctcgctttccccctgcagcctgaggcccagcggtgcactccagcagctcaagcagaagatggtcaactacatccagatgaagctggacctagagcgggaaaccattgagctggtgcacacagagcccacggattgtggcccagatgccctcccgggtgccccgagatgctgcccgctagccacttttttcctctacaagcacacccatgagggcgaccccttgagtctgtagtgttcatctactccatgccggggtacaagtgcagcatcaaggagcgaatgctctactccattctgcaagaagccgctcctcggactccgtggagcaggaatttccatctggagatcggccagaaacacttggaggattggccgatggggcagaactgacgggctaaagatccctcttacgacgaaggtgcacccaaggcaaacggccttcaagcaggccttcggccaaggccaaaggggcgcaggggggcaagcggtgccataagcgctcatcccgggtcc

SEQ ID NO: 523743 - DNA, 211 bp, Homo sapiens
  misc_feature (192)..(192): n is a, c, g, or t
ggaaccccaccctgcttatagaggccccgcttaaccccaaggccaaccgggataagatgactcagatcatgtttgagacctttaatgtccctgctatgtacgtggccatccaggcagatgctattccctgttatgccttctggcccgtacccacaggccattgttcctggactctggggatggtgttactcnacaatgttccccatctatg

SEQ ID NO: 523744 - DNA, 548 bp, Homo sapiens
ggatcctgcatgggccgtgggatgtgaggcggtcggccgcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagcaaatgtgttcgctcctcggtaatttgccatttttattttcaatttccaattctatactaagacatcatggggggttctgtgacagctacctttgcccctgcc

SEQ ID NO: 523745 - DNA, 170 bp, Homo sapiens
  misc_feature (164)..(164): n is a, c, g, or t
tcggggcccagagtactggagagctgccaggtctgcctcgaccacggttgcttgggccccggagcccacggtgtctggtgatgccatagctgccaccaccgcggcgcctagggctgcggcagggcactcgggcctctgggcaggtttacctcgacccccacttngtgccc

SEQ ID NO: 523746 - DNA, 132 bp, Homo sapiens
gccatacattatgctactatagtcactctgctacagaacattacatttgttctttttatttaactgtatgcttgtacccattaaccaacttctttatatgcctactcccacccacactgggttaagtaagca

SEQ ID NO: 523747 - DNA, 429 bp, Homo sapiens
cacgaggagagagagagagagagagagagagagagagagagagagagagagagagagagagagagagagagagagagacatgtagagaggtgaccgttactggaactgaagttgtggattatgcctgatcaatatgacaacctccctaaagcacccagactttgtggcatatcccatgttggagaagccagtggggagcctgactgggattgttgcattcctgggcaagaagctggcggaaaggggttttgacatggcctatgctgtccttgtccagttcttggtgctaaagaaagatgaatacctcttgcgattatggctggacacttgtggctgcaacgccaatcaaccctggtactttttctgatgccttcgagagtagtgcgacgccttcttgtgatgctctctgaggttctcattgctcgccct

SEQ ID NO: 523748 - DNA, 171 bp, Homo sapiens
ttagctatcatgatttatagcatccatatgttctatatccatatttgtccagcgctccatactcttctgaagctccttaatgccagcttctgttttatcaatggaattgtccaaatcttctgatcgtgccatagtgtcttttactctgctattgaaacttctaaaactagg

SEQ ID NO: 523749 - DNA, 342 bp, Homo sapiens
  misc_feature (6)..(6): n is a, c, g, or t
accccntttaccatgttggccaggctgatcacgaacttctgacctcaggtgatctgcctgactcggcctcccaaagtggtgggattgcaggcgtgagccaccacgcccaactgcattacctactttgaggctatttctacagaatttgcggaggttgggttatgattaatttaagacttatacagtgttaagaaatttgtggtcactgcatcaactcactgttccatgtaatgaattttgtaagctcttcaactagagaaggaactcgaagttttaaagcttgtgactattttggaatgctattcattctcttaataattaaaacaaaattcagtgagaatc

SEQ ID NO: 523750 - DNA, 172 bp, Homo sapiens
cggtagagacggggtttcaccattttggccaggctggtctcgaactcctgacctacggtgatccacccgcctcggactcccaaagtgctgggattacaggcgtgagccaccgcacccagccgcctgagtcttacagatgctgctcctgtagctccccttctgtcgtcttctc

SEQ ID NO: 523751 - DNA, 1237 bp, Homo sapiens
  misc_feature (1)..(1): n is a, c, g, or t
  misc_feature (90)..(90): n is a, c, g, or t
ntcgtctgactgtgcagtcgcgacggggtctgagaggtggctgtgggtggtgtggtaggactgtcacttgtctgctgctgcgctgtctgnttcaggcgatggtgcgtgtccatcgtgttgactcgacttggttgccttgctacaattgtcgtctgctgtgttcggtcaaccgctctgtctctaatattgtgacggtctcctctgtcgtgtgtccgcccgctgcttctgtagctgcaatgctcttttcggatgtgtggcccccccctgtgaccccagaggggacccgtgggttgagacggacaagtatatgtccgccgcacccctgtcatctctgaaggtgttgccccactatagtgtgcccggtcctctgtttaagtggtgtaatgtgagcacccccgtggcccagccccgacaagtcatggtatgaccaggaaatgtgtgcccccatgccagtgtatttggaccacagagtcccaaaccttcggccacagttttcttctagttatgatggaaagtttcttgttttcgtgcctctgaatagaactcacgctgtgggttctctataagtgccattttgggctttcccccttttgtgtaaagccaagtctgcctagtttattgcccagttaactttagtgaccctttaaaagttggccttgtaaataaacaccacttgccaaaaagttttttcggaatagaattgacccaatattatctcttattcactcgagttggaaactcgggaaaagcgctttcttgaagataaatagtttctcgagtggaggctacttgggaatgtctttccacgccctcctgccaagtcacaaggaggtaccaccctgtaattgaattatgccctgtaatgtaccacgggcgtccccttcaattgcaatctgagggacttgttttcttttttcctttaatttttaatcctcttagttttaaaatatattgcctatgagactcacgttactacccacgtttgtggttttttgggagaaaatgtaaactggaccacgttagcttttccaatttaaaagaccaccttaaacccactgtgggatgtcactctttttataattagtgttccactgtggagaaaattattcaccacctacttgcactgtaaagaataatttaaacttttaaccactttaaaataatgtggttaaaacccacgaaagcactccatcatgaatgccagatactttccaattaaaagtaagttatatagtta

SEQ ID NO: 523752 - DNA, 920 bp, Homo sapiens
  misc_feature (73)..(73): n is a, c, g, or t
agatcccccaagaagaatgcagggttgcagacgagcacagtcagctctgctgagtatggatggtgactcaagnttgcccatcattgggagtatctctaaggaccccttctgtaggtagctgggatgtcatcatctatatccctattgacgcgctggtgtgtcctttgaccgatgtatgtgtagcaagtccaaagcataggatttgcgccgggtgtcagttacccgattctcctcgacacttgattcataggacatggccttgtagactcaatgttagctctgaagcagaagaagtccatggaggtcaatttgcacatttccttgtgttgcccctttttgcacatagtcgaatcctcgttagtaggcaggttttctaagcttcatactaaagaatatttcttttcccataaccaatcataccactttggctatgtttcattccacatctccttttcccctcaccttaaagggagaactaccctctttgccccatatttgtcaacctaaattttctctcgtactctctctagtgaatgatgtgctaaccaagtatatgccaggcttgtgagaggattatacctgagtagtagaaagaagctaactttgaaaatacacaactattcgtatactaacgaacagcagattagattgcacattgttcaacagggacagttgactggaatgttctgccaacgttagaattcaaaacatcattaaagatgatacgcttgtccataattattagctaagccattatgttaagcctttgttagggtgcggcagctttccggttattcccttcctctgtggtgaccacggggaatatccaacgaatactctaccgggcatcggcccaccgtaaatccccctcgttgcacgggatgcgcgacgtcacaatcacactttggtacacgacccct

SEQ ID NO: 523753 - DNA, 400 bp, Homo sapiens
  misc_feature (13)..(14): n is a, c, g, or t
  misc_feature (18)..(18): n is a, c, g, or t
  misc_feature (62)..(64): n is a, c, g, or t
  misc_feature (71)..(72): n is a, c, g, or t
  misc_feature (79)..(79): n is a, c, g, or t
  misc_feature (130)..(130): n is a, c, g, or t
  misc_feature (143)..(143): n is a, c, g, or t
  misc_feature (155)..(155): n is a, c, g, or t
  misc_feature (193)..(194): n is a, c, g, or t
  misc_feature (197)..(197): n is a, c, g, or t
  misc_feature (201)..(201): n is a, c, g, or t
  misc_feature (211)..(211): n is a, c, g, or t
  misc_feature (222)..(222): n is a, c, g, or t
  misc_feature (225)..(225): n is a, c, g, or t
  misc_feature (227)..(227): n is a, c, g, or t
  misc_feature (253)..(253): n is a, c, g, or t
  misc_feature (291)..(291): n is a, c, g, or t
  misc_feature (333)..(333): n is a, c, g, or t
  misc_feature (346)..(346): n is a, c, g, or t
  misc_feature (348)..(348): n is a, c, g, or t
  misc_feature (367)..(367): n is a, c, g, or t
  misc_feature (381)..(383): n is a, c, g, or t
caggcttacctannacancctattctttcctctatgatatccgaattggactgacctcacgnnnaaagttnntgtcccnttttgtcaccctatcttatctcggggaaattgcagactgatggccagaccnactctgttgaaantcttgcatagancaaacctgtgctcatttttaagtggcatgggagaggcnnggngccnagtaaagccnagtctgtgtcntcncngtgctggtagaatgtgtttgtgtgtntaaatatatgatatagatttatatatgttctaacgccntatattgaaggccgacataactggtggacagggtgggtgacngaaaatgaaagcngntttggtgattgtttaagcnagatgtgtataaannnataaatagtttttcttt

SEQ ID NO: 523754 - DNA, 427 bp, Homo sapiens
tactgcctccttggggactggggaactcatgccctgcccccaccacggggctccagggtgagagaaaggggtgaatggagaatccggtggctgggtgatggggaggaacagcagctggggtatttagggctgggggagtaggggcagaaccaccgatgaatggaaaggctgcgggggtcgtctgcagattctgggagctcaggtcctggggaaggaggatgtgggcgggggtactcttcctcccacgagtgacaccgatccccaacccatactgggtgggtccaagttgccatggagaccactcacaccgggggcaacgtaatttccagggaacgttccgaatttctgggtcccccgggagaaaaccaaaaaacagccatcgtcacactgctgcgtgacattcaacctgttcccctcgcgcaggtcc

SEQ ID NO: 523755 - DNA, 157 bp, Homo sapiens
acagcgattcggtgtggcgcgcctgggtccaatgtcaggtaatgtgaacgatggtcgataggcttggttggccttagcgagatcgctggtcaatgacgtagatcgataggagtcctcaccaagtaaacacacatgctcggtcggcagaccgagtcga

SEQ ID NO: 523756 - DNA, 122 bp, Homo sapiens
  misc_feature (60)..(60): n is a, c, g, or t
gcacgggacaccttaccctactttttctcagtttagagagtaagtaagataagaccattntctttttgggagcctgcggtttataagcgttcaattaagccaagagataaggattttttttt

SEQ ID NO: 523757 - DNA, 780 bp, Homo sapiens
ctcagctgcagacgcgatgctcagttatgccagaggcatgagtctctgtggacatgtatcttgtggaggctgtgttgaatctgtctctcgggtcctcaataagcttggaggagttaagtgtgacattgacctgcccaatcaagaaggtctgcattagaatcgagagacacagaatggacactctgcttgcaaccctgaagaaatagcagtgaaagtaggtgttctcctaaccttgagtccttgtagtagctacgggtgcctggtcaccacaacaacgccacagtgatggactcagaaggggtgctatgcctgagattggatgaatggcacacagagaggacgcatctctgggccacactagccttagactgtctattctagtttttgccccatatatccacgacagtaataatgtgtcgtgtcctaattgtttgcaggggaagatcactggaccctgaaagtggtaagtagaatcctggtcgtgaaatgcctgcttacagataggaactgataagactttgtgaaaagatttaatgtggacatcttatccattttgccccaatatttaaatagcgttttataaatttccttactgcctgttttttacgtggaggtactcgagaaatcatcaagtgtgaagatctaactggactattgatcacctttttcccagatccaataccccttgctgatttcccttatgctggttctctctactttaatctcttattcctggtcatcttcaataagctgaggtaccgctttgtccatcttcaggac

SEQ ID NO: 523758 - DNA, 120 bp, Homo sapiens
cgtaccatatactaaggggaagtagtagccaataagagaaggggaggagataagcaagagataatagcagaatagagagaccctagagaaagtacctagtccacagtctatcgcgtagat

SEQ ID NO: 523759 - DNA, 100 bp, Homo sapiens
ctgccccatcctcacttggggctgatgccattttaggcctcagcctgtctgcatgcaggcgctcattaaaacagcatgttgctccaattattaaaaaaaa

SEQ ID NO: 523760 - DNA, 134 bp, Homo sapiens
ttaggcacagaaacgacaaagggcttatactagagaattgcacacaaaatgagttacttggcagcacaaggtagggatgtatgtgtcacaagagtatatagaccgttctaccttcatgctctacgcgtgcctta

SEQ ID NO: 523761 - DNA, 375 bp, Homo sapiens
actctttagggacgtagtggaccgacggggttaacgggacgacgggacgcgcgcctgcgccgctgggtgattttttcacgtgtcgccaggccggactgcgagtctctttgcggcgctacactacgagcagagtacgagtctagaggcggagggaagtaatggcaggacaagcgtatagaaagtttcttccactctttgaccgagtatgggttgaaaggagtgctgctgaaaccgtaaccaaaggaggcattatgcttccagacaaatctcaaggaacagtattgccagcaccagtagtcgctgttggatcgggttctaaaggacagggtggagagattcacccagttagcgtgccagttggagatacagttcttc

SEQ ID NO: 523762 - DNA, 296 bp, Homo sapiens
gcgcgatgtaacacgagaaagcacataccaaggcaccacacaccacctgtccaaaaaggccttcgatacgggataatcctatttattacctcagaggttttttcttcggcaggattttctgagccttttaccactccagcctagcccctacccccaattaggaggcactggccccaacaagcatcacccgtaaatccctagaggcccactcctaacaaatccgtattactcgcatcagggttatcaatcacctgagctcaccatagtctatagaaacaccgaaaccaataattcag

SEQ ID NO: 523763 - DNA, 349 bp, Homo sapiens
tttctgtttggggcccaaaaagttgctttttgacccacaacgccccttatcttgcccccatataaacccaaaaccccaacctccagagcataccagcaggtgagtatttacgacgcaagccgactgccggcaaaccgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaataa

SEQ ID NO: 523764 - DNA, 172 bp, Homo sapiens
gggaaaacgaggattccagcgtgcacatttccccccggcagaagcgagatgccaacttcagcatctacaagggcaggaggtgccgcatgggtctgttcgattactttgcagaaaacgttcaagttagtatacccagcaaaggggggaaattgcgcagttaccaaattttagg

SEQ ID NO: 523765 - DNA, 276 bp, Homo sapiens
ggaccgcgtctctgcatctatggtgaggagtctctgggtcagagagctccaaaggacagcagccatttggggtcttttgtagccctgaggttcgtcttacctatggtgagagggtgtcgggtgtagttttgcaaaattatcggaacacaggcaggctctagaatgggcaaataatattgggcctacatttaaagcaatcggatgtgcaagaatttgagtttggtgctggcaggcttgagttaacggtcctgggctgtggtgtggaagtaaacagca

SEQ ID NO: 523766 - DNA, 141 bp, Homo sapiens
ctcctttctccttctcaacacctcagctgactccaagcacaccatcctgagtccgtggatgaggagcagcagtgagcactgcacactggccgtctcggtgcacaggcacctgcagccctctggaaggtacattgcccagct

SEQ ID NO: 523767 - DNA, 902 bp, Homo sapiens
acgacacgagacggcgctcgggcacacccaaggagaagaaggccaagactccaagaagaagaagcgctccaaggccaaggcggagcgagagggtccccgtgccgacctcccaattgacccaaggaacccagtactgtctgtgcaaccaggtctcctatggggacgatgaatcggtgcgacaacggacgagtgccccatcgaggtgtcccacttctcgtgcgtggggctcaatcattaaaccccagggcaagtggtactgtcccaaatgtgcccgggcgggagaaaccgagaagaacatggggacaaagccccgtgggagaaaatccaacaaaaaagagaaggggcttacaaaacagggtaaggtgtgtggacaccaggcgcctggtgtggacgcgaggacaaaattaacacccggtgttattacaattaaccattggcctgcccttgtgttagagggtgggcaacgggaggttgtaaccaaggtgtctattgctaaacaaactgtgttcacgacaaaaagggacacccatctccttttcaatagggaatgggcaggagaattacgtgttgcgcccttgtcgttcattgaggctacccggttgtcaccaagaacaggtgtcctgtgagaactcagccattttaagaaaactacaaaatattgggtgagatccacaacactttaagttctcaagactgatatcttggcgagaaggagcggggacctaaactcaaatctaagcacaattaatgtgcaaccgcacacatattccacgcagcgtgtgcattgtaatcacacggtaatttattacttaatgcaccaattttgtacatgggcagtgtcgcaaaaaacggcatagaaaggggttctggcgccgatgttttcccttcacactcgaccaagt

SEQ ID NO: 523768 - DNA, 185 bp, Homo sapiens
taaaagagatgtccgacgatgaagcatgttgatggggtttaggagatgcgtatgcctgaatatggaaactcaatattagagaaaatggcagaatcaggaaggtcactctcaccttctctcctgaagcaggtcagaaaatcttccctaggttatatgacctgcttcagcgagagaaggtgagagtg

SEQ ID NO: 523769 - DNA, 114 bp, Homo sapiens
tccaggaacatcctgcttcctctcacctccccaatgactgtgcctgtcttggttaatttggcctgtccccactgtgtgtcccaatgtgcgtgcctgtggcacgcccgccactgt

SEQ ID NO: 523770 - DNA, 315 bp, Homo sapiens
gttgtaggttcatagtcccggtaatacgtgtaaaggagtaggaaacttagggtcatcattcacagttggagaaagccgacagctgtccatcaaacggatcgtatttgatttcaacctaaacagcacatgccatgcagttgcatatcaacgtctgttgaggggccacagtctctctcgtgtcttttctctggttgttggtatgtggctatttgtaaatacaggtagttgtcctgtacgatggcattataaacggtatgtgaggtcaaaactgtgttgtgtctatggctttagtttcatcccagttagcgtgcgatg

SEQ ID NO: 523771 - DNA, 177 bp, Homo sapiens
ggggggggggggggggggggggtgttcccccttaaaatttttttccccgggggggggggcccccaaaaaaaggggggggccttttgggggggggggggggattttttttttttttttccccccggcccgggggggggcccccccccaaaagggggcccccctaatttttttggggga

SEQ ID NO: 523772 - DNA, 1196 bp, Homo sapiens
  misc_feature (481)..(481): n is a, c, g, or t
  misc_feature (508)..(508): n is a, c, g, or t
  misc_feature (564)..(564): n is a, c, g, or t
  misc_feature (586)..(586): n is a, c, g, or t
  misc_feature (589)..(589): n is a, c, g, or t
  misc_feature (602)..(602): n is a, c, g, or t
gcctcggcatcagacagccgtcttggagaggtgtacctgggccacgtcgtcctctccaccctgtccagcaacggcatgagtagaacatctctccgcgctaaacctcttcaagcgggcacttcttcgggacatagacacaacgaaagtgcgcagtccgttcatggtgctgggcgctggatgcgtgaaccggaaggacgcacggagcctctacattatacgttagatgcgtcgggtaagatcgtgatccaccatttcccagctcgctaccgcatatcatacgatgcgaaaactgctggagagacagacgaacaatcagcctatcatctggtgctggggacccgtgtagtgccctacgtgaccattgaatcctggtccccacctgtttgtgtcagccccacatttatgtatcccagcgaaactgaacatcgaagaggctcttggaatccgaatatctggttgggctcggggaacataggctatnttcgatctcaaagcaacgaaggctcgnttcgattttgagaacccggaagcgaaggcgccggcgaggaatccggaagtgtgcantggccgatccgaacttcgcacntgngaatttttggcanattgtcggcctccgcggaagaagaacctccgcaacagccttactcgggtggtggagcttcgccggataagatcctcttttccccttttgtcgattggtaatcctaagctccccaaaccgaaaaaagcacaaagggaaacccttgctccgcccttaggaactgcggcgagatggaaacttggcggcgtcgagagtaagtcactagggaccaataggcgtgggtggaccatgtcttcgttcaaacctaaacgactcgatcgaacagtacaacgtggtataaattgcgaagggctcagacacagaagctgagccaagctggacgaaacagagagtgtactcactcgtcaatgggagcttgtggatcttggcacttggtgccaacctcagtttacccggtgacactcgagacagttggagacggcgcaaactccactcttccctttcgttcgattgtacctatcttttggaccctctgtttggtaacctcgtacaggggtcggcgacccggtagtccgggtcgtgggtgggaaaattgccctaagaactagcctccgcggggttgggacaccgggttttcttcgccccgggctctgga

SEQ ID NO: 523773 - DNA, 316 bp, Homo sapiens
gtttatgtctattctaagtgaatttcactgtgtgaaaaaattcacacctgttatcccagcaatttgggaggccaaggcgggtgtatcatttgagcccaggagtttgaaactagcctgggcaagatggtgaaaccccgtctctataaagaaattttaaaaattagctgggcatagtggcacgtgcctgtagttccatctactagggaggctggggtgggaggatcgcatgagcccaggagtttgaggctgcagtgagctgtgatcgcagcactgcactccagtctgggcaacaaagcaaaaccctgtctcttaaaaa

SEQ ID NO: 523774 - DNA, 656 bp, Homo sapiens
  misc_feature (4)..(4): n is a, c, g, or t
  misc_feature (185)..(185): n is a, c, g, or t
  misc_feature (248)..(248): n is a, c, g, or t
  misc_feature (280)..(280): n is a, c, g, or t
  misc_feature (302)..(302): n is a, c, g, or t
  misc_feature (329)..(329): n is a, c, g, or t
atcngccagtctgttcttggcagcaaatctgtgttcacagcctaaccattggcctatatgagatagtgggcttggtcttccttgtacaccaaagagcatcagagagtaggtatctcttccccctctgccaagttcccttctgcgcaagaggggagatctgtttgtctgagtccgagtgcttttcntaggttgatatagcaagctccagaagaatctgacagaaaaagaccctaactgtgtaggagggnccctcagagtcaagaggcaaggatgattttanattctgcatgtagggcatattntggggagtgatgggattatgcacatcnttcaggtgtcaagataaagagataaaaccagagtttgtgcagaatgagcttgctgacacacaagcctaaatttgtaccgcatgtttcatactaactccctctgagtttgcacatgggacccatgaggaggcatgaagaggtaactgcccatgcccgaggattttccagcccttccttttctttctgtcaatcacctactaatcacagaatccactccctacaccttttctactaaaataactctttaaaataagtacaatgggacagatttgagctgggctcctgtctccttgttaatcaaattgcaatcaaatgttttcttttgtt

SEQ ID NO: 523775 - DNA, 921 bp, Homo sapiens
  misc_feature (568)..(568): n is a, c, g, or t
ctttatacacctcggctcccgtgttataatctctctcacatttaaattttatctccattttttcgccttttttaaggcccctcttttgtgtcccccctctcatatgtgtgccatctattctttgaaaccaccactttttttacaaaaaacgtgcccgtatcttatgggtcgtctccgcaacctctctccataaaatatttgggctgtgtccaaaacacactctcgcccataactgttggttctatgaccaatcgcctcgcctgctccctcccattggatgtgcgttttaattgatgaattctccctcttgccgctatgttaaaccttactctctctctatcaattgtccttatcttgcgcccttcttcccgccgaaaccctttcttcaaccccaaggaggactactctgtcggccactattaacaaccccgtctctaaacaaatggggtttcacccttaagttcccaccctcataatgatatcttcctttctttccctttgtatccccctcttacataagataaatatagcgtactataggtggtatatacaccaccacacccccccncactctgataataaggggataaattagttagatcacccccccacaccatgtcagaacatactgctctgcattgtaaaataatttgtgcacacagatattctttagtagtgaaaaattcttcatggaaggaaaaggttttttaaaaacagccattttcttcagtacaaaccacacggcaacaacaaatattgagctaataataatcaagctcacaagaagattcatcgtcttgtaaaaagtacatcccgcttggttaagattccaccccaccaactgacacctccaccattgatgccacacagccaccattcaagacgttgaacttttgaaccatttaacattcaaaaaaaaca

SEQ ID NO: 523776 - DNA, 379 bp, Homo sapiens
acactaaagaagatatataaataatgtcaatcaaacataaaggtgatcaacatcttatgttatcagggaacggcaaattacaacagtgacataccatctcacacctagtaaaatggctaaaatccaaaaactgacccaaaaccaaacgatgataaggatgcggggcaatagaaactttcattcactgtcagtgggaatgcaaaatggtacagccactttggcatgcagtttggcagcttcttataaaactaaacatgtttacagcaattgcactcctaagtatatacccaattgagctgaaaactcacggccacacaaaaacctacatacaaatgtttagagcagttttatttatagctgtgaaactggaagcaatcaa

SEQ ID NO: 523777 - DNA, 605 bp, Homo sapiens
ggcaagctatcggttcactaaacacacaggatcacacgggaaaagcctactggtgtcatcactgtggaaagactttctgtagcaagtccaatctttccaaaaattagggaagtccacactggaagagggaagaagcacgtaactttcaagcgcctcctgttggtgtcggtggtttaaactttagaattctgaaacccaaaagaaggtcttgtcattgcaggagcatcgattcccggtggatagaggtttgtatcactcaaacatacagggggatgcctgaggagtgcgagctcccacagcaacatggcaggcaggaggtcctcagaaggtgtaggaggttcccacactcgccagttcactggagcagagtccccttcgccacacttagggtcccagtaagccatgccagcattaccttttgcgtaaacagacgtgtatccagtctagttaaggaagaaacattaagattgtttaatttttaacatatattcaagaattttaatttgtaaagaattgaaccggatagcttgccggcaagctatccggttcaatgagttcaccctctaaatcaccacgatcaaaagggacaagcatcaagcacgcag

SEQ ID NO: 523778 - DNA, 190 bp, Homo sapiens
tgtgttatcctgctctacaaggttgagtgacatgtgccatgcgctatgaaatggatcatctggctgcgcattggcattgatgcaggtgtccagggctgagtttctgatgaccagctccatccgtgagctgctccgcctccactcttcttctcttccagctccttggacaggttgtctcgtaccattccgc

SEQ ID NO: 523779 - DNA, 171 bp, Homo sapiens
tccagcctttctcctccttagcctagcacaccggacggacatcctccttgccacccggtctcagtcatagctgttcccgtgtctgtacggcccccatcccctcggcaacatccgccctgtcaagagggaagtcaaagtggagcctgagaagaaagagctgagcaagcgagg

SEQ ID NO: 523780 - DNA, 168 bp, Homo sapiens
ccgttgggtcagtgagtccatgccgccatgctcggcagcaggcgcaggctcctccacgccccagtgtgccgctgcgtgcggatcgcgccgtccgactctgggtcgtagccagcctgaaggagcaacctcatcacctcaatgtagcccttggcagctcgcccctgagtt

SEQ ID NO: 523781 - DNA, 582 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (8)..(8): n is a, c, g, or t
  misc_feature (13)..(13): n is a, c, g, or t
  misc_feature (19)..(19): n is a, c, g, or t
  misc_feature (27)..(27): n is a, c, g, or t
  misc_feature (41)..(41): n is a, c, g, or t
  misc_feature (49)..(49): n is a, c, g, or t
  misc_feature (70)..(70): n is a, c, g, or t
  misc_feature (72)..(73): n is a, c, g, or t
  misc_feature (77)..(77): n is a, c, g, or t
  misc_feature (103)..(103): n is a, c, g, or t
  misc_feature (108)..(108): n is a, c, g, or t
  misc_feature (111)..(111): n is a, c, g, or t
  misc_feature (122)..(122): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (150)..(150): n is a, c, g, or t
  misc_feature (158)..(158): n is a, c, g, or t
  misc_feature (168)..(168): n is a, c, g, or t
  misc_feature (175)..(175): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (201)..(201): n is a, c, g, or t
  misc_feature (203)..(203): n is a, c, g, or t
  misc_feature (218)..(218): n is a, c, g, or t
  misc_feature (221)..(221): n is a, c, g, or t
  misc_feature (236)..(236): n is a, c, g, or t
  misc_feature (248)..(248): n is a, c, g, or t
  misc_feature (254)..(254): n is a, c, g, or t
  misc_feature (256)..(256): n is a, c, g, or t
  misc_feature (262)..(262): n is a, c, g, or t
  misc_feature (286)..(286): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (306)..(306): n is a, c, g, or t
  misc_feature (315)..(315): n is a, c, g, or t
  misc_feature (319)..(319): n is a, c, g, or t
  misc_feature (343)..(343): n is a, c, g, or t
  misc_feature (350)..(350): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (365)..(365): n is a, c, g, or t
  misc_feature (376)..(376): n is a, c, g, or t
  misc_feature (387)..(387): n is a, c, g, or t
  misc_feature (402)..(402): n is a, c, g, or t
  misc_feature (411)..(411): n is a, c, g, or t
  misc_feature (418)..(418): n is a, c, g, or t
  misc_feature (428)..(428): n is a, c, g, or t
  misc_feature (430)..(430): n is a, c, g, or t
  misc_feature (455)..(455): n is a, c, g, or t
  misc_feature (459)..(459): n is a, c, g, or t
  misc_feature (473)..(473): n is a, c, g, or t
  misc_feature (484)..(484): n is a, c, g, or t
  misc_feature (575)..(575): n is a, c, g, or t
ngntnaanctttnatttgnaaaaaaanaaaaaaagactganaccaattnaacctttaaatgtgcaaaacncnntccncccccccaccccccaaccccaaaacnaaaanttnaaaacccaaanacccacccaaacancttcccncananangccctttnttttcttccnctcttcnanggttcctnanggaaaaccttcttnanggaaaaaaaacaaanaanaacccaatctggccnccaacaacccanggtcancncaaccnccactggaggcgagggaggagggnaaanggnanggnaaaagaanggctgcccnccangaaccttccccttcccaaaaaacnaataaanattnggnaanaaagnaaaagggtccnaaccaactgtnaaaaaaaaaaaaaanggctgggantgggganaaaaaaaaananaaaaaaaaaaaaaatttggggaaangganaaaaaactcagctntttcaataatntggaggggaggtatggtgggggaccaaccatggccctatccaaccccaagctccacaagccccaaattggctttgcaaatccaaacatttnaaggaag

SEQ ID NO: 523782 - DNA, 114 bp, Homo sapiens
gtggtttgttagtactgtttctttagaaagacagggtctcactatgttgctcaggctgaagtactgaggctattcccaggtgtgataatacgcatactaacaccgttgaactcc

SEQ ID NO: 523783 - DNA, 472 bp, Homo sapiens
cccgcgggttacccgtgtatatcaaattgtatgtaataactgtgtgcaatacagactttgttatactgataactgctttaataaatattttaatactttttaggcattatagctatattaatgcaaaataataatagtctaaaatcatcatatcatcaatcagtactctgattattcattttccagctattaatagtaaagggatcttcaacatccctagaagaagactgctctagcaaatgcaatctaatacggaaaaatattgcgaggattcataatataagtagatatgcttcacaaaatagatgaatatactatactgtcatcagaccacatctttatcatgccaccatatattaattgtaatctgtcttacattgtatgaatttctgccttagttaaatttcaaaatgctatgctacttttgctattatgctactggtgaagaacgacccacgggtagccgagctcg

SEQ ID NO: 523784 - DNA, 558 bp, Homo sapiens
tagtttatacctacgaagtatcatcacttcccgctgacagctctgatataatcctggtatccctctatccactagtgccagtaatgccaccacccagttttgcatctcaatttctcgtcggcagaagtggatcctcagcaatgaagtgacattcccacgaagtgccgaaccaagtccggggttcacggaactttgtagtctcgtatcgtcacagataaatgtcaaatcatcggactatgtactcccctgcgctgatagaaagctcggcattaaaagtgaacagatgtcatcgtattagattgccattcccatcggttaatagatgactacataaccctcgtgcatctaacgactagatacgtctcaccatattctgcaattaacagcatgcaattacggcttccctatgagtcggtcatcattgttgtgaactttttcgctatgatcatacaatgcttcaacgtagcaatataggccccacatgtcattctcatcagtaactaggcctatatggaaggattccagttccggtcggctatggaacaattcctaataagg

SEQ ID NO: 523785 - DNA, 367 bp, Homo sapiens
  misc_feature (30)..(30): n is a, c, g, or t
  misc_feature (99)..(99): n is a, c, g, or t
  misc_feature (114)..(114): n is a, c, g, or t
  misc_feature (190)..(190): n is a, c, g, or t
  misc_feature (211)..(211): n is a, c, g, or t
  misc_feature (226)..(226): n is a, c, g, or t
  misc_feature (237)..(237): n is a, c, g, or t
  misc_feature (259)..(259): n is a, c, g, or t
  misc_feature (346)..(346): n is a, c, g, or t
tcttgcaagaggagcacctccttggtctancttgattcccacccgatcccctttcccttgagaatgtttctacacagctttccctgcctgtccttctgntagagggtctcgtgnaaaaggttcacacccccaatgctctggttaatgaaccccaccttgatcctctgcagccggttccccatggtacctncagattcatctacagccaggntcccctttccattgncaccaatgctntggccaatttctgagagctccntcttctgctcctgggtgaggctctggaactcggtggcccatggtcacaggtagtttgagagagaagagtcctcctagatctcaaaanctgtgtgtgagccctcgtgcc

SEQ ID NO: 523786 - DNA, 129 bp, Homo sapiens
ctttcacaggctatgggagaaagagaaagagaggaagagagacagagagagatcagttgatgtaatgaacagttcatggtgagcatgatttcatttcgtcccttggtcctataccccggtggaaaagta

SEQ ID NO: 523787 - DNA, 446 bp, Homo sapiens
tctagagtaccccgcgcggctgcggccgggagagggaccgcaagccgtgaaccagacctccgtgaccgcctcagcctggctttgcaggtgaagcctagctgagctgcaacccctacatggtttccctgcgtgccgggctcggatccctttccccgacatggtggcctggctctgcagcctggcccacctcgtctgcaccctttcccctttcatccgagccttggccccctgcgcagcgacaacgtctagcgctggcagctgggccagcccctgcggcctgacatgtcctatgctgagcggctggcagctgagaggcagcacgcaaaatgggtggccgccctggccccatgacccactggcccggctgcggatgctcgctgtgactccccatcagcaccagcactcccccattcactcgcacctgcacctgccccagccagatgctc

SEQ ID NO: 523788 - DNA, 923 bp, Homo sapiens
aagcctgtgggagcccgtggtctttaaagttgccgttcaggcttttcctccaggtgtgctttgtaatcacggactgtgctcaggtctcgcgggtgaccgaaaggatcatgaactagtgagctggaaagggtactagatggaaacttgagaaaggactgcttattgataacagctaaggtattcctggaagcagagtaaatacatagctcatggcccaccagctagaagagtattcttgccatggagaaacagagaatgtgataagttattcaacttatgaaatgcaatgtcacaatgtgaattctgttcagggcaataaccaaggaacctggtggatagtattcggcaacggtgatgacaaacccttactatgtagctgcgcctggatgtggccaggcgtatataccagcgaggaatcatttgtgctgtcccatacaagcatgaaaacatgatatgacactgaaatttggtccagccacgtaatgacaggtgtcgttgtggctgatcagatcccatcaccatgtagattcttgagaaactgtgtaagaagtggagttgtttatatcgagtggggctgagtccactttgatgagatgatgttcaggatgagcttctgaagatgtacattataacaatgcctctagcatttatcccctctggtcatgacctcatccatgagtaagcaattggtgaggagccttgctgtgtagaacactaactcacagtgataagtcctttatctccaccaagagtctactagcagtggatgagaaggaagtcccatggggcaaagtgcagcggccacatcaggtatggtcgccagcgtccatacaggtccaaggggcgctcaattctggtcagtgtattatcgaggaggcttccacttagtcgggataccaggcactcaaaggcatgtctgtcag

SEQ ID NO: 523789 - DNA, 607 bp, Homo sapiens
gatggcggtgtgcgccctgtattctgtccctcactcgccgacgaggagcgtgtctcgccgagcgcacgccttgccgcgccccgcagaaatgcttcggtgtacccagagtctttcgccagatgagaccggtgtccagggtactggctcctcactctcactcgggccttatgccaaagatgtaaaagttgggtgcagatgcccgagccttaatgctattcaaggtgtagaccttcctagccgagtgctgtggccgtgtacatagtggggccatgatgggaagaacagtgattattgagcagagtttggggaagtcccaaagtatacaaatagatggtgtgactgttgctaatagtcaagttgattaaacagataagataggagaacatgggagctaaacttgttcaagatgtggccaataacagaaatgaagaagctggggatgggactaccagtgctactgtactggcacggtctataggcaaggaaggcttcgagaagattagaaaaggtgctaatccagtggaaatcaggagaggtgtgatgttagctgtgatggtgtaattgtggacttagacaaggagtctaaacttgtgagcaacctgaagaa

SEQ ID NO: 523790 - DNA, 399 bp, Homo sapiens
tgatatataattcacatctgtgtagttcatccatttaaaatgtacaattcgctggtttttagtatattcacagcgttgtgcagctatcaccacaatcaactttgagtattttcatcaccccaaaaagaaactcccaaggaagaagccctataccctttagtagtcacttttcattttcctccaatttccccagcccgtggcaaccactaacctgctttctgtctctgtagatttgcccattctggacatctcatgtaaatggaatcatgcaatatgtggtctttggtgactgggttttttcacacagcacactgtttttgaaattcatcttcatgttataacatgtatcagcatttcattctttttattttaaataaaatgaggtaaaattcatataac

SEQ ID NO: 523791 - DNA, 197 bp, Homo sapiens
gagcgagactcagtctcaaaaaaaaaaaaaaaaaaacacaaaagggaaagggggagagagagagatagacatcgaggcgggggtatctgcctacagccagattggtcccacacttgcaagggttgtgtgatgaggccagagcgattgggcggtgttagggaaccggcgggttttaagccagtgatattgttggagaa

SEQ ID NO: 523792 - DNA, 389 bp, Homo sapiens
ccacatgccagtcgaccttactactagacaggcttaggcggaccatttactctaataaagtatgggcgatggagcattggaactctgagcgatatactgagtaccagctgggaaagatgagagagattcagcatgcataatatagcaaggactaacccatataccttctgcataatgaagtaactagatataacttggcaaggagagccaaagctaagactcccgaaaccagacgagctacctaagaacagctagaagagcacacccgtatatggagcaggatagtgcgaagattgataggtagaggcgaccctaccgagcctggtgatagctggatgttcaagatagaatcttagttcaactgtgaatttgcgcacagaccctctgtc

SEQ ID NO: 523793 - DNA, 1088 bp, Homo sapiens
gcgtgacgcgtgggcgtgacgcgtgggtcgacagcttcaggaggtgctggagggcttcaacatggccaatgtgctggcgttcctcagtgatgactgaggacgatggaggaggaggagtgaaggagaagatggaagaagaggaagcagaagaagaggaggagtgaagatgaggaagatggatggatgaagaggaggaggaggaggaagaagatgcctcagcagcgaggtgcagggagatgaagtcagccacgccctcacggaagattctggaccactaacactgggtgagccagctcccgatgcatgtcctccccacctcctgcagacgtctccaccttcctgggcttattccctcgtccagagaagctgctgcgcctagggcccaagagctccgatgctgatagcccagggagactgacacgtctgaacccgagaaggtggatcgtctgccttacctaaaggtgtcatctggtgttcaaggacgaagctactgtgagcgataggccgtgcaggatgcaggaggatgccctgatgcagaaggcgttcaactcctcgtccttcaaggccaagaactacctcaccgaggatggtcggtgcacatgaggtcatggtcaagaaggtgaagacgaggtcaaggccatttacgaagctgataacggcccctgatggagcagaacgaatggtgcagcaggactatatcccaaggccttgcacccctgctcgcggccgacgctgacgaagccaccagcggcctggaagctagaccctagacgccgacaactgtggagcaggcgaacacgcgagaaacaaagccctcccaacgtgggcatggacacagaaagggcaggacagaacaagcgaggaacgaaggaacgatggaaaggtatggcaaggagtgataatagtaaagataaggaagccagaagaaatagagagtgcataaaaaagaagtaaagaaaggaacaaagtaaaagaagtaagataggataagagaaagaaaacataaaaaagagaagacagagagagagcagagaaagtaggagaaagaaaaataataagacatgctcaaagagtggagggaagaaaga

SEQ ID NO: 523794 - DNA, 455 bp, Homo sapiens
agagcggcctcattgtgcctgattctgacacattccatcaaatcatctccagaacatagtccaatccacatcccaaggtggaacgggaatacgggattcagaagccccagccaacaataaaatcctatttttggaactcctgcctctgtccttatctgtcacctacacgggtatcagttctgtccccgccaccccaaattcaagccccatttctgacggttcactactcatctctacctggacatcccacagacgcttcaaacccagctcgtcccaagtcaccttctctcccatcgtcgccaagttctctcatgccctccccactagctagcagggctgcccttcttccgggcccaggtgacacctcagctcctccacagaaggctgcccagggcgccgcattgcttggcacccctcccctcactttcctcctgagcattctccatggcccaccc

SEQ ID NO: 523795 - DNA, 110 bp, Homo sapiens
tatgacgttctttctttcttttgtgagacagtctcactcggttgtatgtagcagtgacaatctccactcactacagtcttcacctcctgggttcaacgtgattctcctgt

SEQ ID NO: 523796 - DNA, 348 bp, Homo sapiens
cctcaatttacactgactttttatacgttcgtcgggccgcggcgcctacatatcaatgaaactacttacaacatttaattcctttcataatattaaacaattcatacaaccctatttatctcgtaaacctggtctgcagaaattcaaacttacaaaaactgttgtcacaaatgttatctacatatattcatatgtaactgcattacttgccattttcaatcacagtggtcatcgtgtcaatatatttaacactgtgttaaattaatttacgttgctattttattttaatcataaacaactaccatgtttcttaatgttttgtgtaaatttaaggtaattatactatcc

SEQ ID NO: 523797 - DNA, 173 bp, Homo sapiens
tgtgtcggcatgactatttggactgggcgtctcttggagcaacgtcgaagtatggggtgtgtcctctctcagagtctcgtttcagcgtatcttttcagcaccctgtgaatgactccctggtgtgtgtggtaatggatgtgcaggactcaacacatgtgacgctgtacaactct

SEQ ID NO: 523798 - DNA, 1284 bp, Homo sapiens
tgaccctacatcgacgacatatcgggtacttccgcacataccgtctgagtctccctgggagagacctacgtgcttgctgctaggcatgcttggccagccggcatccgatacagctccgtactatggatgtgacaatgctgtccttgagcatcactgctcgtgacatgcaaaccgattctacaaggcctcctagttatcgtgtcgctccaccatcctggactgttgctctctctccatcactcgccaccatgctactctgggtgccacatatctgtgttgtgacttcccgactgtggtagcccatgatcgtgtcatggtagattggcgcccacccgataccgctcgggtgtgcctcggcgcgatgatgccattgaccacttccattcccttggcagtgctagagcggcgttagcttgttaatacatgtttcatgtttgtggtatcactgcttcggggtagtggagtctctactaggtcccttggtcccgcctcttccacgccctccaatcctgccaactcatcatgatacacttggttcgagacactagtatctagattaggacatgtcagcgcaattttgctcccgttctccttttgcggcgtgtaacattgctcacgatgtccatagacatagccactgttgtagcatatttccagagaagccgggagagaaaacgaaaacacatgtccgcaggtggccaccccataacgtattttgcagtgcgtgcgagctgtgtggaactgcaagttgcgagcggcacagtgcacaggcagtgcgcgccaccatcgtgcgttgcgcgtttgaaccccgttgtctttctccctgtgaaagccaccgagccctttttctccgtctggtgtggccgccaggatgtggcgtccaagacaatgcgtgccccacgcttcctcgttaccccctatttatttcacttgcgtgggttcccgggtattttcaattgttttcccggacaacattagtgcccgcacaagaggttccccacccctcttcggcggttttctaatgatcctctgcgggcggggagaaaaacgttccctcgcaccgacagccacagcttccgggttggggacacacacaattttggaattttcccccatggttctctattttggaacaccacgcggggtaacggttatacgcgcgcgattaacccgaagaaacagggcccttggcaacttggtgtccaacaaccacggaccattcggaagtgtgcacttgaacacgcactggtcgggggcattcgacaaaccacgacagcaactgtc

SEQ ID NO: 523799 - DNA, 405 bp, Homo sapiens
aggactgttcaactggcccgtggctctgatcgactccttcccagatctcctcggcttagcagctgaagactgacactgcctgatcgcctcggaagccccttggaccatcacggacgctgagcttcgggtaactctcacagtgaagggtaagtccatccccttcttaatcaatacggaggctactcactccacattaccttattttcaagggcctgtttcccttgcctccataactgttgtgagtattgacggccaggcttctaaacctcttaaaactccccaactctggtgccaacttggacaatattcttttatatactcctttttagttatccccatctgcccgactcccttattaggttgagacattttaactaaattatctgctcctctcactattcctgg

SEQ ID NO: 523800 - DNA, 234 bp, Homo sapiens
ctaccgaagagggagtcctcgcggacgtcagccaagattccagagtgactactatacttgacttacccctattaaaaatcttcccactgcatcaaaatgggccctcagcattttccataagacctcatgcagctgttcctcccatgctacgagactgccccagactgtccagtaccaaaagcgaatggcaggagcagattttgagctttcagattactatttccacaagccacc

SEQ ID NO: 523801 - DNA, 1165 bp, Homo sapiens
gggccccatatttgatctgtcaagaaactgttggctgggaactcctgaggtcaggagttcgagaccagcctggccaacatagggaaaccccatctctaccaaaaaaaaaaaaaaaaaaaaaaaaaaaaaatgtgtgtggcgccggcccgcgggcccctgagaaagcctttcataaaaccaactgtgtgtgggggcgcggggggccccaggaggggaaaagggcgaaccagagggtccacaagagccggttccccagaaggaaaaactcgcggcgacgaagagcacaaagagcgcgtgggaactgcctccaccaaattaaaaaaagccccgggggggaaacccgacagtgttcctggaaacaaacccccaacgaggagaactctccgacggagagcacaacacagggggaactcaatagaccacaagagggagattctccaaaagcgagaagcctcaggcaataacaacaaagatgtaaagcgccgccgcggtgcgggtggggaaaaagaaagagcgaagtagcgaagcacaaaaaacacaaacagaagaagggaagcagagaaagaaacagaagaacaggacagatgaggaagatacgacagagagacggacgaaagaacaagacaggaagacgaccgacagcacagacgagtataaacgaagacaacgaacgcggagaggggaggcaaaaggagaagacagaacgagaagaaaggagaggagaagacgaggacaggagaagagagggaggagaagaaaaagagggggcagggacgagaagagagaggagagaggaagaagggacggagtgagggaagaaagagaagagaggagaaaggagaagacgagagggcagagaaagagaggagaggaaggagggaggagaagacgcagcaggcacgagaaggagaggaggaggacgagggacggacgcggcgggaggaaggaggacggtgagcgagcgggaggaggagaaggcgagagaggcaggagggagaagagagggagcgggaagaaagcaagaaagatacgacagagagcagcggagcgagagaggaagaagagacgacgaagacggagcgagaggaggggagggaagaagacggaggaggagggcgacgaaggaggacgaacgagcagcagagacagaaagagagggaggatc

SEQ ID NO: 523802 - DNA, 701 bp, Homo sapiens
ttatactagcatttaccatctcacttctaggaatactagtatatcgctcacaacctcatatcctccctactatgcctagaaaggaataatactatcgctgttcattatagctactctcataaccctcaaacccactccctcttagccaaatatttgtgcctattggccatactagtctttgtgccgcctgcgaagacagcggttgggcctagcccctaactagttctcaattctcccaaacacattattggcctagaattaacgtacattaacccttaaaaccttacctcccaaatggcctaaacacctaaatcgttccccaacacattatttatttacttacccaccttgacaatgcactttcccaaaaaaaccacattattttgactcaacacaaaacacccacaagcctaatttattaagcatccatcccttcctgctatcttcttcaacccaaatcaaccaacccaacctatttaagcttgtccccaaacctttttcctccgacccccttaacacccccctcctaattatagccaccttgatccttaccctcaaaattcatggcaagccacgcgccacttattcagtgaccactatcacgagaaaaactcctacctctctatacaatctcctacaaatctcctaatatacttcacagcacagactatcatatcatatctccgaaaccaattatccca

SEQ ID NO: 523803 - DNA, 100 bp, Homo sapiens
taccccttttttgccagcagacagacttgagtctgtaagagacaagcatacactgacagaagtttaccatagtttctaaaatgtaaaaaaagaaaacccc

SEQ ID NO: 523804 - DNA, 549 bp, Homo sapiens
  misc_feature (24)..(24): n is a, c, g, or t
  misc_feature (256)..(256): n is a, c, g, or t
actatctccaggacagacaacatnttaggtcacaaaacaagtgttaccaaattcccaaagcttggaatcaggccaagcatatttttcaattacaatggaatggaatttaaaatccacagcagaggaaaactgaaaattccccaataagtagaaattaacacatttttcccttaacagtgggtcaaagaggaggccataggagaaattaaaaaaaaaaaaacttgaggccaatggaaataaaaaccggcccttcatncccaacttatgatatagtgaaagtagggctaacaagggaggttatagctgtgaacaaatatatttcaaaaaggaaggtctccaaggccccaacctaactttatacctcaaaggacaaataaaaacaagaaaaaccttaacccaaagctagggaaaggtaggggtaataaaatttagagcccccataaataaaatagaggattccaaaaccttcccaaaatatcaatggaactaagagtttttttttttaaagattggcaaaattgaaaaacccttaggtagatttacttcgga

SEQ ID NO: 523805 - DNA, 125 bp, Homo sapiens
ctgaaaattactcatgggagcactgcgtgacttcatgatataatttaaattttagaggttgtggcgttttgtgtgtgtgtgtgagacagggtctcaccatgttgcctaggctggacttgaactcc

SEQ ID NO: 523806 - DNA, 481 bp, Homo sapiens
gtcagtcctaataactaattcatgggatccagatgaaaaatccccatctggaatttttaaccaccttgagggtcagagatttttttgagaatcagaggaaagcaatgaacctcaggcctggcaggtgaggggaccaggagaagacaggaagtacatgtgtgcaaacagacaaaagtttgcacacaagtagttcattcccaagcttcagaaccctagcgctgcttgattcccttcagttgcagatattggtggctggaatcaagggccaggccccagaaaagtttcacagaagggacatacatagggccaaattggaccctccgattcacaccgggtatctctgagatgtgtgtcaagattcctagcgtgatttaccaaaggcttgatgatctcacttcatctttattctgcaaactcatgccctagcattcttcccaatagcaactatcactatccctaaataaatgtttaatacttgaaa

SEQ ID NO: 523807 - DNA, 288 bp, Homo sapiens
tctctagcagtcgttttgaatttgctcgctactgtctcaggccagtgctgaaccataattagttttttccactcatggttgtcacgcaggcgcttgtccgcaccgcccatgtgcaaatgcaactgccaggcagatggcatgcccatgcagggccctgtgcagggctgcaatgggctgcatggtgcctgacctgctggagagaactgctgccagttgccgctccggctcccacttcccacctgctgcccgatgaatacttccgggagaaacgcttgtctctgagccccc

SEQ ID NO: 523808 - DNA, 538 bp, Homo sapiens
gaaaatcttgatgcatagggtgtacggttatagaggacatgactgcttctcgtggaagagtgctgtatacgaggtaggtggtaattaaagtgaaccagtgttactcagaagtgtgagttatctcacattaaggtttcgcgtcaaatggtaagtgaaataattatgagtaaacagagtggaatggaatggagtgggatggaatgaaatagaatggaaaacaaaatactggagtgtaccacatgtcgtcagattaggctattagttgggtaaaacgtgtgccatggtaggagggcagaatgatgtcacattcgacactttagaaaaatgtaaatgctatgttcatattacttcgaatacttcactgcattacaatgcttcagaatcgtttcacttgtgattagagtaagtctcagagtccataattgatagagttaagacagattaacaaacagggtggagcattcactacaatagcaacactcttcctccctgaggctcggaaagccagcagtgacaccaacagcttgcgagaggtaaa

SEQ ID NO: 523809 - DNA, 550 bp, Homo sapiens
gtaatatgatatttggagtagagtaattcagtaatttttgtatttttagtcttgaactcctgagctcaggtgatccacctgccttggctcccaaagtgctgtgattacagacgtgagccatacgtgcctggcgctttgcccactttttgatggggttaattggttttttctggtaaatttgtttaagttccttgtcgtttctggatctacaagaatatacaagattctggatctgacctttgtcagatgggtagattgcaaaaattttctctcgttctgtaggctgcctgttcacttggatgctagtttcttttgctatgcagaagctctttagtttaattagatcccatttgtcaattttggcttttgttgcaattgcttttggtgttctagtcatgaagactttgcccatgcctatgtcctgaatggtcattgcgtaggtattcttctaggattttaatggttttggattttcacatttaagtctttaatccatcttgagttacatttttataaggtgttagggcaggggtccagttcaggttctgta

SEQ ID NO: 523810 - DNA, 157 bp, Homo sapiens
  misc_feature (149)..(149): n is a, c, g, or t
ggtgactctaaggatccgggtatagagatagagatatgctgtatgtggaggctgataagacttaagagtggcattattcgtagctagcagaagcagttgcagtttagactacgcagcattgtagagtggacgggtagggtacatacttntggtgtgg

SEQ ID NO: 523811 - DNA, 213 bp, Homo sapiens
caaatgataacaaagacctttggactcgatgatcatggcggctccttgggccttaatgttattgcagtacgggcatatgcgcttcccactgactgacctgttacgcagctgagagcctgactgtgaagctgaaggggaaaggcttctcggggtgggggactgggtggaggccacacctgtggtggagggctttacggagccagctgaacgtgg

SEQ ID NO: 523812 - DNA, 865 bp, Homo sapiens
cggtcggtgttgtaccctctttgtctctttttattgtaccggcgttttatcaccggcggttttcctgtgggttgacgcttgaatagcgctcaccgtccgtagggttggttttacgcaccgcttcccccgcgggggtcgcccagcttggtctgatgaatgttccgcgcggcattgttgtggcccccctctgtggggtggtttaatgaacccctttctgatccagtgggcccgccctttggggaccaaccaccgctccggtttactcggccgctcctggtcttttctttacgcgcacatggatggcgtcgccagctggtccgctttaccggcgctgttttcttcactcgctcgtccgcctcccgtcgttccacgtctgcctgatgattttgttccgcaccgcggttcactcgcgctgcttgagaacttggtcgatccccccgccgctatgttttcgcacctccccgcctccctccgctctccgcgtttaggtaggcgcacttccgcgctccctttaaccgcgttggtgtgtattctccacccagagtgggcgccctcttactgttcatggattctctcccgcccgtcacaccttgttggcgccacttcgacgcgcccaccctaagatgccccctaccccccctttagacctccactctctcttcacaccggccctgctatgaatcccacccacgcatttcgacgacgatttgtccacaattgtcttaccaacctaagaagatgatgagacgaccttgtgtataaccaaaccagatcgccccctcaccttccttccccaccatcaagtttgccccgtcccccatgtcagacgtgcctttccttccccttttttaaatttctcccacat

SEQ ID NO: 523813 - DNA, 142 bp, Homo sapiens
gagggcctatttggatcagactgggggagaaagcgaagaagctgcctggagatgaataggtttattcagctgaggacagagctcaggaagagacacacattgaggagtacaagggggagaaaaagctactagtcagagatgt

SEQ ID NO: 523814 - DNA, 139 bp, Homo sapiens
tccggtactcggggctaccgcgaaccggtcccgtattgccggcgcaaatcttccgggcaagtccgaaatcgggggtcttcctgggtaatgctgcgcggcgcctcaggtgacgtgggcggaatggaataccttgcggccg

SEQ ID NO: 523815 - DNA, 706 bp, Homo sapiens
  misc_feature (28)..(28): n is a, c, g, or t
  misc_feature (119)..(119): n is a, c, g, or t
  misc_feature (218)..(218): n is a, c, g, or t
  misc_feature (282)..(283): n is a, c, g, or t
  misc_feature (328)..(329): n is a, c, g, or t
  misc_feature (333)..(333): n is a, c, g, or t
  misc_feature (358)..(358): n is a, c, g, or t
  misc_feature (362)..(362): n is a, c, g, or t
  misc_feature (365)..(365): n is a, c, g, or t
  misc_feature (374)..(374): n is a, c, g, or t
  misc_feature (393)..(393): n is a, c, g, or t
  misc_feature (461)..(464): n is a, c, g, or t
  misc_feature (501)..(501): n is a, c, g, or t
  misc_feature (503)..(503): n is a, c, g, or t
  misc_feature (506)..(506): n is a, c, g, or t
  misc_feature (517)..(522): n is a, c, g, or t
  misc_feature (524)..(525): n is a, c, g, or t
  misc_feature (529)..(529): n is a, c, g, or t
  misc_feature (533)..(533): n is a, c, g, or t
  misc_feature (536)..(536): n is a, c, g, or t
  misc_feature (538)..(538): n is a, c, g, or t
  misc_feature (541)..(541): n is a, c, g, or t
  misc_feature (555)..(556): n is a, c, g, or t
  misc_feature (558)..(558): n is a, c, g, or t
  misc_feature (565)..(565): n is a, c, g, or t
  misc_feature (596)..(596): n is a, c, g, or t
  misc_feature (694)..(694): n is a, c, g, or t
aactgtatgatataaaataatttaaganatgttgggaattagcagcaccatctgttattgaaatagcaagggaaacttcacatattttaagcaaacacgggaagggggtaactactttnagacctaataatgccattggtctgggatgaaaaagaagggaattgttttagattgttttaggcaaacacacttccttctatgctggggatttagtgggngtgatctgatgactaaggttttagaaaaatgctactgatgtcagagatactgcctagtattttnnttggggcaagactaactgtggcctggctccccccttctatggcanntttngttctggcttatggcatcaggaatnacanatnatgtttaanaggcacttggctctggggnacattaggtggacccaggtccctatggccctccctcccttttcccgtctgcttaatcctttgctttgnnnngttgcgcggttttcccggccggtggcttatcccgctntnttngtgggtgtttnnnnnngnntggntgtnttncnggnatcgcctgggttcnntnggtttcnttcggcctttggccctgttggcgcccttgcngtgtatcagagactctgaatactgtgtattcagagactgaatttgtgtgggtacaaatttacacaaattttacagcaacttataccctaacatctacnaaatccacattt

SEQ ID NO: 523816 - DNA, 244 bp, Homo sapiens
  misc_feature (239)..(239): n is a, c, g, or t
gggcagatttcttggccaaaaatattggccagccaggatccactgcccattatgagaaattcctagcttgccagcaatgggatctctttccaggggacgtaagtctcatcttaccaggacagaaccacttcattaatagtggttttccagtctgatggggcaattttcttcaggttcatggaaacgtaaagatcttcaaacatcttgtggagaacgatctcttcaaggaaattacaggnttgag

SEQ ID NO: 523817 - DNA, 152 bp, Homo sapiens
taaccagctgcattgagtacacacaccggactggtactatattgtatttttttagtagaaatgggatttcaccatgtgggttagactggtctcaaagtcctgagctcaagtcatccgcccacctctgactctttcttgggattgcatggtat

SEQ ID NO: 523818 - DNA, 122 bp, Homo sapiens
ccccggcccccccaaatgggcccggtttttgtttttttttaaagtccccccgattttttcccccctttttttttcccggggggggggggggcccccattaattccctttttgggtttttcca

SEQ ID NO: 523819 - DNA, 312 bp, Homo sapiens
acttcgcattgtccaagctctcgatctgtgtgcccaacgtggccgcgtagaatgggtagaagtagacactgagaagaagtcgggcgttttcaagaacgttcctgctcgcagtgatctgtccgccgacatcaacgaaagcctgattgtcgagctctactccaagtaagggctagaaaataggtgcatccatgcagatttcggtaaatgagttcctgacaccccgtcacattgatgtgcaggttgtcagtccaacacgcgccaagatcatctcgagcatctcgagcgtgtttggccacacctggaacgggccga

SEQ ID NO: 523820 - DNA, 326 bp, Homo sapiens
gggtacaagtggtttttgattacgtggatgaattgtatggtgatgaagtctgggctcttattgtttctatcagcccaatgcccgtcttaaaagtcgggcgttttcaagaacgttcctgctcgcagtgatctgtccgccgacatcaacgaaagcctgattgtcgagctctactccaagtaagggctagaaaataggtgcatccatgcagatttcggtaaatgagttcctgacaccccgtcacattgatgtgcaggttgtcagtccaacacgcgccaagatcatctcgagcatctcgagcgtgtttggccacacctggaacgggccga

SEQ ID NO: 523821 - DNA, 87 bp, Homo sapiens
aagcttcgactgtagatagaatagcctcacttggtgcttattaccagttattcaagaacaataacaacaacaaaattagtagacatc

SEQ ID NO: 523822 - DNA, 191 bp, Homo sapiens
aaggagctgatgagctgtcgcacctgagccaggaaggaactgttaaatcctgtgaccccagttactaatggaaatgggggcatcaaatggggcttaatccggctactaattttctcatcgtcacttcgttattatcttactaaaaaatgtagtcactattcattgcagaaacttagaaagcacagttaagg

SEQ ID NO: 523823 - DNA, 1046 bp, Homo sapiens
  misc_feature (51)..(51): n is a, c, g, or t
  misc_feature (75)..(75): n is a, c, g, or t
  misc_feature (177)..(177): n is a, c, g, or t
  misc_feature (301)..(301): n is a, c, g, or t
  misc_feature (334)..(334): n is a, c, g, or t
  misc_feature (390)..(390): n is a, c, g, or t
  misc_feature (456)..(456): n is a, c, g, or t
  misc_feature (480)..(480): n is a, c, g, or t
  misc_feature (530)..(530): n is a, c, g, or t
  misc_feature (567)..(567): n is a, c, g, or t
  misc_feature (602)..(602): n is a, c, g, or t
  misc_feature (631)..(631): n is a, c, g, or t
  misc_feature (634)..(634): n is a, c, g, or t
  misc_feature (666)..(666): n is a, c, g, or t
  misc_feature (686)..(686): n is a, c, g, or t
gcggagggtcaggtcgtttctgcgcgggctcccggcgctgctactgctgcngctcttcctcgggccctggcccgntgcgagccacggcggcaagtactcgcgggagaagaaccagccctagccgtccccgaaacgcgagtccggagaggagttccgcatggagaagttgaaccagcngtgggagaaggcccagcgactgcgtcttcctcccgtgaggctggccgagctccacgctgatctgaagatacaggagagggacgaactcgcctggaagaaactaaagcttgacggcttggacgangatggggagaaggaagcgagactcatacgcganctcaatgtcatcttggccaagtatggtctggacggaaagaaggacgctcggcaggngaccagcaactccctcagtggcacccaggaagacgggctggatgaccccaggctggaaaagctgtngcacaaggcgaagacctctggganattctcccgcgaagaactggacaagctctggcgggagttcctgcatcacnaagagaaagttcacgagtacaacgtcctgctggagancctgagcaggaccgaagaaatccacgagaacgtcnttagcccctcggacctgagcgacatcaanggnagcgtcctgcacagcaggcacacggagctganggagaagctgcgcacatcanccagggcctggaccgcctgcgcagggtcaggcaccagggctacagcactgacgctgagctccgaggagccccaggctgattgacctgtgggaccctggacgcaactccagcaactcaccggacaaagagctggcaccgctcccgggaaggaagctccaaggcacttcgaaggcccagattcgacgacagcccaagcactaccagacagcagctgcagaattgcgcaccgagcaagctggcgggccgccacagcacgtgtgccgacggccaaccgtgtgaacccgcatcgcgagaaagccccctgtctggaggggccgacccaggagctgggtacacggtgagaagcatctgcggcctggc

SEQ ID NO: 523824 - DNA, 177 bp, Homo sapiens
agctgggaacgtgtggatataccggtctctgaaaaatttagaaaggtgggtcgggcatggtggcttgtcctgtggtctcggctgctgggggaggctgaggtgggaggatcgcttgagcctgggaatctgaggcaacagtgggctataattgtgccactgcattctagcctgggtgac

SEQ ID NO: 523825 - DNA, 409 bp, Homo sapiens
  misc_feature (9)..(9): n is a, c, g, or t
ggtacccgnatgcgatgtgcgcgggacaacacagaggttcaggatcatgctggaaggacaggcggattgctggagatccttttgtctggagtagcagagctgctggctatccagcccctattatcaccagccgctcaatccagatgggtgtctcaaagtgtccttcagggtctgcggagctggagacaagggtgttgccagcacaatgtagaatcgcacgcagccaggagctcttgcgcgggtctgatagttgaacgtgtgcccatcatccacgaccgagctctccttgagctgtagcctgagggctacgtgcgtcagagagagtgatggggtcatccttcatacgttctgacgagcgccgggctcggatgcatcgaggcgcgattgtccctccatgctggcacgccgg

SEQ ID NO: 523826 - DNA, 406 bp, Homo sapiens
gctcgacccagcactttgggaggctgaggtggggccactccggatcacaaggtcaggagttcaagaccagcatgaccaacatggtgaaagcccgtctctactaaagaatacaaaaaaaatgagctgggcgtgggggtgcacatctgtaatcccagctacttgggaggctgaggcaggagaatcacttgaacctggaagtcagaggttgcagtgagccaagattgcatcactgcactccagcctgggtgacagagcgagacaccatcgcaaaaaaaaaaaaaaaaaaaaaaaaaattggctaaacagcccaggtttggtctgatatgttcagaaaaaagcaaaacagtcacctctcaccttttcttttcccgcagtgatgcagttgcatacaacaatggcgtcgacg

SEQ ID NO: 523827 - DNA, 338 bp, Homo sapiens
  misc_feature (67)..(67): n is a, c, g, or t
  misc_feature (134)..(134): n is a, c, g, or t
  misc_feature (141)..(141): n is a, c, g, or t
  misc_feature (191)..(191): n is a, c, g, or t
  misc_feature (216)..(216): n is a, c, g, or t
  misc_feature (234)..(234): n is a, c, g, or t
  misc_feature (254)..(254): n is a, c, g, or t
  misc_feature (326)..(326): n is a, c, g, or t
ggaacactgagcagatagatacctttggccccttccagcttttactgacagagagttccaggctagncaccataaaaaccaccccttggtctccctcccttgttctgagggggtgaggctggaaatagattgtncagacangcaagggttgggtggtggttcccacacgaagtcatctcttaaacatcatnagcaatagcagttcccttccaaggnctcccctcactcccgaancacttacgtcccatgcaggnccaatgcaaaaaaacacatttggagcttttttcccgcaggggcatgaagtccccttaagttcccatatctangatgggcaggct

SEQ ID NO: 523828 - DNA, 569 bp, Homo sapiens
tgtttgcagctgctgaggtcttgtgagtgtcttactgcaagcactccaaagtccactttagaacgcgaacacgcaagtgtcagaagtcaaagctctaactcatgattccattttctttcactttcctcagactttctctcctcacttctctgagcgaactcaagagcacacagctgctaggatttctttctcacggaagagttcacaggtctttccctccccgcttgggcttgttaaccaatattcatgataaagaaagcatcataaacttctggtgtaaagatgccggtgggaaaccacgcacctatatagtctctttgccaaaccccactcccatgaccgaccatacctagcatatacaaaagtcatcaactagttgggcgcagtggctcatgccctgtactcccacccagcccgtatgggacgctgagatgggctggatcacctgaggtcaggacgtcatgagcagcctggccaacatgacaacaccctgtctctactaaaaatacaaacatcaggcaggcgtggtggagcgcactgtaatccagctctcatgggtacgagctcaa

SEQ ID NO: 523829 - DNA, 319 bp, Homo sapiens
tggaaagtcagctgaaggatggttaaacagcacagcgaaaactgctaaatgcactgaccccccccattaaaatgtgattttggtcccttttaatttctctgtgggctttggtttcggttttggtttgggtagatcttcaattgggatattgggaggagtgaacatcgtggtttggctggagggaagatctggagggtgttctatccccaaaaatggactcagatataaacattgggggcttataagagagagttaacaaaaaacataggatggcttcacttaaaatttacaaaacaaaacaacacacaacaacaaacgg

SEQ ID NO: 523830 - DNA, 667 bp, Homo sapiens
  misc_feature (166)..(166): n is a, c, g, or t
gggggtttaccagcaggtagggcccaacctttccccccccttggggggccaggagggggcacaggtttccccgaggttttaaagtggcccttcaaatatggttcttattccggccgatggggccagggcggggatggggatttcttcaattttaaaaagaaggggnggcgtttttctcccccccccttcccatttttgaagcaaagaaggagggcggggtgcccaccttttgggcccctggtcccccttcctcccctttggaaggggtctttgggccgtttacccccatttaaggggtcttccccaaggggcccccccctggggaaaaaaccccctttttttttttaataccccagggggtgggccgggggcccccccctttggggttccccccggggggggttcccccgttttgggggcagttttattaaagggccgggggatttatttggtctttggccaaaaatatgggggcccccttttaaatatggggagggggggcccgggggtttgggtttttgttaaaaaaataaaaaaaatcccccaagggggggggggggggggggtttttttttttccccaaaccttgggaaatcccctttggggttccaaattttgggcccccttttccccttaaaagggccccttaaaaaattttaacccggga

SEQ ID NO: 523831 - DNA, 593 bp, Homo sapiens
cctaacaacctcctccagctacttcctactctacctctgcctcctccatctccggcttgggggggatcagtgtcctctctcggcagcagaatgagccggcaggtggtccgctccagcaagttccgacacgtgtgtggacagccggacaaggccgaacagtgctatgaatatgtgcgcgtctcacagaacatgtgggacaggggttctgtgctgtcaaccctaagtgtgtggccctgatctgagaggccagcggggagaggggccttcctggtgctgcccctgggcaagagtggacgtgtggacaaaaatgcgcacacggtctgtggacacagcagcctgctgtgctagatatcgtgctggtgcgcgcacagtgacaatcgtttattgccagtggctccgaagagtgcacagtcatggtgtgggagatcccggatgggggcctgatgctgcccctgggggagcccgtcgtccaccctggagggccaccaccaagcgtgtgggccattgtggtctggcacaacagagcccagaaatgtggctgctcagtgcgtgttgtgaccatcgtgctcgtggtgtggggacgtgggcacgtg

SEQ ID NO: 523832 - DNA, 856 bp, Homo sapiens
gaatgtaccccacgcgggttttgctcgctgggctgggacatgacccagccgtgaattgctgggcagcagtcgaagtgtggaaaaacaatagtaaaggatcatccggttggttaaatgaggcgatatgtggtgcccaactcacgttgtgcagttgcgtgcccaccgcgcggagacacgactcacgcatgctcttgtatttaatgcgcagtcggcgaccatgtctgtcatacaagcagccgagtccaatgttgctgaggtccccgcaagatacatcactaaggggtccaaccttgcgtaagactctcttgtagagagccaccatgctattctacgatgttaatgcctatactggctttgtagaaggcacagagacgcgcacctctgttgttgtcggagattccacaatgcgagaccaccgcgtcgtgggtgacggccactcaacaaaattcaaagcgagccggccgtctcttcccccacccccattaatgattcttggtggacaatagggccggccgcactgcttagataacagcagcactgttagtagtgaccctcctcccgccctatagtaatgcaccacaacagttggggagcaacatttctgcgcgctggcgtcgtcactggaggatccctcccgggaaatgttccgccctgactcgctattgtttgggaccacagacactgtagtgaaggtagcacttgtttaccacgtgaggagacatcaaatactggatatgagtgttctccagctctgtgtccacattggtatgggatcatcattgttactgatggcaaagagctcccgttaatagctagttcgcaaataaagaaatatactcgcccaatcataacaaag

SEQ ID NO: 523833 - DNA, 379 bp, Homo sapiens
cacgacatagaggcaggctctccatgttggtcaggctaatctcgaacgtccaacgtcaggaatgtccggtgattcgcctgcatcagactccataaatgctaggattacaggcatcagccactgcatctggcctcttttttttttttttaaaaatggagtctcactccgttgcccaggcggaaatgcaggggtgctatctcagctcatggaaagtttcacctcacagtttcaatcaattctcccgcctcagcgtcccaagcagtggggaccacgggcgcacaccaccaggcggggccaatttttgggtatttccagtagagatactgttttcaccacatcggccaggttgggacttgaactccggatctccggatccact

SEQ ID NO: 523834 - DNA, 111 bp, Homo sapiens
  misc_feature (7)..(7): n is a, c, g, or t
atcgctntctaatctatcagcaacagaatcagtcaatattttcggccaccgtatgtcatcaaaaagatatcatttaattttcccatctggccattgtggatgtaaatctta

SEQ ID NO: 523835 - DNA, 158 bp, Homo sapiens
  misc_feature (82)..(82): n is a, c, g, or t
aatctaccaccagtcagaatgggtctccggtatatgaagagccaccctttcctgcccactcgcaggagggcacggaagagcnacttccaggactgtcatcttccccagaccagtccgagagctcctccggggagaaccatggggtgtttggagagcgg

SEQ ID NO: 523836 - DNA, 245 bp, Homo sapiens
attcactgcctccgggcagcactgtgtggtattaggcatatcagtatccattgggtactggatacgtgcttagtagcactgcggtgagtaataatcaggtcctgtgttctctgagggttgacacatcaggtctattgatcttgaccttgaactctcctagccatgcctgcctgaagcccaaccgtggagcccaggctgaggctgaaacctgaagaactgtcttaaagtgagtctctccttagggc

SEQ ID NO: 523837 - DNA, 441 bp, Homo sapiens
ctcgcccgttgctactgtgtggatcttatgaccgccctgaagctatccctgggctcttatgaatttcttgtgcccttgtagattactgcaagaacaactaagttccccagtcccttcctgcctttatcttcattattgagcgtctcctaccattgccatcaggactggtcttgttaggctcctctgttaggagctcaagtcactgttagactttctaccttgggagggtggcgcagaagagtcacgcaagtccgcgttggttttgtcacctacaataatggtgctccatttctatcatgtgaagagctcattggcccagccacagatgatggttgtgtctgatgtggctgacatgtttgtgcctctgctggatggcttcctggtcaacgtcaatgagtctcgggcgttttcaccagcttattggatcagattccagaaatg

SEQ ID NO: 523838 - DNA, 339 bp, Homo sapiens
  misc_feature (245)..(245): n is a, c, g, or t
  misc_feature (248)..(248): n is a, c, g, or t
attcgcggccgcgtcgacgggaaagtccctactgaagatagctttgcttaaatgagctcaattacaatgtgaatgctgaggtttattgtgttggctgtatggtcatgagaaaatggtcatttccttgattacctgatacggtttggctgtgtccccacccaagtcttattttgaattgtaatccccataattcccacatgttgaaggagggacttggtggtaggtgactggatcatgggggtggnttnctccttgactctcttatgaatgctttgtttcaccaaaggctaccgggaaataacggggatcagaatattgcagtggttacattcctgcagg

SEQ ID NO: 523839 - DNA, 233 bp, Homo sapiens
agcctgtctcgctcttggccggagcttcttggccaggtgcactgctgtccgacggatgccttctgcgagctggtcacagccgctgcatcacagccaggggcacccaccccctggcaaagaagctccctgcgcagaggactaccagggcagtggccttgtccagctcggtcatgtgttcggaggcacggtcccggtgcggttatggttctagctgctgtgagctgcgcagtggg

SEQ ID NO: 523840 - DNA, 568 bp, Homo sapiens
tggtccgacttcttgacgaggctgcggtgtctgcggctattctccgagcttcgcaatgccgcctaaggacgacaagaaaaaaaaggacgctggaaagttcggccaagaaaagacaaagacccaggtgaacaaatctccgggggcagggccaaaaagaagaagtgtggctccaagaggcaaagttcgggacaagcctcaataacttagctctgtgtttgtgacacaagctaccctagtgataacactcgtgtaaggaagttcccaacttattaaacttataaccccaagctgtggtggctctcgtgagaagacgtgaaaattcgaaggcctccctgtggccagggcagccctttcgaggagcctccttagttaaagggacttactcaaacgtggtttccaaagccacaagagcttcaaagttaatttgtcacaccagaaaatttcaccacgagggggggcagattgcctccaggcgtgcgtgggtgaaagattgctgtgacaataggctccaaaccagcttgtccctttgggacaaaattaaaactttttatttaaattcaaacaaaaa

SEQ ID NO: 523841 - DNA, 1806 bp, Homo sapiens
  misc_feature (342)..(342): n is a, c, g, or t
  misc_feature (1650)..(1650): n is a, c, g, or t
ctcttctgataccacgagtccatctagggtacacaaagtctaggctgtctgcgccaccaagagtttatgtgacgtctgatacatctttagggacgtccagcgcgtggcatccatgtaccattcaatacgatgctgtgaaatcatgaccatggcagcgacagcctctcagactggtcgctatgaagcgttacaccgtaactcagcaatggtgctaaccgacatagggtcaatacatcattgtctatataaaggctcgcacatctctggaaggtgtccttcgtaaccgtagtatttagtaggaacgatcgaggcgccggtgagcatgtggcacgaggtaacggncccacaacttccgcttcatttcgagacggacgccggcaattgcttagacccaattgcatgcgcacgtcgctcattttggaccacactgggttcctgtccgtgccaggggatcgcgtcatctagtactttcccattgcctctagccgcttccaaactatacaatccatgtctgacgctcacgaactgtttggcacgcgttggaagaagcacttgcaggacgctcaacacgcattgtagagcaattcctcggccagcatggtggggcacttcttgtagagaactaacccaaacttgcgaaaccacccttggacttcattccgaggctaacccgcctgtgaacgcctgggccacatatgactgatctccttggccgcgcttggggcttgtgggcgaccttgctcactgtggcaagtggctactggtccaggaccgcgccgatgcgatacccggtgggcccaaacgcggggcgaacagcgggggcaagaccaactgagtttggacgtggctacttcattattaccggcacttggcgacagggtggcccacgtaacacgggacgcacccggaggggagaccctaaggggggtcccacacgaccccagagcactctttgccctaggggtggccttgacactactggatggcccgcgcaacgcctatgatgattggtttcgacgggtcgccattccaattgccccgaaaaaggggagggaaagccacatgagaggcccccgacaggggcgtgtggttatatggagacagcccgtgaggagaaacgcttaccgccgcatatatcacgagcagaaggagccactgttgtggggttcatcgcgtcggtgggacattgctccgtcacaacgatcacccagttatgcggttcacacttcaacagatacaacaggggcttacatattggatttcacaccatattgggcgcgcaccacatcttcacgacggcgagtcagcagaccaatctcacgaggatactgatcggctggggggctaggacaaccggtgaccccccaaacgggcttgtcgccaccaagcgtgggcggacgtgttatggctcccctcgtggtggcggggagcacaacgatgaagcagcaatcgaagtgaggactagcacgccgcacaaacgtggtgtgccaaacagatggcacctccatctgagcggtacgcgtaaatagcagccccaccctgtgggggcaggacaaagcgcgcgcagctcacaaaacacagcgcacagcgcccgagcggaacccagacagcaccaaatacgaggagcacccccacgacctagactagganagtgagcggcgctatcatccctagacagcaggcaagcaagagaggaaagaaccaagcagcaggctcacagcgagacgataaaacagagccgacgaccaccgcacgaaaggtgtcaacacgaacacaagccagacaacacacagagacgcgtcacct

SEQ ID NO: 523842 - DNA, 394 bp, Homo sapiens
  misc_feature (378)..(378): n is a, c, g, or t
aataggcgcaaagagagagggttttttcccccctgtagatctcggggtgtttgagaactaaaattcagttagggagggaagcaaggccaactagactagcacgagggcctagctgggaccctcccgagtccaggcactcacccgcccagctatacggccataaggcaatacgcctacctaccaaccaggctaccctaggtaaaaaggcggggcatactagtagctagcggtcaggaacagggacgggtaaggtggtagcaaccaggggcaagaacacgtcgaaggctagggaaatagttttcaaaagccaaagtaagaggtgtactagcttccaactaggaaactagtgaaggaaccctgtaataaccccaggacgtnaggggagtcccgagca

SEQ ID NO: 523843 - DNA, 142 bp, Homo sapiens
tagctggccacatctggaagcacacaaagtgtctcctcggtaactataacataatgtgtgcatgccattgttgtctgttcttcttcactattgtcaaaggaagctttctggctctccaacgatgtctgtccgaaaagaacaa

SEQ ID NO: 523844 - DNA, 281 bp, Homo sapiens
  misc_feature (53)..(53): n is a, c, g, or t
  misc_feature (91)..(91): n is a, c, g, or t
ggctgctgcgcccgcggtccccagtgccccgagtgcccgcgccgcagcggagntgggacccagccctaggagaacccaggcgccggccggngacgccgcggagagagccactcccgcccacgtcccatttcgcccctcgcgtccggagtccccgtggccaggtgtgtgtctggggaagagacttacagaagtggagttgctgagtcaaagatctaaccatgagctaccctggctatcccccgcccccaggtggctacccaccagctgcaccaggtggtggt

SEQ ID NO: 523845 - DNA, 1378 bp, Homo sapiens
  misc_feature (1026)..(1026): n is a, c, g, or t
  misc_feature (1378)..(1378): n is a, c, g, or t
gcagtggccctggtcatggcgagtgccgcgcgggtccaccatggtccacggacgagctggcaccaagctgagccggctggctgcagatggagggcgagggcggcggcgagtaccccgtgagcatcccgtggcttgaactggggcatgctggctggctgtgctggctgggtggtgcaacccgacgaggctggcctgaggcgcttggtgctagcgcgggacttgcgagcttgagctgccaagcttgcttgcgggctgcgcaagacctcagaccagtggcatcggcgagcccccagtcgcccagctcgccggcggtcgttcaagccaccttacaacctgagtttcaaaggaagttctcccagtgaagccagattcaagggaccatttgggaggaaggcatgttcaaggcccaggtacttgaattgcccggtggccggggaagcgggcttttcgattcaggaacccctttgattttgggacaggcttaaagaaacctttccgatttgtatttgggaaggaaagcaccttttgggaggggcctcacctttccaagaatcccccgaagccttttgggaggccctttggaagatacgaaccaatttgcattccaacagcgggaacgggctttggcgcactttgcgaggaggcacaccgtttttgggaagccagcaggcccatcatacgggcccgtttagacaggcggccctttttcccccgtgagaggcaacgaggtttttcccgcgtttccccattttagaaacgttacagtttaccccccgagaccacaacaggggccggtagcagcatcgggagccccacgcagagagagaggaaactagcccattttttcccacaaagagcggaaacgcggctagcccgaggcgccagcgagggacgaccctttcggttatccaccagggttttcgcactttggatgggccagcaccatgggaccagagtttccatttccatttcgagcagcacacttccacagagaaccgagggttttcgtttcccccaaaagtagtntcaggacgccggggagtatgcgttccccacgcacacgggagtaggagtgggttctcccccacacaatgacgaaagcagccttatcactcattatatctcagaaaacaggggcggcaccaacaaaagggagggttcacccacaagtgtggggtgcgcccagtttcccataggacgccggggttcggctattcccccaaaagaacgaccgatgggcattttctatcacggagacggaggagcagtggcggagcaaggacttctcaacaacaagggtggcgcacaagggaatacgtaccacatgaggacgcagcggtcggaaacaactcaggcggggataccacggcgacacgtn

SEQ ID NO: 523846 - DNA, 846 bp, Homo sapiens
agagtcctagggatggcccaggggaaaaagggggccgcgaggtctaaaaggttggcctgccaacgcaggggggtcccccagggcacaaggtcaaaggcccgccggccccaccactggggagacccgcgtggtgtgctcgagaagcgccagaaatatagctgggcggttggttggagcaactccctagaacatcacccacgaacctgtggggggcgctaagacaccgagagaattcgtttgacacccccgggaggcggggggttcccgctaaagcccggacgaccggcttttttgccccccacacttctggggccacccacaaatgtgaagctcccgcttctccccacaaaaaaaagtaggttccgcacattcgtaccacacgagtatttttggacaccacaccacaaggcttttgtgttttggtgaattatagaaatgagcttttcacggaaattgacccaaccccccgttggtaacaccgctgtcctcgggctaatttagacgaagatttcacttttccgcgcacaccacccctgttgcacctcccacatcctctatgtgccacgccctatgcccatatataagattgttctattgcaccctgatacactttatggagtgcctccacacccccagatagtggaatttatatgaaagggtgtgaaaagtatttctttaactaactatagataggttaggttaaaaccttgcatctataaatgagccttttcatctgtccaaagctatgggtttttttaaaaggttcaccatatttagatctatcccccctggttttttattgtttcacccaccccctaaagtgaatattggttttaggactgccca

SEQ ID NO: 523847 - DNA, 132 bp, Homo sapiens
agctcgtgggggctctttgcgtggctcgttgcgtggcccctcgcgtggctcgttgtgggctatttagagctttatggccctgaagtaggaaccagatgtcggatacagttcactttatgctacccccacgcg

SEQ ID NO: 523848 - DNA, 465 bp, Homo sapiens
cctatcttggcataattctcataaaacacacatgctctccctgccattcttgtcagactgatctctcaaaccccagcaccttctacaaaacaacgactcccttccttcctaggcatagttggtgcagtcagaattcttacacaagagccaggaccgcaccctgtagcctttctgtccaaacaacttgaccttactgttttagcctagccctcgtgtctgcgtgcagcggctgccgctgctttaataccgttgagaagcttaagcttctcaacggagggtccccctcaccactctatgaggggccattattcatacacctacaaaggacaagccctgaagaggggcaggaaaagaatgtgcccttcttgagtgtgggtgtgtatggaaatgtgtacaaccatggcccacaggatccaggtaatccaaacaagaagcagagcacgcgttgagaagcttgggtaccga

SEQ ID NO: 523849 - DNA, 425 bp, Homo sapiens
  misc_feature (28)..(28): n is a, c, g, or t
  misc_feature (82)..(82): n is a, c, g, or t
  misc_feature (90)..(90): n is a, c, g, or t
  misc_feature (108)..(108): n is a, c, g, or t
  misc_feature (126)..(126): n is a, c, g, or t
  misc_feature (199)..(199): n is a, c, g, or t
  misc_feature (205)..(206): n is a, c, g, or t
  misc_feature (245)..(245): n is a, c, g, or t
  misc_feature (260)..(260): n is a, c, g, or t
  misc_feature (268)..(268): n is a, c, g, or t
  misc_feature (289)..(289): n is a, c, g, or t
  misc_feature (348)..(348): n is a, c, g, or t
  misc_feature (356)..(357): n is a, c, g, or t
  misc_feature (359)..(359): n is a, c, g, or t
  misc_feature (364)..(364): n is a, c, g, or t
  misc_feature (381)..(381): n is a, c, g, or t
  misc_feature (390)..(390): n is a, c, g, or t
  misc_feature (408)..(408): n is a, c, g, or t
gtttgagcatcctccatccaagacaganaggaaagaaggaagggaaaggagaattataaagactatacacagtacatttcanagaaaaanattagaaaagataatttnagacaattacaaaatganattttgttaatgcaaattaataaatttcaggacattttattgaggatttaataacatttccaatatacatttnattgtnnataatatattatgctgtcactttacatattttgtctaanagcaaatatcatttntccttttnattttactgttttcacattanagttaattggctcagagacaaagttcatcaaattacaataatcactaacagaataagtnacaattanntntctgntgggtatcattccagtnacttctgtntcctttacaaggtttatnttttcaaaagagcttta

SEQ ID NO: 523850 - DNA, 175 bp, Homo sapiens
  misc_feature (30)..(30): n is a, c, g, or t
  misc_feature (40)..(40): n is a, c, g, or t
  misc_feature (56)..(56): n is a, c, g, or t
  misc_feature (144)..(144): n is a, c, g, or t
  misc_feature (172)..(172): n is a, c, g, or t
cacaagttagtactaaaaaaattatgttgnatatgctctnatacaacatgcttttncccttcatgaacaatttgtgttttactgagaagagtcattgtttatggtagacattagactacagatgaatatgcactttaaacactnttagtttgctttcttaatttaatatctnctg

SEQ ID NO: 523851 - DNA, 423 bp, Homo sapiens
  misc_feature (92)..(92): n is a, c, g, or t
  misc_feature (114)..(114): n is a, c, g, or t
  misc_feature (116)..(116): n is a, c, g, or t
  misc_feature (119)..(119): n is a, c, g, or t
  misc_feature (135)..(135): n is a, c, g, or t
  misc_feature (140)..(140): n is a, c, g, or t
  misc_feature (148)..(148): n is a, c, g, or t
  misc_feature (153)..(153): n is a, c, g, or t
  misc_feature (156)..(156): n is a, c, g, or t
  misc_feature (161)..(161): n is a, c, g, or t
  misc_feature (165)..(165): n is a, c, g, or t
  misc_feature (171)..(171): n is a, c, g, or t
  misc_feature (184)..(184): n is a, c, g, or t
  misc_feature (187)..(188): n is a, c, g, or t
  misc_feature (191)..(192): n is a, c, g, or t
  misc_feature (194)..(194): n is a, c, g, or t
  misc_feature (197)..(197): n is a, c, g, or t
  misc_feature (201)..(201): n is a, c, g, or t
  misc_feature (208)..(209): n is a, c, g, or t
  misc_feature (214)..(215): n is a, c, g, or t
  misc_feature (220)..(221): n is a, c, g, or t
  misc_feature (275)..(275): n is a, c, g, or t
tgggaaaatgtggaagcaaaataaaggcaatcgattggttttcaatactaattgttttttgggggtaggtatcttcttagaaagtccctagncacctaattatatgttagtagncngcntgtgattggctggggntgtcntatttctnacatnagnatttnccanaaatgntccaagttaagtntgnntanncntgnatgnagtatgnncccgnnaagtnntgctgtgttgtagtttaagcaaagttaaagctatttctaagggccaggtggttntgtttgctcaggatccggccagtctccatttccattttcctttacctattcccctctcctttgtcatgccactcagtaagctgagagtatgatcacatggcttaacgttactctttagttattactgttgaaatggtggtcacaccgg

SEQ ID NO: 523852 - DNA, 324 bp, Homo sapiens
  misc_feature (17)..(17): n is a, c, g, or t
cccaaccgccaacaggnccaggacggacccaaagccagacgaatggactccaaccccagaatgatcgtgccgacagacggacggactcacgaacaataggtggcctccccaatttgcgcacagaactcagaatatttgccttaggcccggacctcccgcacccaaagagacctcaaccactttgtgccctagccccgctctctccagtagccgcgaccgcgagccctccactatctgcgactgtgcgtgcctccaacgattctccccattcaccccaccctcgaccgcccaccgatcatcgatgcattcgctgacccccgtaca

SEQ ID NO: 523853 - DNA, 117 bp, Homo sapiens
atcaggatccgagcattcggtatctagtattgtgacatgcgtaatcctatatgaggtcgtagcctctcagaaccgtaaggatgctgaagcctggttcaccagccggactgaagaatt

SEQ ID NO: 523854 - DNA, 476 bp, Homo sapiens
agagtgagctgatcaggaagtataatttatatatcacattgaattatgcagtggtgatgaatttggtgttaccccctccttctggttttacatcatgaggatcagttagctgctgacagaaaagtcatcttgtgtcttttgtaaatttgaatttttttttaaatctattaggaactggaaaacagcaagtatggttgatttctcatatattcaagggtagttcactgttctataagagtcacttgctgaacacgtgaatttagcaacatataagacaccgtaggggaaatacagaggctagatttcgtgcaagcgcactggtcacaaatttcatcgaagcagtcaacatgtaaatttctgttgtaaagacaccttatttaatataatcgattcattaacattgaagtcatgaccaagaagactgtaactcatgcctgaatgaagcttatctgacacataagcttcataaggcacac

SEQ ID NO: 523855 - DNA, 332 bp, Homo sapiens
atgatggcttgggcagatgttatgcaagttatttgcatgtatatggactttctttttttggagacaagtctctctctgtcgcccaggctgagtccagtggcacaatctcggtcactgcacctccgctcccaggttcaagcggttctctgcctcagcctcccgagtggctgggattacaggcgcctaccacatgcccggctaatttttgtatttttagtaaagacggggtttcaccatgttgttcaggctggtcttgaactactgacctcatgatttacccgccttggcctcccaaagtgctgggattacaggcgtgagccattgcactccgg

SEQ ID NO: 523856 - DNA, 215 bp, Homo sapiens
acccctaattggctcttcgatgacgctaagagagtcttagaggacggcgactaaccttacctggactcgacatccatgaccgttttgagagaggagaacgggccaccgctacccgcgagacagttgctggatgtatgccagtgagcactcccacccagaatgacgtacaagcatcagctagcagtcagaccagcagccaagcaggctggtccctg

SEQ ID NO: 523857 - DNA, 714 bp, Homo sapiens
gcctttcctttcagcggagcggcgggggcgagatggcagtgtaaatatccaagaagaggaagttgtcgtctgatgagcatcttcaagactgaacgtcgaagtgatgtcttcttcactcgggagctggccttgaagcatggctactcttggagctgcatggtgcgagattacaccaacgccaggtagtcgtagcatcgattatcttagccacagatgaacacagagaactgttctctgcgtgagaagggccggcggtgttcgggaactgactgcgtgtatgttcagcaagaggtttggctttccagagggcagtgtacgcagctttatgctgtaaacaagtgtggccactagaggtctcgtgtgccattgcccaggcatgagtctctgcgttacaaactcctacggagggtcttgctgtgcgggagggactgctatggtgtgctgcggttcatcactggagagtggggccaaaggttgcgacgtcgtggtcgtctggtgaaactccgaggacagagggctaaatccatgaagtattgtggatggtctgatgatccacagtggagaccctgttaactactacgttgacactgttgtgcgccacgtgttgctgcagacagggtgtgctgggcatcactgtgaagatcaatgctgccgtggacccatattggtaagattggcctaagaagacccctgcctgaaccagtgagcattgtg

SEQ ID NO: 523858 - DNA, 129 bp, Homo sapiens
cctgcgtgttatcgtctatggatgtacaactgccagacaaacagagaaaaaagaactgaaagacacggagttcccgattgctggctcatgtggttaacgatatcctactgtggttgcggcgttaatgac

SEQ ID NO: 523859 - DNA, 972 bp, Homo sapiens
  misc_feature (21)..(21): n is a, c, g, or t
  misc_feature (863)..(863): n is a, c, g, or t
  misc_feature (885)..(885): n is a, c, g, or t
cgctctctcatacaacccccncccccccgtcagggtcactgtgatcctgagtttcaagaactgactcagtggcagaagaaacttcatcgaggccaagcacattcaccagcaagtcaaaattttctgggccaagcaagaacaaaaagtgaaatgcaaaatggaggaccatgtagtacctcgagtcaacatgaaaattccatcatgttagccatagctacgacgtctatttcgcccttcctacgccaacttacctgcgccccgggttcttggtacagctgaacctctctgtccagctatacctcaacaaacaccccgcacctccgccataaggccacccccttatactccagccccgccaccgccgagcccgtccacccgccggagaatcaaaatccaaccgcaattacctacataatcgtcccccacccgcaatctctctactcctcactcaatactactccccacctacaaccccctataacatacccacaattaccccccttaacgcgcgactcccccacgacgacgacgtaccccgcccgccatattatataatcaccaccaccaaccacactccaccttaacctccacgcctcgccaattgcttgctcgtccgtccctttcattttttctccccctttgcctagttgctccccaagctcaacctcctccccaccgcctcattactatatcaccctcctctcctccacatatcgatatacacaactccgactaccccttccaccgaacccatatacctcctgtcgcattccgttgacagaaactaccgctcacccacccccctcaccgcatgaaccccatataactccccgccatttccaccccactataacacctccccnccccgctcccacccttctcacnacactcatactccggacgaaacgcccactcacccgatctcctacccactcacacttcccgtcccacttgtcgatcatcgccatcttt

SEQ ID NO: 523860 - DNA, 344 bp, Homo sapiens
gaagagtccggctgttaaacgtttaatgaaagaagcggcagaattgaaagatccaacagatcattaccatgcgcacctttagaaggaaaactttttggattggaattcaagggtagaggggcccccaaatcccgttttgaatggaggagtttataaggggcggatagtattgcaacaagagtatcccatgaaaccaccaagcattattctcctaacggctaatggtcgatttgaagtgggcaagaaatctgtttgagcatctcaggccatcatactgaaacttggcagcctccgtggagtataggacagcattattagccatcattgggttatgccaacaaagg

SEQ ID NO: 523861 - DNA, 287 bp, Homo sapiens
  misc_feature (7)..(7): n is a, c, g, or t
  misc_feature (216)..(216): n is a, c, g, or t
tagctgnaataacaagcatgcctggctagtttttgtattgttagtataaatgaggtttcgcggggttggtctggttggtctcgaacaactgacctcaagtgatccacccatctcagcctcccaaagtaatgggattacaggcatgagctaccacacccggccttcgtttttcttttgacacagtgttttgctctgtcacccaggctggagtgcagnggtgcagtcatagctcactgcagcctcaaagtcctgagttcaagcaatcctcttgcctcagcaggctgcat

SEQ ID NO: 523862 - DNA, 527 bp, Homo sapiens
agcattcaggaatgtacagataaaacctatctttcaaagaatatcaaatctctttaccagcaacaagaaataatataatggtaacattcttaaaaggaccttaaaaggagatatttaatttctcaacatatattttggaaaaccataacttggctagcatatatacgagttagatctaaccggcaaggttaatttctcatttcaaacacttaacatcgtcatggcaagatgatcaaacctcacccaagcacacaccatcctccaacagctgaaattcattcctaacaagacatttttttttaatggtagtagtttttcaagtaaaattttagagttctggagattattggcgtaacaaggtaaatgtacttaacactgctgaaccacacacacaaaaagggttaagatgatcaatattatagtatgtccattttaagacaaccaaaatttttttaaatcctaatatgtgtaaatatccttatgatttttaaataaatcctctcaatgggaaaaaaataacattttaa

SEQ ID NO: 523863 - DNA, 291 bp, Homo sapiens
aaaaaaaggggggtcccccccccgcgcgggggggggccctcttttcgcgcggggggggggggtgggggggggtttttttttgcagcaccccgcgggggttccccctttttttttcccgggggggggggcccctgggggggtttttttttttaggggggggggggggggggggcccccccccccccctttttcccccggcggttttttccaaagcccccgcgggggtttttttttttttggggggggtcccctttttggggtcccccgggttttttttttttttttttttta

SEQ ID NO: 523864 - DNA, 665 bp, Homo sapiens
aaattaaccggatggcagtgaattaaggcctgcgagagggatacggtgccaaggtctcctgctggtcagggatagaagccaggtcctcatagaaggttcggagctttgagggttgctcatggtcatagtctgcccttaatcctatcccacggaacagaaacttgatgtccaagtcagtcattgggagagagctgatccacagttctaggagagctatttatgggctgtatacgtacctggggtacttccatctccaggggttcagtttttgcggccacgcagactccgggcagcagttccccacacttgcattgaccacactggctggcggcataaactgaccttagacaaaaacatatcgagagcaaaaagtggtaccacaatgtgcacatgacttgctgatgcaatgagaactcacaaggtcagtagaacaagaaacaaaaagtgaaccctgacccagtgtgaacttccagccaatcagtaattcccaaaactaacgcaataagaaataaggtaccctgctactgttactaattatataatttctcccacaaatcatagtttaaaaaccttgtttgctgaagattaacaaaacttataataacactgggggtaatccacgaaagggtaccggccgatccgatctagctgcttacaaaggaaag

SEQ ID NO: 523865 - DNA, 743 bp, Homo sapiens
tgagccaggctccatgaggattggtagagggacttcctttggcagcgtcgtagtttagaatcgggggtataatatccggcttgttacacgaggtatattgcactggtgctgatggtttggagtatgaacggatccgtccttcaggtaatgagcctagtacgcccataggtagtgttcaacccgggccgcccttcctccttgccgcccgtcttgtattcccccagtgtctgttgtgtccccagaccattgatctttttcctctatgttgctaagactggtagaaaggctggagattgtctggccaacccatctttgccaacccatagccgggagaacttactttggaaatgaagccagacctaagaagaaacaccagattaaaggagaccaaataagtttgactttgtaccagctggaaacccagccatagctggaaatgagccactgaaggccagatttaatggggtttgtcccattgtgaacccagatgaccccatggccagacgtccacagatattgtattggccagaattcctccttttctttatttaaaatggtacattttggcccagagcaaagtggttcacacccgtaatcccaagaactttgggaggccgaggcgccctgatcaccccaggtcagaaattcgagaaccgcctggcccaccttggcgaaaccccctctctactaaaaaataccaacccttagctggctgcggtggccctttctacccgctttttgtc

SEQ ID NO: 523866 - DNA, 885 bp, Homo sapiens
  misc_feature (675)..(675): n is a, c, g, or t
  misc_feature (794)..(794): n is a, c, g, or t
gcacatgtaataaaaatgtaatatggagagataaattaggatgagggaaaatgggaatagaggtggaaagtcaagaccgcataaaagggaaacatggttacagtttgatggtgagagctcaaatttactggtaatatttcatgagtacctattgttgagcatttgtaggaaatctgtggggatagtaatctaaaacaaatttcattagtaattaaggaaaagtaatttaaacaataaattttagccatttatgtttgtaaaactgtcaagaatgagaatgtgaatatatgtagtacctaagacagtttaaagccagttttattcttatgtgcaatcaaatttgattaaacatatcaaatccatatatatatatatatatatatatatatatgcatgcatatatagctatgtgtatctaggtctatctctgtattatgaagttgagctgataatctaggtaaacaacgagtgctccaagggtacttggtattggaatatcaacttgttatatttgacagaataattggggttgctttggagtttatagtccagaagagattggaagattaatgctcctttgataaccttgtaacgggagatataatatgggctcaagtccaggggagatagtcatgtgccggtgacagtgggttataggagtgggacaagtgagangactctgtgttacaacccagttcacttaagtgagtggcccccggggtaagtggctttgacgccagcacctggttttgtgtgagacagttggcagaggccgggcgcgcgtgttgtggtgngcgccactgccgaggttttcttgcggtagcggggggtctcggtttccgtcccctgtgggttattgggccggtttttgccggcggcagtaca

SEQ ID NO: 523867 - DNA, 279 bp, Homo sapiens
gagtcagggacgtactctgtcatccaggccggagagcagtgatggcatcacggctccctgcagccctgaacacctggattcgggtgatcctcctgcctcagcctcctgagtagctaagactacaggcacactgtaatttttttttcctttagagacaaggtgtcactatgttgcccaggctggtcttgagcttttgggctcaagcagtcctcctgtcttgtcctcccaaagtgctgggactgcgggtttgatccactgtgcttagccaggatagattaa

SEQ ID NO: 523868 - DNA, 660 bp, Homo sapiens
  misc_feature (660)..(660): n is a, c, g, or t
agccaggcatggaattatttatttatttatttagtgagatggagtcttgctctgttgcccgggctgaggtgcggtggcgcagtctcggctcactgcagcccctgcctcccgggttcgggtgattctcctgcctcggcctcccaagtggctgggactgcaggcgcccaccaccacacccggctaattgttgtgtttttttggtatttttacgtggagacggggtttcactgtgttggccggggtggtctcggaatcctgacctcgggtggtcctcccgctttggcctcccagagcgctgggattgcaggcgtgagccgccatgcccagcccttattctattcattgtgatttctcttttaaaataaacataaattttaaaaattggatggaaattttttaaacaaacttttcactttggagatgatcggattcggtagagcaggaaagaacaagtaccctagagagtatgttctgggctcccggctcctcttccgggggttgaagatgaattgccgtgggccttggtaaaagaggagagatgttgcagaattgcagttggcagagatgtgcttgggatcagggtggcaaggatcacaaagaacagaggatgagggtgggtgtgggtgggtcatacctgtgggcccagccacttgggcgggn

SEQ ID NO: 523869 - DNA, 141 bp, Homo sapiens
catcggacacaacacaaccatatcaggtgtactgtagccccttgatggaagctttctagaacagactttggaacgtgtgcgtagatagtgagaacggggagcagcacctgtagaaagagctgatttcgtattccatggtct

SEQ ID NO: 523870 - DNA, 588 bp, Homo sapiens
ggtgtttcaagtaccacagtaaagctccatggtagtctcaatgtacgggctatggcacatagaatgcaggtaggtaggatttaagaaattactggccgtgtgtattgaatcaggcctgtaatcccagcacttcgagaggctgaggcagacagatggcctgagctcaagagttcgagatcagcctgagcaacatggcaaaactctgtctctacaaaaaatataaaaatcagccaggtatgttggtgtgcacctgtagtcccagctactggggaggttgaggcaggaggattgcttgagcccagaagatgcaggttgcagtgagccgagatcatgccactgcacttcagcctgggcgacagactggactctgtctcgggaacaaacaaaaaaaaataagggaaagagtcgaaaaatattccctgcggagatgacaaggggacactacgggttacggatcacaatgtccgtatcctgggtgaatctgtttccggggaattcacacatgctatgtgaaagatatagcatataaataatactatcattgctcaatagggatccagaggaggctatagagggtgaaataaagaa

SEQ ID NO: 523871 - DNA, 958 bp, Homo sapiens
ggcgcagctttccccgatggcccactgcgtgtaccttggttcagctgtccatttcctgtgaccatctcattgacaatggacatcgcgctccaagtctgacccactcgtgcgtccttttacaggatgtgggagggggcgagctgcggctgtaggcttggccggactgatagcgggtgctggaactgcttcagagccctgagttctccaagactcgtatcagcttgagctaccgcgtttagtagacagtccagaaagctacgcatttgggcaatctcatgcactatatcacaacgaagacgccagagcttgagggcattgatcgcacttcctgacgtggtgtgccttgatgttgttcccatagcgaccagatccgtcgtccgagcccatggtgacctgactacttcgcccttgtatagcctagatagaccttgggatacaatccttggctgaggccgtggtggtagccagtcaacggctacttcaggctgcagggacatctacacacgtgcaccacatcgttgcttaggtcaagccattggaagcgtagacgggccaggaaatccgtaggactaacgcacacggcacttcctgtggcaatagaatcagcaatccattcttcgtgtgaggttccttgccgcgcagtggctgaatggcgagagactggccgacctgagatgtcacagaatcgtgaagcgtcctagtacaaagaagcaaacgctgatagccctagcgattggaccaggcgtcttcttctagtcccgcgatctacgagcatttgtcctggtgggtgggggagacccccagtcacaagctcattccagggtgccgaatagctcccgacttattgaccaggtgacggggtccacatggatctcattcgagttaccttccacacccaggcttgggccccagctgccaggccaagtccccgggcttgagtttggaattgcattccatc

SEQ ID NO: 523872 - DNA, 242 bp, Homo sapiens
ggatcttaagaggttgcggtgggctgacggtcgtgctactgcaacctctgcctcccgagctcaagcgattctcctgcctcagcctccccagcagctgggaccacaggcacgcgccaccacgcccggctaacttttgtgtaggtatgtgtgtatatgtgtgtgtgtgtgtgtgtgtgtatgtatatatatatatataaatatctttcccaatatgccccgttgacagtgtataaattccagac

SEQ ID NO: 523873 - DNA, 222 bp, Homo sapiens
agctcgtggagaccatggctgcaggggatggggacttccagaagtgggcgtctgtggtggtgccttctggacaggaacagaaatacacctgccatgtgcagcatgagggtctgccaaagccctcaccctgagatgggaagcgtcttcccagcccaacatccccatcgtgggcatcattgctgggctggttctctttggagctgtgatcgctggagctgtggg

SEQ ID NO: 523874 - DNA, 815 bp, Homo sapiens
ggtcatggacatcgcagcgacgcagaccccagcaggttcagtcccgtgctgccactcagctgtccagctgggtgtctggagggaagagggcagaggagggtcatgtcccttcagcctgggggaggggcccagtgatgctccacgtggctttttcccaacagggagcaacgagggaaggattggtgcgagaaaacaatggacgaggggacctgctgaaggaaaacagggaggaacgtgagcggtttgagtcagctctgcatagtcacggtggttctgtgctctcttatttagccagtgcgcttaagggacagatactatcagcagtcctaacgtttgggaagaggcctttgagccagtgtcatctgagcgtctcctccagtagcgtctgaaagctgtggacatccaatggctcaggattccttctcccctggttctgaggatccctgggtcttctgagactggtcaggagcagggatggtggggccagtggttgtgtgaaagcagggaggggcatgtcctcctggactacgtgtgatcgccccttataatcggttctcgaggaggttcagtgagtaggagatgctgcttgttcgtgatgaggctgctgcaggggctccatgggagctgtgctgatcccggggggcacagaagggtggtgacgtgtgagcatagtctagttctcactcgccactggcttagtctaactactaacttcagtccggcaaccagtgcactcctggactcttgtcgcactgtgctctgagggagaggaccttggggagaacctgggactcaggatacgccaatcctgcccc

SEQ ID NO: 523875 - DNA, 507 bp, Homo sapiens
  misc_feature (13)..(13): n is a, c, g, or t
cagtctgcaggcntacaggctgtacaactcctccctgccgggggacagttgtccggacctcaagctgcatcctgccacgacaaggaaggacgtctccaggattgagctggccagcgaggacggggtgtctgtctcctgtgacgtgcccaccggcctctgcagcctgactctgggcctctggcagcacggcatatccgctggccttctgggcaccaatgacaacgaagcaggcaatgagctgatgttgccggatggctctatggcccgcagcctggaggagctcagcctggcctggcaggtgggtggtgactgcagggccactgagaagcctcagcaggagcaggcctgcccgggacagctccccgcctgctgggccttcttcgagggcccccactccagcttgagggactgcttccgggtggtagaccctacaccattcctcagcctgtgtgtgcaggtcccctgtggcacccaggagctccagcctgcctgcaacctggcggccgc

SEQ ID NO: 523876 - DNA, 391 bp, Homo sapiens
  misc_feature (39)..(39): n is a, c, g, or t
ttttttatttttcagaaattaaaaaaaaaatcccactcncaaaattaccctttacccccattcctcccaacaagaagtacccatttttacccttgtaatatgttggtttccagatttatgtttatgctttaaaaaattaggcagccaacatattggcccatggccccttttttcattggttttaacccatgttttttcccatttaaacaggagcaatttttgcattcagttatgggatcctataaatccctagtataatggcagcaaaaaaaattactatggttgtaacccttttttcgccccttgctcctcaaaacccttaaagtttaaaatttattgtggaaagtttttgaaatgcagaccggtgaaaataaacaaattcccagtggta

SEQ ID NO: 523877 - DNA, 142 bp, Homo sapiens
tcacctatagtagaaaaaccgactactgatagagaagatgttagataaagtacaaacatggcatttaccacacttgtcatctatcagaatacaaaaattatctatgtcagggtcacggcaataagcaacatagcatattgct

SEQ ID NO: 523878 - DNA, 703 bp, Homo sapiens
atttgttatttcttgtctctttgtttagtctttcttgttctcatctgtctttatctgttgcattgtctgatgttgaatcattcctttctccttttattggtcatgggcctctgcaatgtcttgctctctgtttattatgtttttattctctggtgatgtttgttttctgttcagtctttggcattcctgcctgctgggagagtttgctttctcatggtatccaggcatcagcctttgtcttcccttcctactccctatgacttccatccacccatggaccaggctgctctacgtcctatactgtgtgaccttgggcaagttgcttcccctttctgggttccctccatcatgtaaaatgtggaccctttcagtacttaccccctatgatgttattgtgaggattacatgagttaatactggcaaagtgcttagaacagggtctggcacatggcagctacaatatcagtatttgttggccgcccccggcggctcacacctgtaatcccagcactttgggaggcacaaggcaggaggatcacttgaggtcagagtttaacacaagcctggccaatagggtaaaaccctgtctctacagaaaatacaaaaattagccgggtgcgctgcacagcctgtagtctcagctactcgagaggctgaggcaggaggatcgcagaacatggagatagagctgggttgattgata

SEQ ID NO: 523879 - DNA, 899 bp, Homo sapiens
  misc_feature (74)..(74): n is a, c, g, or t
  misc_feature (92)..(92): n is a, c, g, or t
  misc_feature (119)..(119): n is a, c, g, or t
  misc_feature (127)..(127): n is a, c, g, or t
  misc_feature (140)..(141): n is a, c, g, or t
  misc_feature (145)..(145): n is a, c, g, or t
  misc_feature (148)..(148): n is a, c, g, or t
  misc_feature (154)..(154): n is a, c, g, or t
  misc_feature (168)..(168): n is a, c, g, or t
  misc_feature (176)..(176): n is a, c, g, or t
  misc_feature (203)..(203): n is a, c, g, or t
  misc_feature (215)..(216): n is a, c, g, or t
gtgagctagagggtgaagctggcggagcaggaggatgggcgagcagtctgaatgccagaatggataaccgtttngctacagcatttgtaatngcttgtgtgcttagcctcatttccacnatctatantggcacctccatnngcanagncttctnggtatgaatatcgnagtccagntcaagaaaattccagtgattggaatanaagcatctgggnntgaattcattagtgatgaggcagatgaaacgacttataatgatgcactttttcgatacaattggcacagtgggatgtggacgaccggtgtatcaccatacccaaaaacatgcttggtatagcccaccagaaaggacagagtcatttgactgtggtcaccaaaatgtgtgagcttccacagtaactgagcagttcatggcgaacttcgttgatcccggaaaccaaatagcgggatggatctccttaggaccctatctttggcgtgcccgttccttatacctttgtgagtaacggtggactgtgccttggggcttgatcggacttgtgcttgcttttgccgaagttatattccaccatttgcaagggacttctccatctccttgcaggtcttgtgtacccggggctcagtaagttggtcgtgttggtggaagtgaatatctccccagacatatagctcctgaaacgtctcccggggacttggagtggacctctgctggttgtgctaggcccctcaagtacggtcgttcctacgtgctgtcaccacccgaaaggaccctaaagagcggtctgtggcgggagacagccgcacaatgcctattgtcacaaatagtgccacactagtgtatttagtgtacttgtagatctttcaccccaactcattggttgcgctcaatacagcacctc

SEQ ID NO: 523880 - DNA, 1027 bp, Homo sapiens
  misc_feature (1027)..(1027): n is a, c, g, or t
aacattcactgtggaaatatgatttcatttctttaggctacaaacctgtattactttactgaatgttaaggccatgtcatatattgggtagaaagatattgagatcccaattttgtacaagattgtgattgcttttatctaaaccttagacttaatcctttaaattttgtagctttaggctgcatctgcccgcatagtactattccatggcaaattaagaggttggaagtacctttaataatataaaacataatgatagtcaagtcttatacttctgttggcccttagtcttgaaaatagcagttgagaataaaattcatgtgttgccttgattatcagatagcttgaaatttatgttgtgcactataaagcttgaaaatatttgattactgtgatataaaaacaagtgtgatctttactgtatatgctggtttcttctaaatgttgatagaattgtggcattacatctacatttgtaagtcttatcatatcaaacaagccaggctttgtatgctgctaagtctgtgggtgcacaaagaaaacaccccttggaagggcaacagaaaagccggtggttgcatcaccccgttgcagtttctcacacacatctcttttctgattctgtgttcaaaaagaggctgacggataaaactgaatgcagttgccggagcaccagcttgtctgggccacagaatggtgcaggcccaagaacccaacatcaccagtgggccatggggaacggtgaagtatgggcaaataagaatccttcccttcccactttagtaagtgaagtcctcctcctttataattggaagaagaaaactgacacacaaacaagcctggagatccacccctatgagattagattttggcttgtaacagtgcgaaagtacgaataaacgatatgagtctttacaggtgtcaaaaaccattgactaaacaacgaccccaaatgcgaagaaaacgaacgacatgaaagagataagcgacgagcatagagagagcagacaacactacaagtaagagn

SEQ ID NO: 523881 - DNA, 206 bp, Homo sapiens
tgggggggggggggtttttttttgggtgcccctgggccccccccgggccccggggaaggggaaacctcaaaggttttaagcccccccggggggctttcccccccccccccggaaaggaaaaggggggggctttttttttaaaaggggggcccgggggggttttttaaaccggggggaaattttgggggaaaaaaaggttttgggga

SEQ ID NO: 523882 - DNA, 717 bp, Homo sapiens
atgagcccaataggcaaaattaagcccctaataaaattaagttaagccactcacatcactcgacactccccagccctatccaagtatctccggcatgatgaaagttgcgggctcacgtgcctgtgtgcgcctgctctgtaatcgcttccaaatcatccatcagggactatgtcctagccatgcagctagtcatccagaacgtgctcaaccgccgttgttcatcaatgcgcccacatcactcgagacgtaaattatggtctgatatcatcgcgctatccttcacgccagtggacgcctcaatattctttatctgcctcttcctacacaatcgggcgaggcctagtattaacggatcagttggctctactcagaaacctgaaacatcggcaattatcctctctgctttgaaactatagcgaagcagcctgtcataggctatgtcctcccggtgaggccaacatatcattctgaggggccagagtaattacaaaccttgctatccgtcatcccatacaatgggacagacctgagttcaatgaatctgagtgaggctagtcagatagacgagtcccagcctcacaggatgctttacctggtcacttcatcgttgcccttcattattgcagccctagcagcactcctacctcctattcttgcaacgaaacgggatcgaaacaatcccctaggaatcagctcccattcgataagatcagcttc

SEQ ID NO: 523883 - DNA, 530 bp, Homo sapiens
  misc_feature (1)..(1): n is a, c, g, or t
  misc_feature (465)..(465): n is a, c, g, or t
  misc_feature (511)..(511): n is a, c, g, or t
nctcatcaggttctctgtgctctctgagactcgttgactctccgattcaagtgcgagtgctagttttagactctcatggagctgttagtctgagttctgtcgaatcttctggtcttcaatcagatttgtgcatttccgcaaaataatcagtgggtcgcttcgtaaggactttgagctgatggaggcggggtaagactgcaagcactgcgggctgggcttggcgatagctgagaatcgtaggacaaaatgtgtaatgaggtgaaggaggaggccttacgttccttttcaccgccaatcatgagttatccaagctcagaaggactctcaaaatctgacctccattagcaagaacaaacaaacaaaaactgtctcactgatttagtatctaaaagaaatgtagccgtatactagtttttaaaaaggggaggggtgttgctaaaaatagtttaagagaatgactactcntaaaggtaccattaacacaaacgaatgtcgattatggattcttatngtaattactaaagcattcc

SEQ ID NO: 523884 - DNA, 1227 bp, Homo sapiens
  misc_feature (534)..(534): n is a, c, g, or t
ggtaaagatggcagcttcctagctgatttgcgcggaatgattatagaaggaggttcatgctatcgtccacaccgagtgagacctagtaggtaaagttgtgcatgtagctcgagcagctccattgaaaaggatgcatgcggaggaattaggaagctagctcaggttagcagcccatcgcgacgcgccgacaactctcatccattatcctgcacaggcgagctgcaacgaccgtggtcacgttaggtggcgacaggcccagcgtggtccagccgccatggatggtgagggtgaggccgacgcgatgttggctgatgattgggagcctcaatcacattctattgatgcctggacccatagatgtcctggtaagagtgtccccgccgtgcagactccgcctgcagggtccaagatttccgtggaccgatcaaaggggttccaattggtccaggatagacaggtgaattatcgggccttgggcacctttgctcgtggactggcaagattgtcatccttgtcgcaaagagcttggggagntcagatatgcgacatcggtgcatcgctatagatagcctagatcgtccccttcaaaatggtcgtcaccaagaaaggatgcatttgagcactgttccggtgtcggagcaataacacagagaatcgacaaaaaaggccgaacgaagcttttgtcaactttgtgattgtggtgtgtttggaaaccgaagtggatcatccgcggcccttgggcttgtttcgttgtgccactatgcacgcgtctcggtagcctccccgctgtagacctcgtggtaaggcattgcacttcttaatgcactctggggacgcaacggctcgtccatgtatccgacgcctttcaagtcttggcaacgtgaacttttatccaagcgcttcattcccttaggctagaaaaaacctagaggcttttcccgcgttccatcgaggaaggaaaccgggtgcaagtaatcgaatatcacccccagccccgattattggttgaggttccccgagaaaacgatcgcattttggtcattaaacacggccgggtcccaacgccttttggccaaggcccccaagttttcgttctctttggaactgggaggcccctagtgaatagaaaagattggtttcgcaagttgtgcccccattaatttttctttccttctggaacggttgggtttatacatttccaacaaattggggcacctgaggagagat

SEQ ID NO: 523885 - DNA, 1045 bp, Homo sapiens
ggagagtgtacctggatgcttctgggctcccgttggcatagcagctcttggctgatgtgcacagtctggctcccagctcaccctttttgtttagagtatgacaatagttgctaccgagtagggacttcgccaagtccaatatatcttctaggattcgaaaggtgcatttaccgccataaaaaaggcgaggaaaaacccaaggctctgctttagtgtcatcctcagccgtatcttacagcatcccccgtggtgcattgtagcgttggctagctagagtccagatcatccttaacaaagtcttttcacattttatgttctgttcagcattgtaagtcaggtcttccaaagaaggacagagcaatatggaagtatgtgacgcaaaagggggcaactcttctgttgtagccgttctcagtcagaaaggtcaccaaaaatcgatggaatcatgttccactgggcaagaattgacctttggtatgtatctgtggggtaaattattacgcgttccagatgcttgcaggcttcctgcatccaggagatgctgtgttccccgtgatgcatctggaacccaagctgcagcaggagatgcatggtgtcaggatgttccccacgtgacgctggaggaatatctacagcagtgatgccttgaaattttgtctgaattatgtgtcgtctagccttgcctccagaatcagaaagttcgaggattacttttagtactttggatttcttccccccttgtttgtaagaaagtaaggttttttattggacacagcctcctggcatggtttaccctggtgatagcaaaggagggcggggggcagaaaggtaccacgggggggcaaccctgaggaacccgtcttttgagtaagcggcgcattaagaggcgctatataaggccagggggccgattaaacggccgtgtggaaaaggttggggtttgagacaccacatccttgggggggccaagtgggacccccagaataaggcggataataatatgttggtggaaccgctctgttgggtcgtgtgataaacgactacg

SEQ ID NO: 523886 - DNA, 313 bp, Homo sapiens
ccccgagatgttactgagcttgaatcgtagtacgctgactcacactgtaatacctgccacgtctggacacgagggcgcggccaccgcgctggttttgcattttcaagagacgctccgaaccctcgcgcttctcctcggccaattcgcgaaaaacatgactcacgccctccagagccacatcgtcgcggttgaaatagaagccctgcgggaacagagaaggcgtgaacaatggttagccggagccaaggccgggcttgtggattctgccttccaactacacagttgggacaatagaaaggccaggcgcgtgcgc

SEQ ID NO: 523887 - DNA, 392 bp, Homo sapiens
  misc_feature (28)..(28): n is a, c, g, or t
  misc_feature (30)..(30): n is a, c, g, or t
tcgactccagctgaggctgccgaagacnangtgatcatggcgatgtttgagcagatgagagcgaacgtgggcaagttgctcaagggtatcgacaggtacaatcctgagaacttggctaccctggagcgatatgtggagacacaagccaaagagaatgcctatgatctggaggccaacctggcgtccctgaaactgtaccagttcaacccagccttcttccagaccacaagtcactgcccagattctgctgaaagccctcaccaacctgccccacaccgacttcactctgtgtaaatgtatgatcgaccaggcacatcaagaagagcggcccatccggcagatcttgtaccttcggggaccttgctggaagaccttgccacttttcaaagcct

SEQ ID NO: 523888 - DNA, 325 bp, Homo sapiens
cccagtttctctgaattccaccacaaaacgagaccctgaataagaggagcagtttccctgtgcatatagggggtgtgtcaacggtgaagctttttgggggaccggggaaaaacaaagttgcctgattccgcggcaggtgccacaggccccggatgtacacccggacaggggagtttgggtttaggataattcatccgtatacagtaaaacaatttcgccaataaagtacatgtcttcctaaggcaaatataaatacggtaacagacacttgatttaggatatagcttgatgttaaatatgtgcacctttacaaacctctcagata

SEQ ID NO: 523889 - DNA, 104 bp, Homo sapiens
tcccggagccttacctcggagccttacctcggaccttacctccggagccttacctccggagccttaacctcgctgcgatctattgaaagtcagccctcgacaca

SEQ ID NO: 523890 - DNA, 186 bp, Homo sapiens
gtaatgaaccttaggacatagtgtatgaaactcagggagttggaatacaagtgtctcaaggccactccctccttacccactttaacatcaaacaagctctattcatcccacctccataactgaaggattaaccttcttttgctttttcttttagttgtcttggggaaatggagtctggtgctggtg

SEQ ID NO: 523891 - DNA, 987 bp, Homo sapiens
ataaaatttgcagcacatcagatccaaaacagaattattgacgtaaatcaaagatcgacacagcaaggtggaacaggatatagacagtcgctatatttacactgatggtgaagaacataagatacatgaaaggcactgctctacatgcaatcagttagagagcctgtaaatggaaccatcgcatgaaaacttatgcaacaacaaccggcatagtggttggctgctcgagcaacaaatcggagcatgtcattgcacttttctcctacactggcgcagttttccagtggacagacgagtaagagtcattacttcaatacccaaaaacgattgattacaatacgcggttacgggacctccgttcgtgcagaggtgtgtgatggcattaccgcgcaggtgaccatataacaaacctatccaaaattatcaacgtgtgaatccatagttaaagagggatccaagaatatcatacaaccttaggttctttagtaccgtcgaggataacccgaagatggggagccaccaaatttgcctaagcaagaaatccttgtcgtggaaactagaagttcaacaagtgcaccagggtgcttaatcatcataccagttatctaagttcccaggacagatcagctagctcaatttacggctcagcgatattggggaatagaaagcggctcgatgttaggatatgctgttagaaatcacaagcccaaagccaatgaccagtcttctcctcatactaacaagtgagattgcacgcattcagcacataacagaaaagaattaaagccaaacccctagaatggttcctggtcaaaaagcataacatggtagtcggcgggaaggacccattaattcccaaggattccttaactttggccaggtatattgacagaattatgaaggtggtcacctattgtagcccgggggagggaaatcgcttcagagaggagtaagcacagggaggaaaatattgggcacacaagacga

SEQ ID NO: 523892 - DNA, 1556 bp, Homo sapiens
  misc_feature (972)..(972): n is a, c, g, or t
ggcgtcatctgagatagatcgccgtcgggaggtgctctcgtgcgagttttgtattctgtgcgccggggggggtatagtactaattgttcctcgtcggggcgacgcgttgttgcccctggtgcgcgcgtcctttgttggtgcgccccccgttcgtgggtgcccaagggggggtgtctcgcgaagagcacgcgcggtggtggtcgtgcccggccggcgggaggtttctgccgggggatgtgttttggtctgcgatacgcaggcgtcgctgccgacgatattattatttggtggcgcagcggggggtttgcacgtggcccccggcccgtgtgtttgttgttgctgccctcctgttatttagcctcctggtggggggcggcccccgctagagtgtaaggggggtgttgctctttctctgcctgcgcgaagggtgcggccgccgtctgtgaggggagggttttgtctttttgtgtaggaccaccttgcctggcaggggtgagatattgtttggtggggagagtatcgtggggtggtggtggtgttctcgccgcctctatgttgtcgccgcacgcgttggttgtgtgtctccgcccccgcttcgtggatgagagagtttgttagaggagacgaagagtctggtgtgtttgggtgtgccttgagaagggggttcctctcccccccccccccgcgcgtttgtgtcttgtgtgtgtgtgtgtgtgtggcgccccgcagcacgcagaggtggttgtgaagggttttttctggtgtgatgtgtgtggtgtgtatagtagtgtgtgtctgtaatatcattgtgtgagagagagagaggtgtgtgagagaccccggcactcactgccattgtgtggagtgttttgtttatatatctgtctctgtgtggtgtggtgtgtggcgtcgcgcgcgcgccgccctctccgctctctctcagatatatgacaccctctctctgtgtgtgtntttgtctctctctccccggcctctctatatatatacacgccctctctcacacactcgcgcgccagctttaaaagagattttcctcgcagagcaagaacacacacacacacgataagaagaagaagaccacgcacgaatattcacccccgcgttatatatatatttctcccccccgcacaatatatatctcacatctgtctcacacacactcttgtgtggagatagaatatgtttttcacaccggtgctttcttgtggggggggccccccctctcggggtgcccgcgcgcatatatggtggtgccgccgctttttttttgtaccccctctcttttttccctcttgtgctgcggtggacacacacattttaagggttttttttaatatattttttgtgtgaacaattatcgcttttgttggacccacactctgtggggggacgcacaaaattgttttacacaaatgatgtttatttgtggtgacacacacactgggcgtcgccccccccccgcgcgtcgcccccatatataaatatataaaccggggggactttttttttcgcccctcacacacacacaccacaca

SEQ ID NO: 523893 - DNA, 345 bp, Homo sapiens
  misc_feature (1)..(1): n is a, c, g, or t
naaagagatgagccaccactagaggctgtcttagacaatgtatgctgactcagtaatgcttttcgtataaggtcaagtatcagtcatacagctagggtagtccctgaaaaaaacaattgctaagaagtataatacccttttcataacactcaatgcagctcagttttcagttactcatcagtggtcatgatgactatcaccatttctccataagatcctccgtccatattcatgcattatggctcaaaagactctaagtgccatcagacagaaggaccagagtttctgattataaccaatgatgctgggtaatgtccaaatgagcacattgcatatggatggtcg

SEQ ID NO: 523894 - DNA, 172 bp, Homo sapiens
tttgactacagcatcaggcataagcatagcaattttgttatttttccttgcagtttcattgacttagtttatgcagcttggaccacactacttttttgatgaatccatgtccatacccaggcaaaaataatgtaactacctctataagtctagataaccaggcaagtagctc

SEQ ID NO: 523895 - DNA, 359 bp, Homo sapiens
ggggttctaggaggacaactgagccttcaatgcctcaggttatttttcttgtaattagtattattattattattagaaacacggtctcgctcggtcgctcaggctgatatgcagtggtgcggtctcagctcactgcagcctcaacctcccaggctcaagcgatcctcctgtctcgtgctcccaagtagctgagattacagtgcatgtgccaccatgcccggctaattattagtttatcattttagtagagatggggcttgctatgtttgcccaggctgtcctcaagcgatcctcccaccttgtgctcccaaggcactgggattatcgacatgagctgctgcctcatgctcatctgtcaa

SEQ ID NO: 523896 - DNA, 214 bp, Homo sapiens
accacccacagcctaattattatcatcatccctctactatttcttaaccaaagtcaacaaaagcctatttagctgtttcccaaccttttcctccaacccccgtaacaacccccctcctaaatactacatctaccctgcatcattcctaccccttcacctaatcatggtcacatgccaacgtccacattactccaggtcgaaccacatgatctac

SEQ ID NO: 523897 - DNA, 373 bp, Homo sapiens
ggggggggggggggggggggggggggggggggggggcccaccggcccttttcccaagttgtgggttttcccggatttttccaaagtttttgtttaccggcgtttttggtttagaacccccccctcagggccctccccccccctttggcggggggttgttttgttttttaacccaaaaggccccccctttgattggggccgggtttccccctttttaaaacaagggtttgttttttttccccccagggcccttatcaggggcccaaagtttttttttaaatttttgccgggtttccccggtaagtttttttttttttttatttaatttttttttttttccccttttaaaattaaaggccttttttttccgggga

SEQ ID NO: 523898 - DNA, 271 bp, Homo sapiens
catcatcgccatagctcactcctgagacagaacggcgtgcaggaagagccagatgctaaggatgacaagttgctcggtgcccctaggctagctgtggaacactgtgccctcaacaggaaagactggaatgacagccccaactcaaactatttctatttccagctgatttctcttattaggctactttaaaacttccaagattttcatttttaatttttgtaaaacagtagtctaaatgatggtttgtgaaaaatactttgcctggaagata

SEQ ID NO: 523899 - DNA, 128 bp, Homo sapiens
  misc_feature (118)..(118): n is a, c, g, or t
aggtggtgtgtctgctattcccggcttccggagatgaagcacccataggccaccaggggcgattggcaagaaggtgcaccaggccgtccagggagcccgggcctgccggtatgccagnccgcagcgtc

SEQ ID NO: 523900 - DNA, 484 bp, Homo sapiens
gggggcgaggggaagaccctgagctgcacggacacacggcacacacgcgcggcagagccacgctcccagaccacagccaccgtgcacgccgcgctcaccgtgcccgggatgtagtggaagagcttgttggcggcggcgtccccgcttcgagcagcctcggggcccggcaggccggccgacatccgcgcgctgtcctctctggggacaaggcaaggggtctcgtggcttggccccggagcgggtgggggagccctgcgcccaggtggccgcacccacgccccgctcacctgtttcccttcagcgagggctttctggagaaggaggcccggagcctcctgggggcctgagggacacagtggctgttccccatggccagagtcgtacaggtcggcaagtctgggtccctgtccacagcctcctgcccccgcctcccgcgggcaggcggggctccgggacgtcccgcccggcaccagggcctggaaat

SEQ ID NO: 523901 - DNA, 523 bp, Homo sapiens
aaagagacagactcctcatctgcatcggcagcgacaccttctaaaaagaaaagtttaatcgatcagttcttcggtgttgagtttgaaactaccatgacaactgtacagaatctgaacgaagaagaagtcagccaacaggaaaggaaccatcacacttccagcttatgctgttttatcaatcaggcaagtcacacgtatcttgttcacaggaccttaaagttgcgacttcaggaagaaatcaccaagacagtctccaagcgtctgcaacagaaatgccttgtatatcgaaatcttccaagatcagccggctgcctgcttacttgaccattcagatggtgcgacttctcttcatacagacgaaggaatctgtgaatgccaaagttcttaacggatgttaaatttccctcttatgtcgcgatatgtactgaactgctgtacaccagcaaccttcaagagacaaacgcgtgctcttttcgatccaacattcaaggatctagaagataccccccgtgactcagcagct

SEQ ID NO: 523902 - DNA, 231 bp, Homo sapiens
ttcggtgaccaggctgaggcccgcaggtctaggaaccaagaaagcacgcaagcgcggtgaagagcgcctccaggccaaaaaggaggagatcatcacgaactttatccagggaggaagagaccaaaaaataaaacctcccacttggtctgtacatacgggcctctgtaattacttagatcagccattaaaataaaacaagccttatcggcgcatacctaatctgcgggggta

SEQ ID NO: 523903 - DNA, 640 bp, Homo sapiens
  misc_feature (1)..(1): n is a, c, g, or t
  misc_feature (313)..(313): n is a, c, g, or t
ngagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctanctcggaggctgaggtaggagaatggcatgaacccgcgaggtagagcttgcagtgagctgagatagcaccactgcactccagcctgggtgacagagcgaaactccgtctcaaaaaaaaattaacttgccgtggtggtgagcgcctgtaatcccagctactcaggaggctgaggccagagaatcactagaagctgcgaggcagaggttgcagtgagctgagattgtgccagggccctcctgggcaacaagagcgaaactctgtctgcacatattataatcaagggccctttgttgctgatgaatacattggttagtacccctcttttcg

SEQ ID NO: 523904 - DNA, 811 bp, Homo sapiens
gtagagtgttgtatattcaagggattgtgtgcagaaattcttgtggtgataacccttttatttatttatttattttgagatgggctctcactctatcacccaggctggagtgcagtggcatgatcacagcttactgcagcctcaaccttccaggctcaggtgatccccagcctcagcctcccaagtagctgggactacagtcatgcctcaccatgcccagctaatttttttgggtatttttgtagagacagggtttcaccatattgccaaggctggtctcaaactcctagactcaagcaatctacccgcctcagcctcccaaagtgctgggattacaaatgtgacactgcactggcctaacctgtttattaatcgtacctcacctacataggactcaaccattatgcaacctacctccggaatataactgaagactggggaataagagaaataattttcaaagtaaatgcatttctccgagtcccaaaggactttgttcagagcctatccttaattcataggcagttctaacaaacagtataatctaatttctgagcccatagctgatcagaagtgggtcagaaagactatcttgggaaatgcccctgcagcagaaggtagtgacagttgcaaggcaagcatacttaaaataagcgtaagaacacagaagatatcttcccataaacggaagttactgtctcagcaagttgaggaaaatttctttccctttccattactgctaatggatattgcctaccatggctttccttttatccgtcctacggtagataccggtgtgtctgggacgatc

SEQ ID NO: 523905 - DNA, 132 bp, Homo sapiens
  misc_feature (62)..(62): n is a, c, g, or t
aattacatgtaattgtttatttaaaataattttccaagtcttccaaggagggaatctgctcntgctgctttttaaccaccccaaacagctataaatcaacacactttctgtattttattttactactatgta

SEQ ID NO: 523906 - DNA, 112 bp, Homo sapiens
ttctgccactatcactaatccgaaggtacatgaattattggtatctatgaacaagctttgttactgtcacttattcacattatttacgatcgattgtaatgtcggtacgaga

SEQ ID NO: 523907 - DNA, 413 bp, Homo sapiens
  misc_feature (75)..(75): n is a, c, g, or t
  misc_feature (181)..(181): n is a, c, g, or t
  misc_feature (300)..(300): n is a, c, g, or t
  misc_feature (362)..(362): n is a, c, g, or t
  misc_feature (406)..(406): n is a, c, g, or t
tccttaatctctttgcatctcaatcctcatttccttaaaatgggaatcctaccctcatgatgttccttacagggntgaaatgactaaaagtttcctaggctggacgtggttgcttactgctgtaatcccagcactttggaaggcagaggcaagaggatcgcttgagctcaggagtttgagnccagactgagcaacacagtgggaccttgtctctactaaaaatcaaaaacattagccagatgtgttggtgcatgcctgtagtcccagctactcaggaggctgacgtggaaagattgatcncctgagccctggaggtcgaagctggagtgagctatggtcataccactgcactccagcctggntgaccctgtctcaaaaaaaaaaagagtaagatcctgtctaaaantaaaaaa

SEQ ID NO: 523908 - DNA, 868 bp, Homo sapiens
  misc_feature (353)..(353): n is a, c, g, or t
  misc_feature (395)..(395): n is a, c, g, or t
  misc_feature (467)..(467): n is a, c, g, or t
  misc_feature (528)..(528): n is a, c, g, or t
  misc_feature (564)..(564): n is a, c, g, or t
  misc_feature (569)..(569): n is a, c, g, or t
  misc_feature (612)..(612): n is a, c, g, or t
  misc_feature (665)..(665): n is a, c, g, or t
  misc_feature (763)..(763): n is a, c, g, or t
  misc_feature (766)..(766): n is a, c, g, or t
cagcattgcaggagtacctagtatggggtgagcccaccgagtattaacccccgaggtgaaggagatccgctgcattgtgatgtctgccgtcacttgcgtgcgcactcaccagaccgtgcaccgtgtcgctggctcagctgtccccagcatgtagtacctctacatgatatggatcccttaagttggatccatattcataccctaatgagtccccgcagttatcaccccaggatgtcacacccatgccaagatcatggctgacaacccatcttgggatggcgagaagaccattatcatcacatgcagcttcacgccaggctcctgtacactgacggcctacaagctgacccccngtggctacgaatggggccgccagaacacagacaagggcaacnaccccaaagggctacctgccttcacactatgagagggtgcagatgctgctgtcggaccgtttccttggcttnttcatggtccctgcccagtcctcgtggaactacaacttcatgggtgttcggcatgaccccnacatgaaatatgagctacagctggcgaaccccaaanagttntaccccgaggtgcacaggccctctcacttcctcaactttgctntcctgcaggagggggaggtttactctgcggatcgggaggacctgtatgcctgnccgtttccctgcctcctgcttcagcctcccgaggccgaagcctcagcccctccagacaggccgctgacattcagcagtttggcctctttccctctgtntgngcttgtgttgttgacctcctgatggcttgtcatcctgaataaaaaataataataaattttgtataaatagggacaacttaaaatagtaaaaaaaaagacaaa

SEQ ID NO: 523909 - DNA, 224 bp, Homo sapiens
ggagcacggagatctcgccggctttacgttcaactcggtgtcttcagcaccctccgctttcttcttctaggggacgggacccagttgctagttcaccatttctattcttaagattcatggcagaggagatctttaacttttgcggggattccacttttgaggtgtgatctctctcacctctaaaagggtctctctcagagactgtctgtgtcccagttgtgtgt

SEQ ID NO: 523910 - DNA, 219 bp, Homo sapiens
atacgggatgaggatgggaggagcagaggagacagtctggcactgcactgggacactaagctaaggctccaacgggggaaaacaaatctgatatcccatttccatactccctccttcctgcttgacttgccaatgtgtactgctgcttccccctccttccactctgaggatctctctctctctctctctctctctctctctctctctctctctttctgt

SEQ ID NO: 523911 - DNA, 188 bp, Homo sapiens
aaccctacttgttctaaaaaatctgtccacaaatataaaactatatagtaataaattgttatttccgaactctggaaagtaacattttattacttatgttttatatctgtggacggatggttttataacaagtagaggtcattcgcgaattaaagctcacttgacagttggaagtatttgaaatcatt

SEQ ID NO: 523912 - DNA, 386 bp, Homo sapiens
ctgtcgcccaggctggagtgcaacggcgcaatctccgctcactacaacctccgcctcccgggtttaagtgattctcctgcctcagcctcctgagtagctgggattacaagtgtgtgccaccatgcccagctaatttttgtattttcagtagagacggtgttttaccctgttggtcaggcaggtcttgaactcctgacctcatgatccacctgccttggcttcccaaagtgctgggattacaggcatgagccactgtgcccggcctaacagttttgtttttaaagtccaaatggggagacataatcagcaaaatatagagcacatttctgagaatgaagataaatgagaagggactatcccattacatatcaacgaacattagagat

SEQ ID NO: 523913 - DNA, 121 bp, Homo sapiens
gcttatgcgtacgtcagtgctaaccatatcgctcaggatgccgactcgtgtgaaggtgatggtcagcgagtcgacgcgattgcgagctcagtgaattgggccgccttgagtcgaccacgcg

SEQ ID NO: 523914 - DNA, 869 bp, Homo sapiens
cgaaaaaagccaggggagggaacccagcacgaggttaggggcctcccccacagagggaagtgtgggcaacccgccccgcagggcccccaaaaaattcggtcaagcgccggggttccaagccgatggcggagcccacaagggggccaaaaacaaagaggggaaaaaataccacctcaggatgaacatactaaggagcatccttgaaacaagaaaggtttggccaacaacacaccctaaacgttgttgcagtggaagacgcacacttgtgtaagccaactggggtaaaaaaaaacgtccccagtgcatggagcaccattttaaacaccatagtcctagaaaaatacgttggtattgggaaaagccactgtcatgtcaaatgggacgaagtactactcctcccgtggaggctactgacaaaaaaatggtcttcgaaaatttatgcggagaccttgcacatttttgtaagtggcgcgtcgaataaaatactttatacacagcacgcattgtataaaccccattaataccgtctatttacacgacggtacaccaccggaggggtacaacgacatctatgccccactctccgccaatagaatgaacacacaagtgataataaaattgagggcacaagggagcggagcagtgaaagttttatataagtgacggtgggcgctaacaattacattgaataattatgttttcggactggcaagtgctttctgaaaaaaaaggatttcaccacgggacgctacaaatctatgcggtgggggcttctagacattcctttcatgcatttgtcttacctccgctcttctcttataaggagaagatcctgaccaaacaaaataaacacccccgaccacatgaca

SEQ ID NO: 523915 - DNA, 320 bp, Homo sapiens
gccggtaccctacatccagtgaagagagctgagcaggaaagaaagaaaattttaaattgacaggtgtggagaagtgtggtcgaccagttttccaggctgatggcagatgtggctttctcatctcaagctcagaggcaaaagatatagtgtgcagcgtgtcaccaactgtctcctttgctcatctgagccaattggttcctcccactatggtctgcattcttgggcatttgtcctcacctgccaggttccaattgcaatgtcagctgcacagaagctgctgattcttgatagctctactatctgccagctctgctcatcct

SEQ ID NO: 523916 - DNA, 335 bp, Homo sapiens
tcttactataaatacaaaaaattagccgggagtgctggccgcgtgtctataatccgtagctacctgagagtgctgaggcacaagaattgcttgaacccgggaggtggaggttgcagtgagccgagatcataccactgtgctccagcctgggtgacagagtgaaactgtctgaaacaaaaaaaaaaaagaaaaagagcaattagccaggcatggtgatgtgcaccagtgttcccagctgggcgcctgaggcaaaaagctgtgcttgtgcccaggagttacaggttgcacagagctacgataatcatgacgctgggctccagggtgggcaacacact

SEQ ID NO: 523917 - DNA, 581 bp, Homo sapiens
ttagtctgtctggggtcagataatgtaccttaaaatctatttaggcgcgcgcgtggtcacgcctgtaatcccagcactttggaggccaaggcgggcggatcacgaggtcaggagatcgggaccatcctagctaacacggtgagaccccgtctctactacaaatataaaaaaattagccaggtgtggtggtgggtgcctgtagtcccagctactcgggaggctgaggcaggagaatggtgtgaacccggaaggcggagcttgcaagtgagccaagatcgtgccactgcactccagcctgggcgagcactccagcctgggcgagcactccagcctgggcgagcactccagcctgggcaacagagcgagactctgtctcaaaaacaaaaaacctatgtgtggtggctcatgcctataatccccgcacattgggaggccaatgcggagaattgtaggaacccaggaattcaagaccagccagggcaataaatcgagaccttgtctctacaaaaaataaataaaaggacaataccagcaaaacctatgctaaaaaacaaacaagaaaaagcctcactgtttacttt

SEQ ID NO: 523918 - DNA, 161 bp, Homo sapiens
atccaaaactgattcatctctattaaaagtaagcacttaacaaaaagagcatgtctgtgtatatagacatatttttacaggaatcagcatatctttgaagcagccttagtgtttcttgtaaatttgtttatttgtagattctggaaattaagcctttgcaa

SEQ ID NO: 523919 - DNA, 204 bp, Homo sapiens
ggcatttttgggggctgtatatatgtaccacaagtaccaaaaccggaaactcaatgcccccttttgcaccatcgagctgaaagaagacggtatcagtttcagcagctaccatgacagcattcccaatgcaaatctttcgggattcttggaagatgatagcaatgaagtggctcccaatgggcagctcaccctgacaacgcccat

SEQ ID NO: 523920 - DNA, 1087 bp, Homo sapiens
ggcggaggtcgcgatgtagccgggtgcgagcgagtgagggcccttgcgggtggcccgatcggggcccagggtgtccctaagccattcctgaagtcatgggctgtccaggacattggtgtacccgccattccggtatggtaccgtagctggaagctccacgtgctccctctagttcaaggccctttgtggtgctcggtaaatgacagcgcgcagcttggtaccttaccgtggcatagtataaactgactaaaaccatgctgtgtgcctctgtcgagaagtattctcgttcagagcacgcgaggcccgtgacatctctatccctgcatggtttggcaccttggtcgactatggttcaactaatcaatgttcgtagtccgtgcgacgaccttccgggtggagtcccactcaggatgatacggccagatgcaaaggaacgctctagaaggcctcgcaggccatagcactgtatgaatgagggcccattaagagtcgcaggcatgggaaatgcctcctcaaacggcagccaggaaggtcattgcatggtcccccgcggagcggggtggtaccttgtgcaccggtaaagaggcgttcgtactttcaaaggatctgtccataccaatatggtataattggtggcaggatgcgaattggtacacccagcagatcgcttggagacgcgactcgacggcgccctgagtaagccaaagtctgccctgtgaggcacttcccaatgatctcctatcgtacctttctagaccaagggcccaacagggcgaccacccgttgagttggcacaaaatcgggtagctgtatgagccctctgttagattcactccctaccatcgacgagatttcacggggaccacttgggttgcccttgaattccctctcaaatagtgggatacgacaggccccggtgactcagaagttagcctgagattcctgccctttggaccacatgggaatgaagggggccttccatatcccaggtcttccaatgggacatacaagaccaactgtgattccatgcctgcacggaggcccctggggggcaggggcctacgtgcattgtggaccccctggtcca

SEQ ID NO: 523921 - DNA, 275 bp, Homo sapiens
atcattgatttggtaaacttcccagtcgtttgtacgcttccactgccgagggacaactgtactagggggaccccgacgtaggggctgatcatcatcagtagcctcgagaatgagacttccaggtgcactgaggggatggcagaagaacaagcccgtgtagtccttggctagcctgggagggtagtcattcacatccataaggatcaggtggaactctgacacagagcttaaggaagacccccctacttctgtggccaccaattgtacccgatatg

SEQ ID NO: 523922 - DNA, 973 bp, Homo sapiens
  misc_feature (676)..(676): n is a, c, g, or t
gactggtgtgattccgtcctgcgcggttgtatctctggagcagcgtgctttcatctccgtccgaccttctctcctaacctaagtgcgtgccgccaacccgatggaagattcgatggatcatggacatgagccccctgaggtccagaaatatctttctcggttgtgaactacaggccgacaaatattatcactttaaggtggataactgatgactaatgagcaccagttatctttaagaacggtcagtctctactgggctggtggccaacaggatgagttgccagcattgtttgaagcatgcaggcaattgtaattacgaacggcagtccatgttaaagtaaaacactggcaactttgtaaaaatgtctgtacagacaaatgggcttttcccttgtgggggcttttggaaactatcaccaccaggtggtcttaagagttgaagcctgtgtgtttcaggaccagtgccataattagctggtacatgcacttagctagctgtggaggaagatgcaagagtccagaaacatgaacgatgaggaggatgttgaaactcttgagtatttcttggaaagcggtctgccccctgaaggtggttagcaaggtttccacccaaaagaacgctaaaactttgctgctgattgaaatgattgacaatgattgatgaccaggatgccantgaagattaatactgatgaggagttgtaacgttacggaagctggccaaagacgcccccgtgagaaaactattctggaatattccaggcaaaggttgctcgcgctgttccaatgggaaaggtcagagcctcctgcgacaagtcggggtaacctttggacagggacacctaaaccaaagactttggaccttccaagagctaaaaggggcgcccgagcaactaaaatgcgcgcaggttctcgaaagcaaaataaaatcttgacatgataacacacctggttcctctctctgatactctcg

SEQ ID NO: 523923 - DNA, 1057 bp, Homo sapiens
ttgtatgtcaaattatgagatctgatatgagatggatctctgcaagggtcacagtatgctcaatctttatacattcgaatatgcagaaaaagatgtgcgccgtgattagaggcgcgacatgaaccatacctacgtactgaaaagaccactatgtaggttcaatcgatgaatgtatgaacgaacctgaccaaaaccatcaggttctttaaatctgacccaagaaactatttgattagacaactatgtcagagtaagaggtgcctgacacgtactagaatccaaggatatccctacacactcacgtacgacgatgtcaccacttgcttacaggaggtgtacttcacaagatgctaataggctgaaccatattttactaaactgcgaactatgaatctcaagtgactgtgtggatccaaacggacaacgaaggtataaagcctaatgagatcagacaggcgcgacttcgcctatgcattcgaatgtccattatctaatcaaactcaggagatttaacctcgatcgctatccgaatcgtctcgtgagatctagagagagtaatcgcactagcttgagatcgcagcgaacgttgaatcttcatttcgcttcgtggtgtcgttgcatacggaaattaagaaagtccctaacgggatgaatcatgaacgatttcaacgaacgacagtaggtaagtacctagaagctccgagtttttctaaatcctagcatttcaaaattcactgcccagctcaatgaagttgggacagccgcagaaatagttagggcacgtactttttaaccataatggaggtcctttcccacccggtaccatgactggtgactcttaaaaatttccctaataataatttcacaattaatctagccctaccagaaacaggggggtttggggagaaaaggcataaaacaagcctggtttgaaaagggggagcgcgcgacgcatgtccaagttaatcccttagaaggcgtggggcaccccaggtttcaaccgaaagggcctaacgctggtttctttggacaaccaccgttgggttcgctcataggg

SEQ ID NO: 523924 - DNA, 286 bp, Homo sapiens
aaacccgtgaaagggggggggaacctttttcccttatatgctgtttccctggaggggttccccccagtccccagaaataatgtgtccccccagtcttttcaatcctttcccccccgaagtgcaaaacccccgcgggggattgtgcggggattttgggggcaaaccccagccaatttgccctcccctccccatgtttttgaatgcaatttccccctttttttcgccctaagttttccccccctttaaacccctaaagttaaataaaggaatagggtccccatgccca

SEQ ID NO: 523925 - DNA, 388 bp, Homo sapiens
  misc_feature (37)..(37): n is a, c, g, or t
  misc_feature (193)..(193): n is a, c, g, or t
  misc_feature (374)..(374): n is a, c, g, or t
  misc_feature (384)..(384): n is a, c, g, or t
tttcttttgtatttagagacagggtctcactctcttncccaggctggagtacagtgatctcagctcactgcaaccatctccctcccagttccagctattctcctgcctcagcctcccaagttgccagtgtgccactttccattattacttttttttttttaagagaaagggtcttactctgtcacccaggctngaataagtggcatgatcatagctcatttcagtctggaactcctgggctcaagcaatcctcccacctcggcctccccagtagcggggactgcaggcaggcgccaccatgcctggctactttattagtaattcactgctacaaagtgagagcagctcccaggggcacagaacttccccacacnggcaggcttncccg

SEQ ID NO: 523926 - DNA, 302 bp, Homo sapiens
aggatgactaggtagttcatgtggcacttatagcagaccgccaaagacttcaagtaacacgtgaacacatatggtattcaaactcaaactcctcaacaagtagaacccattccgatatggcctcagcaggagctagtgaaagctcatatgcagctgggtatcaatgacaccgttaggactctctggaacgccagacaggcccattggttagctcgggacatcaaagatttatcgcattctaggaaagactgtggtatgttacccgcattataatcggagctaagtgatttctacatagtctc

SEQ ID NO: 523927 - DNA, 528 bp, Homo sapiens
  misc_feature (130)..(130): n is a, c, g, or t
  misc_feature (132)..(132): n is a, c, g, or t
  misc_feature (151)..(151): n is a, c, g, or t
  misc_feature (270)..(270): n is a, c, g, or t
  misc_feature (346)..(346): n is a, c, g, or t
  misc_feature (398)..(398): n is a, c, g, or t
tctatcaccagtggagaattgccgggggttgtgttggctcccccaagtggccccttgcccaaggtgggttcaacaataatggggggcatcctgttggccttcattgagggggttggcatcctcttcactngntaaaaagccaagcagtttngaaatgggcccccatttgtggaggaccccagcaagttgccccttaaggatggcacccgggccccaggttaccccagttatcagcagtacccttgaggaagccattgccaccatgggagntatttttgggttccctccccaatggtttaccttaaagggaggggtggttcccagttaaccctgggaccctcaaaanagggtttttactttgctccatagtccaagggtgggggtggggcaccccaaantgccctaaaaaaggggtcccctttttttttttaagggccccccagccccacattaaaatggaggaagttttccccccagttcctttgtggggccccctgatgagtatttaaagcccgttttgaaatgcca

SEQ ID NO: 523928 - DNA, 233 bp, Homo sapiens
ttctagaggatcccggaagatgtgcatgtatagagaaaaatcctctacctgttatattccaatgaaaatttgtactttctttgctaatactgataaatcagctaaaaattgatttaatttactttccatgttcacccctattattttttattctttatttctttatactttgttacttgtctaaccattatatcaagcattgcatcaattgctgaataaagactcttatcttt

SEQ ID NO: 523929 - DNA, 198 bp, Homo sapiens
gcgcggaggcggtgaccctgggcgtggatgcctgagctgaacactgtcagtgaggtggtgagatttgccatcctgtggagaatggcttcctgctggagtacctgtgtggccatccccatggcgaaatggccttgactcccaaggctgcttctgcgcaggctgctcccggcagactcggcttctcctttgtacgaccca

SEQ ID NO: 523930 - DNA, 452 bp, Homo sapiens
tatagagcgcacgaactgataatgctatcaagaaccactgtaattctacactgtgtcggaaggtcgaacaggaaggttatctgcagaagtcttcaaaagccagccagccagcagtggccacaagcttgcagaagaacagccatttgatggaatttgctcaggctccgcctacagctcaactccctgccactagccagcccactggtaacaacgactattcctattaccacatttctgaagcacaaaatgactgcagtcatgttccatacactgcagcgctacatgtaaatatagacaatgtcccacagtcagctgccgcagccattcagagacactataatgatgaagaccctgagacggataagcgaacacaggcatttgaattgctcctaatgtcaaacgagaacgagctataaggacagcagctgctaccagcacagaatcacacatgc

SEQ ID NO: 523931 - DNA, 232 bp, Homo sapiens
gctcagggcagcatggactacacacgcatccatggacaagttgcacaggcacaacagcacaagcagcacaaggtcttcaacatgccagagcgcacattgcacatgctcgctccagcaccatcccgtctgcgtatggctgcatccaaatcatgctgcacatttccccatacaccggttgcaatgactcacatctctctcctcttgcacaacacattgctcagcatgcaccagc

SEQ ID NO: 523932 - DNA, 207 bp, Homo sapiens
gagatgttacgttaaaggttggaggttgagatgacatatctgacactctgttgttaccctcagaagctactacatgtgaaattctaatgactgcattatcctgccaagtgaaagaggcaggcatgagcaaggacagttaagaggggtgggagccttatcatgatggggagtcttgttctgacatctttggaaaaacttgtccacagt

SEQ ID NO: 523933 - DNA, 763 bp, Homo sapiens
  misc_feature (176)..(176): n is a, c, g, or t
gttacatatgcagcaatatgctgtttagggagcgcgtggcctgtagtgatagttgaccttggtcttatctgctaatgtcctatgagatcctggatcatagacttatgtagtctctgcgcatgtctcgagcaattaataaataccgactctcggccgtgaaaactgcaagcgtcctntgagataatatcctgtgaatggagttctagaggagtgcaatttaactggtgattctaatctaagcatgtgagttcccgaagctgagctcgagatcagataaacgccgcggcatgagtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttatttggttatactacttttgtataaatggacaataagtcacattctggggggaacaaaaactggaatcgtctgtcatttgtaaagagggggggatctttcatgtgacaacatcagagctacttgttaccataaagcccttactatcaacagataattcatctgtaatcactttttttatcccaggttggaattgctttccctttctaaagttatccttccttaaataactt

SEQ ID NO: 523934 - DNA, 369 bp, Homo sapiens
  misc_feature (26)..(26): n is a, c, g, or t
  misc_feature (130)..(130): n is a, c, g, or t
  misc_feature (159)..(159): n is a, c, g, or t
  misc_feature (166)..(166): n is a, c, g, or t
cacgaggtcgatcgatcggcggatcnagcgccccgcgttgttgacgaggatatcgaccgcgccgtgctccttcagcaccgtctgcacgaagcggtcgcaatcggccatgtcggacaggtcggcggtgtangcgaacaccttgccgcccgcggcgcgcanctcgtcncgcaccttgaacagctcgtcctcgccacgcgcgcacagcacggtgatcgcgccggcttcggcgatcttgcgcgcggcggcaaggccgatgcccgaggagccgccggtgatcacgaccaccttgcccttcacccggctcttgagcgagcgatcgacgaacagatcgggatcgagatggggctcccagtagtcccacagccgcca

SEQ ID NO: 523935 - DNA, 154 bp, Homo sapiens
atataaactcaggatcttagtccgctcggacgatagcttggagggctgtgagaggcggctcgtgccatgatctgtatttaatggttttaatttctcgggtgcatttgagagaagccacgctgtcctctctgagcccagatatgtcctgagcgga

SEQ ID NO: 523936 - DNA, 537 bp, Homo sapiens
  misc_feature (4)..(4): n is a, c, g, or t
  misc_feature (7)..(7): n is a, c, g, or t
  misc_feature (9)..(9): n is a, c, g, or t
  misc_feature (33)..(33): n is a, c, g, or t
  misc_feature (35)..(35): n is a, c, g, or t
  misc_feature (38)..(38): n is a, c, g, or t
  misc_feature (45)..(45): n is a, c, g, or t
  misc_feature (48)..(48): n is a, c, g, or t
  misc_feature (72)..(72): n is a, c, g, or t
  misc_feature (93)..(93): n is a, c, g, or t
  misc_feature (102)..(102): n is a, c, g, or t
  misc_feature (107)..(107): n is a, c, g, or t
  misc_feature (118)..(118): n is a, c, g, or t
  misc_feature (143)..(144): n is a, c, g, or t
  misc_feature (151)..(151): n is a, c, g, or t
  misc_feature (163)..(163): n is a, c, g, or t
  misc_feature (196)..(196): n is a, c, g, or t
  misc_feature (206)..(206): n is a, c, g, or t
  misc_feature (210)..(210): n is a, c, g, or t
  misc_feature (236)..(236): n is a, c, g, or t
  misc_feature (248)..(248): n is a, c, g, or t
  misc_feature (308)..(308): n is a, c, g, or t
  misc_feature (327)..(327): n is a, c, g, or t
  misc_feature (329)..(329): n is a, c, g, or t
  misc_feature (337)..(337): n is a, c, g, or t
  misc_feature (367)..(367): n is a, c, g, or t
  misc_feature (381)..(381): n is a, c, g, or t
  misc_feature (383)..(383): n is a, c, g, or t
  misc_feature (388)..(388): n is a, c, g, or t
  misc_feature (400)..(400): n is a, c, g, or t
  misc_feature (404)..(404): n is a, c, g, or t
  misc_feature (406)..(406): n is a, c, g, or t
  misc_feature (424)..(424): n is a, c, g, or t
  misc_feature (427)..(427): n is a, c, g, or t
  misc_feature (446)..(446): n is a, c, g, or t
  misc_feature (451)..(451): n is a, c, g, or t
  misc_feature (465)..(465): n is a, c, g, or t
  misc_feature (489)..(489): n is a, c, g, or t
tcanacnanaaaagtaaattttatttgttcaananccnaaaatgnaancattaaaaccaagcaaaggctttnattctgtaagcccaaattcanaaattgaanaagancaaagcaaacngtgatccatgtacatggatgaaaannaaaggcncgagtaaatcanattgtagtttttaaatttctacagcctagagcncactagtaanaggncttttaggtccttctggatgtcccanagggtatctgcncttttcttgagcggagcaaccccatcaccctttagcttctggttgaaaacgcgggtaaanccccgggcattgaggaaananggaaggcncaggaagacttcattctcaatgccaaaaancccctttaccattntngaaangggaggaatccnggananatttttcaacatggattnaanaagaacagccacacttaanccaanagcccagtgggtanatccttttagcttgaggacttcanaggcactttcaaccaccaccttatgcacttccttccaattttcactat

SEQ ID NO: 523937 - DNA, 327 bp, Homo sapiens
gcccctgggccccaagaagggggcccagtttcctcctggggaagaaggggtttttacccaaaaccgtttttaaaaaattccgaagaaatttggtgaaaggaaaaagaatgcccaaatcccccgttttctgggggggccgttcccgcagggcaagctttttgggggcatcgcttcaaggccggggcaggggggccgggccgatggttttgtgttagagggccaagggttggggttttttttttgggaaatccggggccccaaaggccaattaatccttgttttgttttcccccctgtaataaaggggttttttgttttgttcccccca

SEQ ID NO: 523938 - DNA, 574 bp, Homo sapiens
  misc_feature (105)..(105): n is a, c, g, or t
  misc_feature (144)..(144): n is a, c, g, or t
  misc_feature (149)..(150): n is a, c, g, or t
  misc_feature (176)..(176): n is a, c, g, or t
  misc_feature (260)..(260): n is a, c, g, or t
  misc_feature (274)..(274): n is a, c, g, or t
  misc_feature (276)..(276): n is a, c, g, or t
  misc_feature (292)..(292): n is a, c, g, or t
  misc_feature (297)..(297): n is a, c, g, or t
  misc_feature (323)..(323): n is a, c, g, or t
  misc_feature (391)..(391): n is a, c, g, or t
  misc_feature (409)..(409): n is a, c, g, or t
  misc_feature (469)..(469): n is a, c, g, or t
tatagttgataccatcgcatgagtggtcccaaagccgtttatgcagttaagcaccagtcgtattactcgatgacaattagttggatgccactaataggttgacgntctgaataattaattataagcttacagagcatctgtgtncacannggtctggttcttacacagagactgtntcgtctgtgaggcatgaagtaatagagcattgcctatgccctcgtagtgattacgtgtgtggtgatagaggacagccttgtacnctatctataggtgngntgatcgatcattacantgtgngtacacatagcatcgtatcacgtatntcacagacgtagatgtaacacacggcagctcgtctatagagagatatatacgtagatacaagactttntctttcaactgctgttancttacattggttgtattaataaaaactacggcctcgtaagtaaatgtaactatggcttgnctatgtacgttacgtaagtatcgcactgtaatcttgaatggtatctcagactcgttagtttgtatacagactcattgtactaggtagacaagtagacgacttacg

SEQ ID NO: 523939 - DNA, 563 bp, Homo sapiens
  misc_feature (5)..(5): n is a, c, g, or t
  misc_feature (122)..(122): n is a, c, g, or t
  misc_feature (142)..(142): n is a, c, g, or t
  misc_feature (177)..(177): n is a, c, g, or t
  misc_feature (182)..(182): n is a, c, g, or t
  misc_feature (191)..(191): n is a, c, g, or t
  misc_feature (195)..(195): n is a, c, g, or t
  misc_feature (228)..(228): n is a, c, g, or t
  misc_feature (239)..(240): n is a, c, g, or t
  misc_feature (242)..(242): n is a, c, g, or t
  misc_feature (246)..(246): n is a, c, g, or t
  misc_feature (254)..(254): n is a, c, g, or t
  misc_feature (322)..(322): n is a, c, g, or t
  misc_feature (334)..(334): n is a, c, g, or t
  misc_feature (337)..(337): n is a, c, g, or t
  misc_feature (342)..(342): n is a, c, g, or t
  misc_feature (349)..(349): n is a, c, g, or t
  misc_feature (385)..(387): n is a, c, g, or t
  misc_feature (412)..(412): n is a, c, g, or t
  misc_feature (435)..(435): n is a, c, g, or t
  misc_feature (473)..(473): n is a, c, g, or t
  misc_feature (479)..(479): n is a, c, g, or t
  misc_feature (495)..(495): n is a, c, g, or t
  misc_feature (540)..(540): n is a, c, g, or t
aaggncacacacggcccgcccagagacacaagaccacgagccgagcggggaggggagcggggcgggggggggggccggagggggcgggcgggagacagcgcccgcgggaaaaagcccgacgnaaacacaggggacagaaganaggggggaccgagggcagagcagaaacggacaggngcccngcggccggngggngggcgaagggggaaacggggagaacgggcgggncacagcggggnngngggnggaggggncgggggtggggggaggggggggagtggagaaaggccagagtggggagagaagagcgtggagtagtcanccagtgtgtgtnggncaggnagggggnagcacaggggggggtagcgtacgtgggggcaggaannnaaccaggcggcagggggggggagcnaggggaagcgggagcccagaggnggaaccggggggaggggggagggccccagagaaaaggnacccgngcaggcacggcaaggnagagacaacgggaaaggggaaggccccggggagggggggggcaangagagaaggggcaacaggggcag

SEQ ID NO: 523940 - DNA, 1269 bp, Homo sapiens
gcgcgggaatgctgccgcgatgggttgacagctctccgccacatcttccacctctcttgtgtccaggcgagctgttgcctggtgccctagggtcaatctggaggtgctccgactgtgcgcggacgtgagcgaagcgccgagccatgggcaccaaagtgggctatccactgccactggaagagctgaaggaattctttgccaatggcacgggctggctctgtgcggctcatcaaggttgtgattgaggacagagcagctcgtgctgggtgcctcgcaggagccagtaatgccgctgggatcaggactatgacagtggccgtgctagccacttgctggactgcccagcagccctgctacctgatctacctgcctcgactcacagaattgctcagtggcttcgaatggctcttacctcgacatggtcgccttgataacataccccctgttgcggcttgaaagattgctgtaccgccgggacaccgccgagtgccaccaggtgaacataacgtgaggttagggaagggtgggccacaattccaacgtgattgaggctctttcgggggacctgatgcacaggggaattgaccctcgtcgttatttgcctggggttaacccgatggataaacaagcgcttggtaacggatacgctttgtttgctgtgcaacccttttgcacgaccgtgcttggaaccttcgaggctttgacgcaagcatggaaggcatccccatgctatggatatcccgggcatttataacgctgaagtggttgagatcagcgacctggatgaatttcaagagttgggttgggaaagaaatgggcccaacatgggcgcaagtctaaaaaggaaatcgcccctttggcacaagtggggtcgcccgttcctaggacccttttttgccccgccctccttgttgttcatgctgccccttttctacgtcgtgggcgccccacatatggagtgtgtgggttgagaacgattcctccagagtgctgaaggtagcgcgttctacaaaacgagggaccagcgggataacacaaactttggtggtgtcccaaaatcacgtttatatcggcaatttttccccaacgcgaacaagttggagatgcaaggcgcctgcttgggcagcaacccgccattatagcgaatcggacgccgggtagggagaagaaacacgcccatgacagtaattgatgggctagcaacacttcggagttgtctagcccacgtcgcaccacaacggtaaagtagtcacacgcctcacactgtgg

SEQ ID NO: 523941 - DNA, 286 bp, Homo sapiens
taaggaggacaaaggtacattatcaaaaaatcatgattgagaaaggatatgggtacatataagattgtattgttttgtttttgagactgagtctcgcgatgtcacccaagctggagtgcagtggcacaatctcggctcaatgcaacctctgcctcctgggttcaagcgattcttgtgcttcagcctcctgagttagctgggattataggtgcccgacaacacgcccagctcatttttctattttaactagagacggtgtttcaccatgttggccaggctggtctgg

SEQ ID NO: 523942 - DNA, 264 bp, Homo sapiens
  misc_feature (160)..(160): n is a, c, g, or t
ccactttcatagtagagagatggcagccatttctttgtcccgtgagtctttttccaggtaaccaatctgccctttgtgaagaaaagacaaaggtagaaaggatggtggaggacaagacagaaggctaagaacaggaaggtaatcttgtgcacctgacaanatagaaagaataaaggatcaaaaattgaatgcagtctataagagtatcaagaaattcttagaaaaccataaagtgatttggtagcacaaaacttacagttaatg

SEQ ID NO: 523943 - DNA, 162 bp, Homo sapiens
  misc_feature (34)..(34): n is a, c, g, or t
  misc_feature (133)..(133): n is a, c, g, or t
cccccaaaaaaggtttaaacccctttaaaaaaangcctttcaaaaaaggggaaagttggggggcaaattttttaaacgggaaaattaaaaaccccccccaaaagtttttttaacccggtcccccaaacaaaanccccaaaaaaaaaaggttttgggggtcca

SEQ ID NO: 523944 - DNA, 429 bp, Homo sapiens
cgggcgccgggggtcacacctattgtcctagttctttgcaaggctcgggtcgtgacgacacgtcaagagttcaaggccagcctgaggaacatactgagtgctcgtttatacaaaacatacaagagttgggcagctgctgcggctcacgcctgtatgccagactgtgggggtcaaggtgcacggatcacgaggtcatgagttagagaccagactgtccaacatggcgaatccctgttcctactaaagatacaataaattagctgggcgcggtggtatgcacctatagtcccatctactcgccaggctgaggctggagaaactcttgcacccggtagacgtatgatgccgtgagtcgagatcgcaccattggactccagccagggcgagactccgtctcaatattattagccggcgtggtgccgcgtgcct

SEQ ID NO: 523945 - DNA, 252 bp, Homo sapiens
gggggggttttttttccccctttacctagcccgggggggggaaggatttccggtggaccaggttgtcttccccccctaaaagggggggaattggggtttggtctcccccccccccatggatttcccccttttttttttttttcccttttgaacccccccggtttccccggggccccgggttttttttctcccccaatggggaaggggcggtttgttttttttaagggttattaattttgggttttttcttga

SEQ ID NO: 523946 - DNA, 450 bp, Homo sapiens
gagccaaaagagaattttttttccttttaaaaatacattggttcagcaggaaaaaacattttaaaaacaagctttttcatattaagtggaaattaaaaacaatggcttttcccccgccaacttatgaggaatagggctggtcagcaatagatcttttagtgcttccaatatgtttttaggcctttgtccccagtctgttccttgtcttccacagaaaggagttccaggggaaaaaaaaattagaatctcaccaaaacagcttcctaaatacagatggaaaaataagagggggacacgactgtttcgatttaatttatttggtagactgtgcaagatattttaatatttaaaattttcagtgggattaaaaccaattgtttaaacattcattaaacctttgagggtttaaatgcctaacattttaaaaaattccctcgtgccaaaattcct

SEQ ID NO: 523947 - DNA, 163 bp, Homo sapiens
cagaaaagacgctgggcctggcaagcggggcagtagcggcttccgggagagtttttggcctccacacggctgcgtcgggcgccgcgctctttccggcagcggtacttttgggagacgccgggaacccgcgttggcgtggttgactagtgcctcgagcctcagc

SEQ ID NO: 523948 - DNA, 87 bp, Homo sapiens
  misc_feature (24)..(24): n is a, c, g, or t
cattggataagcggatgagggggngatcattcagttttacttttctttttgttgaaattttgtacccggaatcgcctcagttgatag

SEQ ID NO: 523949 - DNA, 149 bp, Homo sapiens
aaccccagccttcggcccggaagtttactaaggcggacccatggtttccaactcatatgtagtaaaccccgtcaccctctcggaagatgaagaagtagataacctcatagcccttgatagcatagtactacatgtaccagttgtactcc

SEQ ID NO: 523950 - DNA, 276 bp, Homo sapiens
gtatgtaaggaacggtagtgtagtgagtactcttatgagaatgtgtagcaagtgatgacaataataattgcaaagtactatagaaactgcagagcaaatgccgtggcttcatgatcctgaagggaaaacttctgatggtagctatagtaactggccagttacaaagcttatataggagtccttagaaaacagtacgggaacctatacggtagtataccacccagatatatgacacacctagcaatatcatcaaattactaacgtaacctaccaatc

SEQ ID NO: 523951 - DNA, 1068 bp, Homo sapiens
gatcctgcatggcgatcacctacagtctgtgtcgtggcaacatggttgctgtgcgatgtcacactatactctcgaggcacatcatgctatctcaacgcaccattcttgagctttcgcatgcgggtattaatgcacatgcttccgatcttcctcggacctgcgcggcgggtaggctagtgcttcattgcgctgataattccctgactcacttgttgtaccttgtacaggcacgcgccggtatcgaacgctgaggcttccacgtacgttgtacagaccaagccatgtgaaccaaccactggatgaagaatcctcagattcttacctaaccgaatgatgaaagagttgagcgcagcgaatggctggcatcacagcctgatagctgcacaggctatcttagcgaacgtcatgatgcgtctgcgtgagaactctaccttatttaaccgcacccagggagagttcaaaaagtggtggcgtccatggtgaaggcgtgggatgaatgcacgacttttattgtccagctgcgacaattcgcgtgggcaggcgcgacagaagaaagggccgaaagaggtcctgaatgggaagcgatactccctgaaaagaatggccaaaaaaacacaagacggatgggctgtgtccggcggcctcttctgtcccagcggacaatacaatgacaggtcccaagcctgtcaggcattgaggtggggcgtggagagacccccgccaaggagcgtgccattggaaacaacgcttgcccaatgggccgctggtgacgcaaaaaaaaagcttgatagcgcgagggcaccctacttgtgtggatcgtgtcaattggcccctggggggatacttaagcccgggcacggggggggcccccccaaatcgtcttgtttgtacattcccatggtgacagaacctccgagttgcctcaggaattgaaggcgacaggtgagggctttcattccaacggaaaggattgggcttgaccacgcctttggaagcatatactaccatagggctggcgggggtgagtggcgcgcagaaggactgggcggtctgcggcggggacgtaat

SEQ ID NO: 523952 - DNA, 354 bp, Homo sapiens
atattatactagcattcaccatctcacttctaggaatactagtatatcgctcacactcatattcccccaaaaaatggagggattatacttttggttgtcaatataggcacctttaaacccccaacacacccactcctctctaggcacatatatgtgtcgccctatgcgcacatatttggctcttttcccccccctcgcagagggagtgcgggctttacgccatctttaggtcaaactccccaaaaatagggtataccaccagcagcagcataccataacctcctactaccagtaaaaactactaatcggcccccaacatttattactactaccctcacttctctccaccaaaca

SEQ ID NO: 523953 - DNA, 395 bp, Homo sapiens
agaagtttctgagaatgcttctgtctagatttgatctgaagacaatcccgtttccaacgaaatcctcaaggctaggcaaatatcctcttgcagattccagaaaaagagtgtttcaaaactgctccttcaaaacggtggttcaattctcttagttgagtacacacatctcaaataagtttctgagaatgcttctgcctagttgttacgggaagatatttccctttccaacataggcctgaaagcgctccaaatgtccacttccagatactacaaaaagagtgtttcaaacctgctctaccaaagggaatgttctactctgtgacttgaatgcaatcatcacaaagaactttctgagaatgctgctgtctgctttttatatgtaatcgcgtttccac

SEQ ID NO: 523954 - DNA, 370 bp, Homo sapiens
catgttacagttgctcacgcctgtaatcccagaactttaggaggctgaggcagagaatcacttgaacccaaaaggcagacattgcagtgagccaagatcacacccttacacttcagcctgggtgaccaagactccgtctcaaaaaaaaaaaaaaaaaaaaaaaaaaaaccaggtgttgtggcatgcagctgtagtctcagttcctagggaggctgaggcgggaggattgtttaagcctgggaggttgaagttgctgtgagctgtgattgcaccagtgtactccagcctgggcaataaagcaagaccttgtttcaaaaagaaagaaagaaattagcatggtgggaatggggacagatggcaatgttaagta

SEQ ID NO: 523955 - DNA, 174 bp, Homo sapiens
  misc_feature (19)..(20): n is a, c, g, or t
  misc_feature (25)..(25): n is a, c, g, or t
  misc_feature (28)..(28): n is a, c, g, or t
  misc_feature (39)..(40): n is a, c, g, or t
  misc_feature (61)..(61): n is a, c, g, or t
  misc_feature (90)..(90): n is a, c, g, or t
  misc_feature (103)..(103): n is a, c, g, or t
  misc_feature (108)..(109): n is a, c, g, or t
  misc_feature (138)..(140): n is a, c, g, or t
  misc_feature (167)..(167): n is a, c, g, or t
ggaggcgggcggcccgggnnccaanaanaccccatgganncccccagcacggggcgctganacccccgcgtcgctgcccagcccggtccngcgcgccacgcanagggnnatctggacaggacaagactccgaagcaannnccccagcacacagcccgggacccacanacccagc

SEQ ID NO: 523956 - DNA, 339 bp, Homo sapiens
  misc_feature (103)..(103): n is a, c, g, or t
  misc_feature (105)..(105): n is a, c, g, or t
  misc_feature (337)..(337): n is a, c, g, or t
cccaggaaatatgatcctatatggttcccttaaaagattttccaatacactgaaaatttagttccttatgttcattgtataaaaatcttaggccaggcgcggntntcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattnca

SEQ ID NO: 523957 - DNA, 89 bp, Homo sapiens
taggaggaagaaggtggggaggaagaggaggaggaagaacaaggtgatggtgacgaagaggatggagatgaagatgaggaagctgagtc

SEQ ID NO: 523958 - DNA, 298 bp, Homo sapiens
  misc_feature (32)..(32): n is a, c, g, or t
  misc_feature (39)..(39): n is a, c, g, or t
  misc_feature (62)..(62): n is a, c, g, or t
  misc_feature (137)..(137): n is a, c, g, or t
  misc_feature (155)..(155): n is a, c, g, or t
  misc_feature (163)..(163): n is a, c, g, or t
  misc_feature (181)..(181): n is a, c, g, or t
  misc_feature (190)..(190): n is a, c, g, or t
  misc_feature (214)..(214): n is a, c, g, or t
  misc_feature (223)..(223): n is a, c, g, or t
  misc_feature (225)..(225): n is a, c, g, or t
  misc_feature (237)..(237): n is a, c, g, or t
  misc_feature (246)..(246): n is a, c, g, or t
  misc_feature (251)..(251): n is a, c, g, or t
  misc_feature (254)..(254): n is a, c, g, or t
  misc_feature (258)..(258): n is a, c, g, or t
  misc_feature (281)..(281): n is a, c, g, or t
gttttccttagaaatttaggtgagagattttngcctttnttattggataaattgggccaganaggcagggtagatttcgaagcactggttctgttgaagttaagtttattaagcctgggaacattaaaagctaattnataaaagcaatacttttnaatatganacttactgcaagtttgtntatactttngcctaaaaaggaaattggatgggnatactgtgnanaatcataaaacnccagtatanttganctntgangttatagaaaatcagagaggggnaagtttatagggcattt

SEQ ID NO: 523959 - DNA, 145 bp, Homo sapiens
gtggattaactggcatccctccatctagttctcctgtagatcctccctggaatcttccaccactcttctcccccactctaccccctcaactgcctcctggacctcttcccacccactccagccccttgcctggagcctggcggac

SEQ ID NO: 523960 - DNA, 124 bp, Homo sapiens
tctcacgaagatcggcatcccacctctaagagggagcaccaggggcagggggactctttcgggatgtggtagtcagacagggggcgtccatcttccagcggttcccagcaaagatcaacctcgg

SEQ ID NO: 523961 - DNA, 210 bp, Homo sapiens
gtgagagtgggaggattatggagctgcagtctgtctccgcggctgaagtggtgtccagcctaggaatttgagatcccctcactcctcctcacaagaggtcaggcttgcaattgcatcagaaaataggatagtattgtcagggctaacacgagaccaagggctccaactataacacaatctctctggaaacttcaaggctttacctattaa

SEQ ID NO: 523962 - DNA, 242 bp, Homo sapiens
aatgataggggtggggaacacggaagaagagaaaagaaccagaggagagaagagagctagtgtaggtatattctctgacaacttaagggagtttaaagggattgctaagagattaaccaggacagataaggtaagggctacccgtttttatgtactaaagaggttactaggtgagctttatggagtaatgtccttgtgtatccatacctctcatgtaagagtgagatcgacgtaggagttcg

SEQ ID NO: 523963 - DNA, 692 bp, Homo sapiens
  misc_feature (20)..(20): n is a, c, g, or t
  misc_feature (31)..(31): n is a, c, g, or t
  misc_feature (322)..(322): n is a, c, g, or t
  misc_feature (498)..(498): n is a, c, g, or t
  misc_feature (523)..(523): n is a, c, g, or t
gccagggtggccagggtggnccaggttgccnggggtgggagctaaaatgcgttcccccccggggttttttttcccggggagcagcaagccctttttggggccgttctgtgggttccgacccaatattgggggggcaaaaattacggggcctttcaaccgacaccctttcccccccctgggttttgcatgccgggttcccgctattagcttggggcggggccatttgggcctggaaaaacccagcttatttttatttttgggtgcccacccccccccccggttgtttggtgattccccttgttttccaaaaaaccaagaaagnacccaaattggttttgggccccggggggccctcccccttggagggaaaggggggggggaccccctccctgggttttttcaccccccggggtccccccccccccttttttttgggttttttaaaaaagccccccccgccccgggggggattttccccgtcccccctatgggggtttncccgggggccccccccggttgggantgggaaggttttcccccccggaaaaaggggttaaaaaaaagccccttttttaaaggtaccattcttccccccccgggggccccggtaaaaaaaaccccccctttagtttttttgggttttcctgttttttttttccccccaaaaaaaaaaaaatcccggggttttttta

SEQ ID NO: 523964 - DNA, 1549 bp, Homo sapiens
gggttaccgacgcctcgctctgtgttcgccagaccagcagtcgcgccctgagcaatgcggtggcagggaattcgtgaccgcagtccagacgctgggccggcaggatggcaccggcgcaccgcgtcgcgtgactgacgtcgcgtgtgtagcgctgggcgtctcgggggcgacctgggcattgcgacgctggtgcgcgcgatgcagttgtaggaggactagggctgctctggtgtggatatcattggagttgcgctttgtgtcgaatgtactaatctaatccctcgggagatccgttgcctcgtcagtaccgatacgaactagatagcatcgatagacacctgacatactacgtagtaatcagccgcaactttcgtcccacaattgacgcgtcctgaggacgtctagttgtcccaactagcgacataggtaattgcacaagttccttggcgcctccattgtctcatttcgaaagattctcttacacagttgacctagcgagatttgtcacgaagaaggcgacagggattgccggttagactagtagggccgtgtatggtatagggactagaccctgggtccggacgcggtggatcgcgcaaaatccacaaaggacgacggggcggagaagtccattcgcagttttggctaagaacaagtggctacaacacggcgtgtgtttcatgactgggtcctacatcggtcgtgatggaggctttactacgtccccagcaagtaaacaacacaacttacaaagtgttgttcatacttcttattgcccttccctagaagcaacgaccagtgaccggtagggacttggacgcttcatcgaagacagttcctccttggtaccattgcgcaaaccacccgagatcttccacccgggggaacgttatcacagtggcacgctctggctacccatcgggacccaatcctaccaaacaccaaagagaacctaagctcacgacttgcaacgccacatctacaccctgggggcactgcgcttggtaatgggtcccccttcccaatccgactgtctgctatacacccagaaacaacgacctgccgcactcacgggaaggacaaggcagccaagccgaatgggcgcccaggctctcccacaggtgggacactcgagggttacgaaattcacccgtgtatgggtctcaaaccatctctgcacttggcaaggtgccccacgaattatataaacacacagcccaggagatctcccaaaaacacacggcccagcataggaccagtcagcaggtacacacaacagcgagaaacaggacaagcggacccaccaaagacatccagatcaatacaccaccggcggagaagggaaatccacagaacgacaggcacagcaacagcacgaagaaaagcgaccacctagcacacccgcaacccccagcacacacacaggcaccagacgcccccaacgagcatcacaacagccagagcataaccgcacagactcatagcaccgccgaacgaagcgacgtccacaatgcagaccacgccgccaaccaacacgcacaacgcagct

SEQ ID NO: 523965 - DNA, 1059 bp, Homo sapiens
  misc_feature (4)..(4): n is a, c, g, or t
  misc_feature (91)..(91): n is a, c, g, or t
  misc_feature (96)..(96): n is a, c, g, or t
  misc_feature (111)..(111): n is a, c, g, or t
  misc_feature (118)..(118): n is a, c, g, or t
  misc_feature (138)..(138): n is a, c, g, or t
  misc_feature (260)..(260): n is a, c, g, or t
  misc_feature (263)..(263): n is a, c, g, or t
  misc_feature (354)..(354): n is a, c, g, or t
  misc_feature (475)..(475): n is a, c, g, or t
  misc_feature (500)..(500): n is a, c, g, or t
  misc_feature (511)..(511): n is a, c, g, or t
  misc_feature (522)..(522): n is a, c, g, or t
  misc_feature (525)..(525): n is a, c, g, or t
  misc_feature (534)..(534): n is a, c, g, or t
  misc_feature (538)..(539): n is a, c, g, or t
  misc_feature (549)..(549): n is a, c, g, or t
  misc_feature (554)..(554): n is a, c, g, or t
  misc_feature (561)..(561): n is a, c, g, or t
  misc_feature (569)..(569): n is a, c, g, or t
  misc_feature (574)..(574): n is a, c, g, or t
  misc_feature (586)..(586): n is a, c, g, or t
  misc_feature (593)..(593): n is a, c, g, or t
  misc_feature (596)..(596): n is a, c, g, or t
  misc_feature (610)..(610): n is a, c, g, or t
  misc_feature (615)..(615): n is a, c, g, or t
  misc_feature (618)..(618): n is a, c, g, or t
  misc_feature (621)..(621): n is a, c, g, or t
  misc_feature (624)..(624): n is a, c, g, or t
  misc_feature (628)..(628): n is a, c, g, or t
  misc_feature (635)..(635): n is a, c, g, or t
  misc_feature (638)..(638): n is a, c, g, or t
  misc_feature (644)..(644): n is a, c, g, or t
  misc_feature (646)..(646): n is a, c, g, or t
  misc_feature (657)..(657): n is a, c, g, or t
  misc_feature (670)..(670): n is a, c, g, or t
  misc_feature (715)..(715): n is a, c, g, or t
  misc_feature (738)..(738): n is a, c, g, or t
  misc_feature (756)..(756): n is a, c, g, or t
  misc_feature (759)..(759): n is a, c, g, or t
  misc_feature (797)..(797): n is a, c, g, or t
  misc_feature (802)..(802): n is a, c, g, or t
  misc_feature (806)..(806): n is a, c, g, or t
  misc_feature (818)..(818): n is a, c, g, or t
  misc_feature (822)..(822): n is a, c, g, or t
  misc_feature (850)..(850): n is a, c, g, or t
  misc_feature (870)..(870): n is a, c, g, or t
  misc_feature (888)..(888): n is a, c, g, or t
  misc_feature (899)..(899): n is a, c, g, or t
  misc_feature (938)..(938): n is a, c, g, or t
  misc_feature (952)..(952): n is a, c, g, or t
  misc_feature (973)..(973): n is a, c, g, or t
  misc_feature (990)..(990): n is a, c, g, or t
  misc_feature (1033)..(1033): n is a, c, g, or t
aaanaaaaacataaaaagcgataaatgataagataatgctatttaaattaagcacagtgattggaatactatttatagaacagtataaaanatgtnctccatatgccttcnccatggncctctaagatgttagaaganacattagtaggtgaaatgtaagggtaggtagttgcctttttcagcgaattgagaggcagggaaacacagtggcaaacacaggcaatatccattgttgcttaagaaagtgaagaattttcccntcntccaaagtattgacaaagatggtgatttttgttgtagccttgaacctgagactaaatagtatatgttgactaaataatatatttgattggncttcaaactggaacattaatttgaaaaggttaatcaaaatttcattggtttataactacacataattaattttctttaattaataactgttggttttctttaaatcttgttgaaaaatatnccatagaattggaaaatgtgttttntgtttttaacntttttagaaantgncccatttcntgtnnttttcaagtnggacnttttatnatgcaaancattnatttttcctttnacacgtnaanacaaaggcatggtnagttncanttnatnatgntttcacntanttcaancnttttaaattcntgtccaatagatnttttcacacttattcctttaaattatacatagggagtttttagtngttcatttcacccatttgttaanatgaggaacttggaaaanttnaaaaaccccatttggaaaaagaatttctgtaaaggggntcttncccnagacttttgganaaantttttttttttagtaaacttttaaatgnctaaacattatggcttggtnatttagaaaaggaagggnaaataaaaggngaaaaggaaaaataccaggttaaataaactacaattctnattattattacaanccagggtgggttttggtgatnactaaatgcataaagangagtaggggcattttgtttagaaccacagaactgatttagggnttctgggagttttttcatattccttc

SEQ ID NO: 523966 - DNA, 206 bp, Homo sapiens
aaggcatgacggaagtccagtgtggcacagtcaccgtccacgttacagtgctcctcggacagcaccaacggcacgggggtacacggagggccagatccctagaacttatattctatcacgtgacgagcacttccccagagcgtcggatgtgggctcctgaggtgcacatacacatccacatccgtcccctgcttgcttagatgcta

SEQ ID NO: 523967 - DNA, 466 bp, Homo sapiens
  misc_feature (30)..(30): n is a, c, g, or t
  misc_feature (62)..(62): n is a, c, g, or t
  misc_feature (80)..(80): n is a, c, g, or t
  misc_feature (443)..(443): n is a, c, g, or t
cggagaacagctctcaaatccaccttcccntgaagaccaaggcctcggggatatttatgggnttaggggaaagccagggntggtcctaacgttgtgggggaaaaagttgattgggccaatgggggaaaaaaaatgaaagtaaccaggttccattctgccaccaagccattagtcgggggttcattgccatctcaaaggaagtatgttcagtaaatggcagcattagcgtgatctgggggaggtggagcttttggccctccaatgtcaaaaggccacctctccggcacttgctcaggcccagttgaaggggcagtggtcctaactggtttgaactggacaggagcttgccctagtttctgaaaaacaactgttgcgaccattaccgtggtgacctatgaatgttatctgtaaagtagccagtgaaggtcaagttccagcattcnagtgcaaggcctcagcttcatgg

SEQ ID NO: 523968 - DNA, 1482 bp, Homo sapiens
  misc_feature (988)..(988): n is a, c, g, or t
  misc_feature (1262)..(1262): n is a, c, g, or t
aatgaaccaccagtcatctgcgtatcgatactagttacaagctcagctctatgagggccacttatgagtggagcctctcgttctacgtgcgcgtgcacgtgaaatgcaagcgtacctgacacttaaggactcatggtggaaatgtttcaccttttcctatctgcccgaataaagctgacttccctacgaattaactcagtgccacttagcatgatactctacatcgactacttaacctcaatattacccaaatgaatggacgcagtactagtagacagcgtaggcaagaggcaactagttaaccacaggcgacaaaacaagctacccaattcatcgcgtgggtctcatataccaaatgaggcacatataccggaggtaaccagagtggagtcaaagtccccttgaggtgctcattttcattccctacgaggcataggtgtgcaaaatgctcctttcctggaatgcgcatatttcttcttgaccacctattgaacgtatgtactcaggcttgtatagctgcttgtacccttgcgctgattgtccttatgggacgagagtcagctgggatccctccaaagcacgagcgtattcaagtccactggtgtcatgagtccccgcaataggaaattattccaccagctcgcatactgagagaaacatcgcggctatctaaacactcgtgcgatccactaacacgtctatgtccaaaattcaacacccctgtggcccttcacccgtggtagtaactgatacttagatatcgcccattatccagaattcacaccaacacgtcattttatcccatacggtcaaaactttggctttgcaatttggaccggaatattgtcggtctggtgagtgaatactacctcaatttcttggtccctctttcaccttaaacaatatgaccctttgccaggaagtaaaccccgtagcgagtacgcttcacctggtacacactccggagtgctaaccggtgacgccaggnactttactatgaagaggaggggtatctacagcaatcttctttatggggaggttacgagcccaaacaattgggaacatttttccacggcgtggctttacacagaacagaggtcgcacgtctacatttagtgtaaacaataggggttttcacattccacagtatatggtgcggtttgcatggaccaggtccccaccagtgaactctgcactggcgacagctttgtgtgtacgctgagttaaccgattaaaatatcctctcaccttctctcggaggnccattttgcgttgaagaagacacgtgggtctgacacgtgtgtgattacacgtgggcgctacacttttcctgagaaagcaaatttgcgtggatactgtggaagctagagtgtcgacactggctgacgttgtgaagtcacacacgagtatattgtacgtcacgtgagcgggtatatatacaggagaacacacatagaagaggatagttgagaaacaacagga

SEQ ID NO: 523969 - DNA, 890 bp, Homo sapiens
  misc_feature (6)..(6): n is a, c, g, or t
  misc_feature (226)..(226): n is a, c, g, or t
  misc_feature (246)..(248): n is a, c, g, or t
  misc_feature (250)..(250): n is a, c, g, or t
  misc_feature (258)..(258): n is a, c, g, or t
  misc_feature (339)..(339): n is a, c, g, or t
  misc_feature (391)..(392): n is a, c, g, or t
  misc_feature (433)..(433): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (474)..(474): n is a, c, g, or t
  misc_feature (476)..(476): n is a, c, g, or t
  misc_feature (495)..(495): n is a, c, g, or t
  misc_feature (506)..(506): n is a, c, g, or t
  misc_feature (517)..(517): n is a, c, g, or t
  misc_feature (527)..(528): n is a, c, g, or t
  misc_feature (532)..(532): n is a, c, g, or t
  misc_feature (558)..(558): n is a, c, g, or t
  misc_feature (560)..(560): n is a, c, g, or t
  misc_feature (620)..(620): n is a, c, g, or t
  misc_feature (636)..(636): n is a, c, g, or t
  misc_feature (744)..(744): n is a, c, g, or t
  misc_feature (751)..(751): n is a, c, g, or t
  misc_feature (777)..(777): n is a, c, g, or t
  misc_feature (804)..(804): n is a, c, g, or t
  misc_feature (806)..(806): n is a, c, g, or t
  misc_feature (811)..(811): n is a, c, g, or t
  misc_feature (879)..(879): n is a, c, g, or t
tatatnaaggctgaaggaaaaccatatctggataaagtttaatgttcactgagcatgacctaagactactgggagaaagttaatttccagcactcattttaccaaacctatgtaaccctgatcagggatccctgagttagctccagagctggaacagacagggcaaagggactgagcctccaaccctgagcagtggccaggcactcgacatgacaagctggaagancctgaagaacgagctctcannngngatttttnggaaagatcctccacgactcctccagacgctcagtccagggccgccaggttcagccaccctccccgctgtctctatctgtngccctgccaccagtcactcaacccgactttttggtctagagtaagagcagcnnctgtaccccaatggcacagcaaagcaaatccccctacatgnaccatgcaaggtcancntnggcagctcagtgaaggcaacanantccagtgcaggtccacaangtccccctgcnggacgcctgtntgcaggatgnngggnggagggaactgaattggaagccaaangnggagggcagctgggagcaggagcccctagcccttttcagaatagggcaaggtactcagancttctgactctgaggnagaagtacaagaactcctttcactgcagaagtatcccaggacttaagccatgggaagaattcacaaccttgaagtcagaagtgaaataaactgtgtggagtccaaggnaggaggntgcctccagagcagaaggaaatggangggtggaggtgtgggcaggaatgcagnanaaganaaaaaaaaaaccacctccacttccacccccaccctcttgctgctgtaacttggagggtaatgaaaggntgtgcataaga

SEQ ID NO: 523970 - DNA, 185 bp, Homo sapiens
ttctcctcctcttgcactgacttatttctcattagaagcaggtgtcaggcgaagagaggacaacaaggtcaaggaagtgaggcagactggagtatacagagcccacatattcttataaagaacatcactttgaagggggacagatatgtgggcgacgcaaacaatgagctagacacttatgccat

SEQ ID NO: 523971 - DNA, 357 bp, Homo sapiens
cgaggaacgcactcacagtcgaatcataatcctcatctcaaggactatacacactctactaccaataatagctagtttgatagacatctagcacgcctcgatacaactcgcctataacccccaatattaaactactgggagaacactactctgagctagtaaccatgtactcctgatccaatatcactctcctacatacaggacacaacaaactagtcacagccctatactcttcttctaccatattacaccaaacccggctcaataatactggatacaaagtaagagacggaatacacaacatgtagcccaggcttgatactaccaaatcctgaaaaaaagagacaaacctcctga

SEQ ID NO: 523972 - DNA, 153 bp, Homo sapiens
tactcgaacccaggaggtggaagttggaggtggtgaccgtggagacgtggcaggagggctccctcaaagcctcctgcctatacgggcagctccccaagttcaggacggagacctcacccggtaccagtccaataccatcctgcgaacctatga

SEQ ID NO: 523973 - DNA, 420 bp, Homo sapiens
  misc_feature (127)..(127): n is a, c, g, or t
acgcgtccgcccacgcgtccgagcgatcctcctatcttggcctcccaaagtgctgggattacaggcatgagcaacagcacccagcctagtcataagaataatggattttaaacaaggtctgttgcantttactggaagtccactccaaaacctgattgcctgggtatcaccagtggaggctgcagaacaacaaagattcctgcctgcttcttcctctggaagctttgtgtctggaattgttacccatggccaaccatggcccaaagatattaatggaaaattccagatataagtaattgatgaattttaacgtgtgtgtcattctgagtaatgtgatacctgtaccaacctgctccatcctacctgagacatgcatcattcctgttttcaagagaccatcaagcttcagataattatatg

SEQ ID NO: 523974 - DNA, 398 bp, Homo sapiens
  misc_feature (35)..(36): n is a, c, g, or t
ataacacaaaattccttttgcccataaaagacccnnccttttagtggggcccaaagaggggtggggaatttttttctcgaaaaagggtttttccccccccaaaaaagcccaatttaaagggggaattgtgtccgcccttttaagttaacccccccaaaaggggttttggcccaaacacaaagtgttggtttttaaaatggaaaccccccggttggaaaaatagggtttttcccccccccggggtttttttaaaaaaaaccaaaggtgcctttaaaaggaatttaaattagggaaagggctgggggggggaccccgggtttttttaaaaaaaacccggttggctttggggtttaaacccgggaacctttttttaaaaaaggttttttcggggttcccca

SEQ ID NO: 523975 - DNA, 151 bp, Homo sapiens
tgattgccggccacctactcatgcaccttattggaaacgccaccctaactatatcataccattaactcttccctctacacttatcatcttcactattcttattctactgactatcctaaaaatcgctgtcgccttgcaattccagcctgga

SEQ ID NO: 523976 - DNA, 206 bp, Homo sapiens
atctaaggacttgatatgtgccatcactaggatatcatgtctctatcattctactaattgttgcttctcatcactcatatgatatgagcctcatgtttcaattttcagctggaatggaagggcaacttcgctgacaattctttgcctggccttccatctctgtgacctttcttcctttcttctctcgctccatttcacacatatca

SEQ ID NO: 523977 - DNA, 1127 bp, Homo sapiens
  misc_feature (206)..(206): n is a, c, g, or t
  misc_feature (211)..(211): n is a, c, g, or t
  misc_feature (216)..(216): n is a, c, g, or t
  misc_feature (553)..(553): n is a, c, g, or t
cagtgggagccagaagccgtgtgacagatccagcaagtgtgactccttactctccaccgtgagcaagtcagcagaaccacagcagaactgaacctccgagaaggcagctgttgagatcctaagttaaagaagataaactaagaatgcttgagatattcacagactagaggaaggaaacagcctgaaccaggagccacatgaccgcnaaacntgacntggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgacagatgaaactgtgtgggtttagcagcaggtccattttggctaaacagatcttgtattagtggatggaaaggaaaccagaagnaatgcgggctaaagagccaaacagaaaacaagagacactaggaaccgtggaggccagggtgaggcacagcacacgtttaaacaaagtttgggggtgtgaggcttaaagtgacagtggccagcaattttctctaaattatgaaagcctgaatacacaggatcgggagcacagcatccatccatctcataatgaaattgcaggacaccaaacgcaaagagaatatcttaaatgcacccaaggaaaaaacgcaaattagctctgagagcggacaccgagatgagactcggctttgccacggcacagtgggagccagaagccgtgtgacagatccagcaagtgtgactccttactctcaccggcagttagaatcaagcttgaagtagatgcttgtgcaagaatctggtggtggataaggcattttcaattggggaaacatgtattcacgaagggaatcagtagaagcgagtgtaaggggagcctggctgcagaaaagggtgagacagattgggagagaaagaggctggagggagagcggggaaacttggagttggacaaggagggctaggaagggagg

SEQ ID NO: 523978 - DNA, 147 bp, Homo sapiens
ggtgcagaggatccctccaagatgaggaatgtcgagagcttttgttggcgttgatattcgtgagatggagtcttggcttattgcccaggttgtagggcacgtggtgctgctcttgggtcactgaaatctccatctctcaggttcacg

SEQ ID NO: 523979 - DNA, 1067 bp, Homo sapiens
  misc_feature (146)..(146): n is a, c, g, or t
  misc_feature (151)..(151): n is a, c, g, or t
  misc_feature (156)..(156): n is a, c, g, or t
  misc_feature (493)..(493): n is a, c, g, or t
cctcctacccacgcctggagactggaaatggaatcagagggaacatctagaaatgacaagtatgatacatgaccgccaaacatgacgtggagactggaaaggagtcagagaacatctagaaatgacaagtatgatacatgaccgcnaaacntgacntggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgacagatgaaactgtgtgggtttagcagcaggtccattttggctaaacagatcttgtattagtggatggaaaggaaaccagaagnaatgcgggctaaagagccaaacagaaaacaagagacactaggaaccgtggaggccagggtgaggcacagcacacgtttaaacaaagtttgggggtgtgaggcttaaagtgacagtggccagcaattttctctaaattatgaaagcctgaatacacaggatcgggagcacagcatccatccatctcataatgaaattgcaggacaccaaacgcaaagagaatatcttaaatgcacccaaggaaaaaacgcaaattagctctgagagcggacaccgagatgagactcggctttgccacggcacagtgggagccagaagccgtgtgacagatccagcaagtgtgactccttactctcaccggcagttagaatcaagcttgaagtagatgcttgtgcaagaatctggtggtggataaggcattttcaattggggaaacatgtattcacgaagggaatcagtagaagcgagtgtaaggggagcctggctgcagaaaagggtgagacagattgggagagaaagaggctggagggagagcggggaaacttggagttggacaaggagggctaggaagggagg

SEQ ID NO: 523980 - DNA, 655 bp, Homo sapiens
  misc_feature (206)..(206): n is a, c, g, or t
  misc_feature (211)..(211): n is a, c, g, or t
  misc_feature (216)..(216): n is a, c, g, or t
  misc_feature (553)..(553): n is a, c, g, or t
cagtgggagccagaagccgtgtgacagatccagcaagtgtgactccttactctccaccgtgagcaagtcagcagaaccacagcagaactgaacctccgagaaggcagctgttgagatcctaagttaaagaagataaactaagaatgcttgagatattcacagactagaggaaggaaacagcctgaaccaggagccacatgaccgcnaaacntgacntggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgatacatgaccgccaaacatgacgtggagactggaaaggagtcagagaacatctagaaatgacaagtatgacagatgaaactgtgtgggtttagcagcaggtccattttggctaaacagatcttgtattagtggatggaaaggaaaccagaagnaatgcgggctaaagagccaaacagaaacagccagcaaggaggagctggaagtgtcaaggttaaggctccctaggctaagccccctaagatcctctagagtac

SEQ ID NO: 523981 - DNA, 726 bp, Homo sapiens
  misc_feature (394)..(394): n is a, c, g, or t
  misc_feature (413)..(413): n is a, c, g, or t
  misc_feature (462)..(462): n is a, c, g, or t
  misc_feature (520)..(520): n is a, c, g, or t
ccacacctggcctgcactcattttaaagttggaaaaacagaggccccagtgattagctttaggacggaaaccagtaaatagaaataaaaacacacaaaaatatatacatatatatacctacacacatctatacctacaaatgtttatatatgtatatacacacatatacacacacctgtataatatacacatattatatatattatttatttatttaagtttttattctttgtttttttgagacagagtctcactttgttgcccaggctggagtgccatggcgtgaccatagctcaatgcagcctcgacctcccaaacacaagcaaacctgcctcagcctctcaagtagttgcgactacagacatgcaccaccacacctggctaatttttggtntattctttgtacacatggngatcttgatatgtacctaggttggtctggaaactctggcctcaagtganctttccaactcagtattccaaagtgctgagattacaggtgtgaagcactgtgccaagncaaaccaaacatttttgagttgcccctaataggatggcagattagataaccaataggtcaataagaagatcttgacaagttaatcactaattaaacgatatggaaataatggattcgaaagtgaggaaattctgaatattaaaggatgatagaatttggcaaataacttgggtaagggatccattagggtatctttgctggggggg

SEQ ID NO: 523982 - DNA, 153 bp, Homo sapiens
  misc_feature (89)..(89): n is a, c, g, or t
cgtgttggttcctcaaagaaaacaccagatagattgtttctaagctagagccaccccagatttgcttaaagttgcaaagctcacttgcntgtttgggggttacccttcttgagacactggaaagactgggttttacccgctggcccctgtgaa

SEQ ID NO: 523983 - DNA, 724 bp, Homo sapiens
accggccgatgtagctcaccccggtcgcgctttgttgccccagcgcactaagtgggccagtatgtttggcgcgcccctctgttcccggcgggggttgtggataatataactcttgcgtgggcacaggaagaacagcccagcaggtgtgcctgaaacacactgctctccatgggagagaagttgagtagagtctaatcaaggacggaggcagtcgctctgtgcgaggcaccacacacgggtgagtatctagatactcacgatgtactccccatctcataggagtggccttttgtgtggaggaagaagtaatcggcggacagatacaccacgtggcatgaggaatatgaaaagcaggtctctcctcgagcgttgggaccccactggcgtggtcgcacaataggaagtagagatcaacgagacaagataattggttgaggaaatcgatttctttgctagacctcctactgtgagtgtatgcggggtaccccctaccacaattctctctaccctctttggtggaataaatagcgccataaccctactgcttcctctagagcaaagataattatttgttatatctacaatatggccctcacatattcaataaaacaataacaagttatcttaatcattatccacccttaatcatcacccattttctatatttgcattttataccacgagtgcgcccaactcccacccccacatcaataataagaaacaa

SEQ ID NO: 523984 - DNA, 279 bp, Homo sapiens
ggaactggcctgtcccttggaaaaggacatgtattagaacagcactgatggtgcaggagagaggagtggagtactgtcttggtcttgactttgaaggagaggctgggatgttggagatgtgtgtgtgtgtaagtgtgttggtcatgaagtgtgttaaaagatagtatctgccacatggagttctctgcttaaggtagttttctttttcttcttctttttttttttttttttttggggctttttaggggccgcccccattggattttggaggaattctca

SEQ ID NO: 523985 - DNA, 603 bp, Homo sapiens
taatttatccccttgatgatgagacccaagatctcatgattaggaaacatgtgagtacccagtgggcaaaatcccgcagataatctcaattaagtggttcttccaataagcaagcaataatttaaggtttgtgtgtttgcgcagtatgaaatttcttaatggagggtttcataatatatcttagtcacagcttttgagagttttgaaggagaacaaacccatggcaaggcccgtgcaaataattacgggccctttgagattagacaatacacgcattcttaaaaaaaaaaatttagcacacacctttattaatgcctttatatggaaaaagaccgttagatatatatagatctattttttaagtcaggaaactccgggacatgattttacacattattttaacaatgggttacatattcacagggtataaaaaaaaaaaatagtgagaagtgggtttcccacccatcctatatccacccggttctcatccctcaccccaaagagtataaacactgtctttttttttttttgtgacacactcttactcgtgtcacccgagtatagggtgcagtggcaccatctgggctcaataccacctccatc

SEQ ID NO: 523986 - DNA, 486 bp, Homo sapiens
  misc_feature (425)..(425): n is a, c, g, or t
  misc_feature (459)..(459): n is a, c, g, or t
  misc_feature (479)..(479): n is a, c, g, or t
aattcggcatgagggctacatctcattgctgcccttcttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccagggccagggccatcgcatcccctgtggacttggcacgtgtaacatccaggatgggcctggaagttaactggaaggttccacaaaaggaagttaaaaacagcctttaactggatggacatttccaccntgtggattttgtttccttgccccaccttaattgntcattgttatttggtaattntccccct

SEQ ID NO: 523987 - DNA, 704 bp, Homo sapiens
tgttgcactgtaccagtttttaaaaacctgaaccataacggcttcgcattctagtacacttacttacaaaaaaaaaaaaaaaaaaaaaaaaaaaaaaaaaaaaaaaaaaaaaaaaaaaaaaaaaaaaaaaagggggggggggcaaccctcgggggggccaaaagtagtagagcaaccccccctgtttttgatgaaacagaagggtggcccccacaagaggaggactgttctatatataaacaagagaagaggcagggggccggtcttttaaacaacaaaagccggatgggacgacggaacaacgacgatgacacggtgggtagaactatgcgggggaaagaagaacaccatctctctccggggggcgggggaagcaacatagtgtggggacacacacacctccaccccagcgagtattttatataccaacagcccacaaggaggggagcataaatatatttcacttctttctacagagggcgtgacatctaggcgggggtgtaaaaacacccccaccgcccgaatcatatttacgccctcggcgcccgttagagaagagaaacatgtcgtcgtcgcccccccaccgcgggcacagtctctaaccttccctccaagccaacaactattattctacccccggcgcggcgcctcctttgctacataattcctctccccccaccccagaccaaaccccacccccacac

SEQ ID NO: 523988 - DNA, 929 bp, Homo sapiens
  misc_feature (387)..(387): n is a, c, g, or t
gcccttgcaagtaatagggcttctgctaagctctccctccagccaataggcagtttcttaatatcctaaaagccttggaccaaatggaaataaagcttttggatgcaaaaaaaaaaacaacaacaaacaaaaaaacttgtgtggggccgctcgggccctgaaaataagtttttcaagcccatcttgtgtggggcgcggggccccagtaggtttagtttgacacactgggcgcaaggcttgtcccagaggaaaaccgggccccaggacatagggtgtgtggctttctcccccaaaataaaaaaagcggccggggcgcgacccgcagtgtttcggaacacaattccaaagaggggaggtcgggaggccaaactggcgtcttcatcacancgggggggtcgccaaaggggagggggtccggagtaaataaaaattaaaccgcccgcgggggcagggggaaaacaatccagcaacataacacgatcacatgaacacaagacctacacaatccagcacaacaagcacacacacaaacagaacacagctaacgacaaacataacaagtacaactacatatcaagacaatcacaaacacgttatacagcaccaacactcagcaacacacacacacaacaacacaagctaccaaccacagagtgacagaagggtgaggcaagaaagcacgcgtaaacagagaaacagacacagacgagacagagagcaagagcacaggcagaccagcagagcgaaagcggagacagacaagtacatagaagagcgagaggagcgaaatcaagacgaacaaaacaaggcagagagagagagcggagacgcacggacatagcagactcgacagaacgacagcggacgcatgagaagaagcgcggcggtggcagcgagcggcggcacagagcggctgacagaccacggtg

SEQ ID NO: 523989 - DNA, 390 bp, Homo sapiens
ggtaccagtatcttcacgttggtcagctgttacttgatagcctcttaaggaaaatttgcttccaaatgaagctggagagtcatgtaatctttaaagtatccagactttccgtaatgacatttgcctttaagagagctatcatgctcacgtggaatacgactttgtcaaacaaatgaattacaatacatgggctttggaagaatttccgttacgtattggttaacgaattatgtcgtacaaaactttgagattggtcgtggtcactggaatccatcgaaccgacataaacatctcaagttttattgacaacataagaaaacaaagaaacacaaaaaagagacctggggggcgatcatattgtgcgcgggctgcgggcgaaacaaggggtaa

SEQ ID NO: 523990 - DNA, 296 bp, Homo sapiens
  misc_feature (14)..(14): n is a, c, g, or t
  misc_feature (177)..(177): n is a, c, g, or t
  misc_feature (199)..(199): n is a, c, g, or t
  misc_feature (214)..(214): n is a, c, g, or t
  misc_feature (283)..(283): n is a, c, g, or t
tttgttatttctcntttttttcgttttatttttttttggagatggagtctccctcggtcaccaggcgggagtgcaggggcgtgacctgggctcacggcaacctccacctcccaggttcaagcgattctcatggcctcggcctcccaagtagctgggattacaggcatgcaccaccangccccggcccagcctcttaaanggccggtttattttnatttttagacatgcagataagcgtagttgcctagttcctaaacttacagcaaattagaagataatttcngtgcccatttcaa

SEQ ID NO: 523991 - DNA, 220 bp, Homo sapiens
ccacgtataagtaatacacatctgatcaaccacgcgctccatcatcttaacgtcgtctctcggtgaagcttctccccgctggagtggtctgtcggtgaccagtgtgactgcttgattgtagatatatgacgcagtcagtgcacagaagttgtactaggtagctgtactcatccatggagcctgtagtacacttggtatggggtaacaggtgcagtgtttt

SEQ ID NO: 523992 - DNA, 243 bp, Homo sapiens
  misc_feature (232)..(232): n is a, c, g, or t
gatctgaggttaccctcggaatcgacggttctcaacttttgcagtgaaaaagaaaacagatgatgatgcagaacgcatttgttctatgtgcaatgctttaactactggccagatagtgcaagtgtggaatttgtatactcccagttaatgagtttgacagaacagagtctctgtgtacgttcacttcgtactataccagatgcgtttacggagacaggacaagaactctccnccagctgctca

SEQ ID NO: 523993 - DNA, 449 bp, Homo sapiens
cgtgccgccacgggtgactccggggcccccccctgtgccgcccacgggtgactctgaggctgcccctgtgcccccctacaggtatgagtccgaggaagctcagatgcctgcgttcattaggtttagggtgccatgagccttggtatccataggttacttgagacggtgggacgctcgcatgtgagcgtcctccttacgcgatcttgagcgtcttccttgaagttaacgccttcgataccgcctaagaagaaaataaatactaagaaagagagcagaacaataacgaaaagaatcgaatataaatacaattataaagaaaaaaagaatagtggggtggcggcctttagataaatattatatttatatgaagaggacgggtgaagcgagatagtagcagagatatatattaaaagaaggggagagacgaaaattaaggggtaataaaaagg

SEQ ID NO: 523994 - DNA, 320 bp, Homo sapiens
  misc_feature (77)..(77): n is a, c, g, or t
  misc_feature (292)..(292): n is a, c, g, or t
  misc_feature (299)..(299): n is a, c, g, or t
ttcaataccctgtaacatgcgcttactgaggcttcaggagctgtaaacatcctcccctatacactgccacgggtctngagccccacagcctacccatctgtatgctaccctagaggtttgagtagcagggcactgaagaagcgagccacaccctcatcgcatgccctgccagggggacaagggaacctttcccttatcaatagtaatatctataattgtacatcatttgaccgtgagataatatataaaatctttctggagtatccctacacacttttcaagataacaacanaactcanggaattattgaaaagaggatg

SEQ ID NO: 523995 - DNA, 195 bp, Homo sapiens
gacagacacacacacacacaccccataccccacactgactgtctagcgacaaagaccctatttcctggcatacgggcttcctctgtaccctgtattttttgtgtacatacttgtaaacacggatttgtctgggttttggtttgctttttccttttgtccccctgtctgtgttttatgtcctgatagacactctgt

SEQ ID NO: 523996 - DNA, 344 bp, Homo sapiens
ccacacaaacataccacacactgcacacaccacacataccacatacacacacatgcacacacatacaacataccatgtacactacacactatataccacacatacataccccacaccacacacacccacacgagtgacatgtgaataagctcttggtccatactggtgccagatgcctgggtgtgacgtgacgacaccactgtatgtgtggcatataatgtggtatataatgtaccatatggtatgttgtctgtgtggatatgtatgtggtatgtttgtgcagtgtgtggggtgtgtgtagtatgcagtgtgtttgtgctgtgccagtgtgtgtgtggtatgtg

SEQ ID NO: 523997 - DNA, 358 bp, Homo sapiens
  misc_feature (358)..(358): n is a, c, g, or t
ggagagcacttagatgagacacaatggaggtttagtacaccgcattagtctacatctgatgatcacggctcagttgatgccacagcgaatgtagacaaactgcctggcaatctaatgctagtgactgtcagagagtcaagaggaaagaggctctacaatcacagagatgtatcaccttacaaagttctttacggagagagcatagtggcattctacctcttagcttcacttagaggcctattaggtgtagtaacaatgggttacttaggactgggcctgaacttgcattttttgagacgcccgatgttgcagttcctctgggtctagcttacagaccctgacctcatcttacctcttn

SEQ ID NO: 523998 - DNA, 136 bp, Homo sapiens
ataaagtaagtgctgtttgggctaacaggatctctcttgcagtctgcagccaggacggtgattccagcagcggcttaccgggagccggaaggttcactattgtgaaaatggccttcaattccccttccgcgtcaaa

SEQ ID NO: 523999 - DNA, 340 bp, Homo sapiens
  misc_feature (4)..(4): n is a, c, g, or t
  misc_feature (6)..(6): n is a, c, g, or t
  misc_feature (16)..(16): n is a, c, g, or t
  misc_feature (220)..(220): n is a, c, g, or t
  misc_feature (327)..(327): n is a, c, g, or t
tagnanatcagtcatntgattcagtgtggtggtgtatttgtaccttttcacactgctataaagaactgccggagactgggtaatttatgaagaaaagaggtttaactgactcacagttctgcaggcttaacaggaagcatgactgggaggtctcacggaaacttaccattatggcggaaggcgaagggtacaaggactttcttcacattgtgggcaggtnagagaggggtagtggtaaatattttttaaacaagcagatcttcgtgagaagtcactctttgaaaacagcactagttgggatgggtgctaaaccctccaggaaactgncccccggggtccc

SEQ ID NO: 524000 - DNA, 691 bp, Homo sapiens
  misc_feature (400)..(400): n is a, c, g, or t
tccccacattctgcaaggacaggagccaccttcctctctctcacctcccctgccctgtcaccagaggtctctatgattaatttcttaggcctatttaagatacatattatatagtcctaaacggttttctctgatcatttcctctcatttttagaatccccaggtctctctcagccaagacagtggcagggagagcctgaacttatgaggggagagggcagagccccttcctcaagaccctcaagctctaacccattttcctccagccctggtctaccccggatgaagagcgttcgcaggtgggcagccagggtagccagttgaggtcaggaaggtctgtgtgcctataagcgtccccctttccccaggaacacacacccttctccgctcccaggtctgnttggagagacctgggaagtcaaggaataggggaaaacggggaatttgtgggttggggggttttccccttgaagcccctccctttttctttcaggcctgttttccttccccccccatttgttgtctttgaccctcacttaaggtgggacaccacttatttcaataaccccatgaggattctgtcccaggccccagagtccggacaagacctgttttggcccctattccttaattgagggggttgtgtggggccccatgggtggagcgggaaggggatttggggggtacagag

SEQ ID NO: 524001 - DNA, 235 bp, Homo sapiens
gaggatcccggtgtttccgttgtctattaaaactcaaaaattagcggggcgtggtggtgcgcatctatagttccagctacttgggaggctgaggcaggagaatgacttgaacccaggaggtaaaggttgcagcgagctgagatcgtgccatttcactacagcctgggtgacagagcgagactctatctcaaaataaaaatttttttggttaaaaagtagggataccagacaaagg

SEQ ID NO: 524002 - DNA, 1235 bp, Homo sapiens
  misc_feature (550)..(550): n is a, c, g, or t
  misc_feature (838)..(838): n is a, c, g, or t
gagatgtgaaatcttcagtagaagaatagctctttaggtgagttcgcaggaaggtagatgatatggagatcttgagctaaagaataggaaatgtgtatcagaattggtcgtacaaagcaggtcctgtgatttattgataacatgaagagcaggagtatgtgcgaagattggtgaagtgatcactaaaggtgtgattcggggatcactcgagtgaggccaccattatgcttacgcattctaatcgcagtgccgtcggattgtcagcctgacgcttgagaatagaaggccagtcaaatcggttcacaaggggtggtggcattgaatgggaaaccgatgcgattcgtgctacttccttataactataagccgtaaaagtaatgtcaacgacgcagtccacatgaggtactctcataggaccaagcaataattcgtcgctaggtggagacacaaggagaacacaacgtggcacccgtgagtaattgaaacgatcaagggtagaatacgcgaaaaggcgcacatttaacctatggggttcgaaacattgtgtcangcggaggagtttggcccgtttaggggctccgttgtttttaaagcacaatttatgcctaagagttggcaagaattttggattggacgtaggaagagcagaatggtagcggaaagggcaatgggagggcaacctgggaggaggggggttcccttttggcggaaaaggatcgatattgtgggatgggaaatgacctatccatagagaacttggtagggaaattttctcatgggagagcatggcgaaagagaaaattccttaaagggaaaccagtgttacatacttctaggnaatgaatcctattgatcaaggagcaggggtgtttaacatagaggttagtaaggaaagtggggatatccttgaattacataagcccagggaattctttgcgtttagtctcataacaggttataactataatgccattgagagggatttaccaagtccttggggagaaaaagtctagacggagggaaaaacaggcgtttatgggacataatttggttacatttgtgagacgtatacaaggagggtttggactcgcggacctaattgatacggggagccttttggggcagtggtaggtaacgtgtgagcgaattatatgagaggcctcggaattgtacattcacttgggctggaagagagccattgtggtatacttggaatttggggagaaggagggaac

SEQ ID NO: 524003 - DNA, 125 bp, Homo sapiens
ccagcgactcaggaaggcagtcgctctctacactcaatcagcgccaagaggcactttctatgggactcttaaggtagagatgagtacatccactagtagtctcttgcgcaaaatgtctctgagag

SEQ ID NO: 524004 - DNA, 466 bp, Homo sapiens
  misc_feature (12)..(12): n is a, c, g, or t
  misc_feature (61)..(61): n is a, c, g, or t
  misc_feature (91)..(91): n is a, c, g, or t
  misc_feature (104)..(104): n is a, c, g, or t
  misc_feature (352)..(352): n is a, c, g, or t
  misc_feature (367)..(367): n is a, c, g, or t
  misc_feature (422)..(422): n is a, c, g, or t
  misc_feature (424)..(424): n is a, c, g, or t
ccattcagtccnggactgtccaaggggtggaggtagctccgtacaggaagctgcctgctgngtgtggatcagtaatatcagacttgcccancaactcactgganacatgaaaaccaatgcatgggggatgcatgacgtcacccaaatatttatgaacactcttgtgctgccagagaccccagatctttaaaccaatgcatggggaatgcatgacatcacccaaatatttacgaacacgcttgtgctgccagagaccccagatcacttttcctgcctcctgctaaataaatgggggcagtagctttgcatcggcttccacattacattactcataactgtggccttcctaatntctcatgtccctaancacttattacaatgtctcagcacgtttcgctcagcctctcaaaatattagtcatnangaaaataaatgtctgatgttaaagcatcaggggtcaattgta

SEQ ID NO: 524005 - DNA, 240 bp, Homo sapiens
gagagaggaacgtttcgttacctgagtaaagaacatcgaaaaaaacccgtacagctaatatcattagttgatgattaagaaacctggaacgctttccatgcaaaggattaagcacaaggcaaggaatgtccccatctaactccattgcattttccagccatccattctagttctcagctgcatgccagtaagcacaaagaaatgggaaataacacaggtatatagcatttgcaacaaggg

SEQ ID NO: 524006 - DNA, 707 bp, Homo sapiens
tcaaagtagttcaatcaccaaatcctatcatttctacctcctacatatttaaaacatccgtttaatggcctctttatctcctccagtctattctccacattgcaaccagagggttcctctaaaaagaacttaatcttgcctccttttgactgaccaactagccttcaatgggctagcactatctgtcggttaaatccagactccttaacacagcaaacaagggcctccgtaatccggcccattcccacctttgcagcctcatcactcctcactgcctcgtacccgctcccctctatcttggctggctctcagtttttcaaatgcactgggcactttctctctcatgggactttctgctctttcctctgcccagaatcctccctccactccctagatcagagttgggaccttctctgaccaaagactgtgataggaccctctgctgtatgttccttgtctccttttaactttccataataaaaaattcatcacacctcagtgcaattttttatctaaagtctatgttcccaatagcatgaggatggggacaatgtctatcttcttcaactctgtatcccagtgcttagcacagagccacatatatagtggactatcaagaaatatctgtagaatgaatgaatggatgaataaatgaatgaatgtcagagctacttggagggatggcatactggccatcatagcaaagc

SEQ ID NO: 524007 - DNA, 455 bp, Homo sapiens
gtggggggtatgacacatcatcgaagcacataatagccagaagtaatactgggatatcctaagataaactattacctactactaccagacaacaacaaagatactccatgataatctaccagttccgaaagaatcacagcatttgttaaaggtagaataggatatttctgacggtttatatgttgccgatcatagcttgaacactgtacctataatgttcctgacaatagactattctgccttgaataaaataaaccggtaagacaagtttgcaatcaaatattcactcgttcgagcatatgagtctttgtttttgtccgtgaatataacatcttgtttggttgcccaggctgaattgcaagggcgcgatctcagctcactacaacctccgcctccgtgaattcaagttgatctcccacctcagccctccaagtatagctgaattacaacgcatg

SEQ ID NO: 524008 - DNA, 173 bp, Homo sapiens
  misc_feature (115)..(115): n is a, c, g, or t
ccccctggcaattgtgtaaagatagaatagtacatcataaactgtattaaaagacttggtcaatgcgtgtgtggcacgatggatatgtgctcgtgtcaaatagcctttgtgtgtnaataacgtgctctgtgtagtaattatcgctatcctggatgagatgtctaatacattgt

SEQ ID NO: 524009 - DNA, 1033 bp, Homo sapiens
  misc_feature (31)..(31): n is a, c, g, or t
  misc_feature (51)..(51): n is a, c, g, or t
  misc_feature (94)..(94): n is a, c, g, or t
  misc_feature (96)..(98): n is a, c, g, or t
  misc_feature (100)..(102): n is a, c, g, or t
  misc_feature (411)..(411): n is a, c, g, or t
  misc_feature (427)..(427): n is a, c, g, or t
  misc_feature (471)..(471): n is a, c, g, or t
  misc_feature (702)..(702): n is a, c, g, or t
  misc_feature (897)..(897): n is a, c, g, or t
  misc_feature (925)..(925): n is a, c, g, or t
  misc_feature (939)..(939): n is a, c, g, or t
  misc_feature (942)..(942): n is a, c, g, or t
  misc_feature (951)..(952): n is a, c, g, or t
  misc_feature (954)..(954): n is a, c, g, or t
  misc_feature (959)..(959): n is a, c, g, or t
  misc_feature (963)..(963): n is a, c, g, or t
  misc_feature (968)..(968): n is a, c, g, or t
ccatgagcgcatggctctggcgtgagcgctnggtgccggcatgggcttcgnccttgagcgcatgcccgctcccatcgaccgtgtgggccagacnannnannncatgggatctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccccgccatgggcccggccctgggcgctggcattgagcgcatgggcctggccatgggtgncggtggcggtgccagntttgaccgtgccatcgagatggagcgtggcaacttcggaggaancttcgcaggttcctttggtggagctggaggccatgctcctggggtggccaggaaggcctgccagatatttgtgagaaatctgccattcgatttcacatggaagatgctaaaggacaaattcaacgagtgcggccacgtgctgtacgccgacatcaagatggataatgggaagtccaaggggtgtggtgtggttaagttcgagtcgccagaggtggccgagagagcctgccngatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaaanacttttttaatgactggggttccatttnactgttgcattganatngcaatgtgnncnatttntttngtaangtggcatcttgttgccatcgaatatgcctttcataataaatcccggttcctgtacataaaaaaaa

SEQ ID NO: 524010 - DNA, 309 bp, Homo sapiens
acaaggtagggggatatgtcatggtcatagatttgaagactaactgcggtaaataagggaattttgcccaatattaagctgtcgattaaagtcagaatcaaaaattccagcaggtttctttcctgctgcaattcacccactgatggtaaaatacatgtagcactgcaaacgatccagaatagccagagcaatcctgaagaacaataaaactggaagctctacactacaggtgccaagcactactataaagctatactagctaagatactgtcagtgtcggccaccacaaaaaaaacaaaaacaacattt

SEQ ID NO: 524011 - DNA, 1037 bp, Homo sapiens
ggttaagggtcggtgtggaattgctggacgaagaaagcgcgctccccgggtacttaggacctttccctctctactgctataccatggtctggggctatatagggcgcaagaaaaagttgtgcctacccggtgttcctcccaaccaaggggaatgttcaacacgctcgaggcccttgccacatctcttgggaattgggggggcatggaccagggggtcaatcctgacgaggttttctaatgcgccgggcctgtcccctaaccaaggacaaagcgtgctaccaagcccaatacgaagcgagatgactaggggtcttatcggcgtctaaaggcgcgatactgggactgcaagcttcgaacttcgttgttataaacttggtagggtgtggtcactacgaggagagcgactacgaaaaatgacccctatgcgcgtgaacgataggtatgtagcagttcaaccacctttgtgagagcttaaaacgggaccaagtatcgttcctgcctaaagggtgatccgacttcccctggaatgactgggcatgataatatgtctatgtcacaaggtcttgtcacgtggaacctcatgtgctcatccaacgctcaacctgtatatgtctcggaagcaattttcaccctcaaattccccttgtctgggccttgccatgaaatctaggggggatcataagggaagctagacggactggtcgttcagagtagtggacagacgctgagcacaacagggcacgtccgagagtcagccactcgagcaaaagtggacataagggatcacagggatgaggtcatggtaacctggaaagcgcggcacatgatgaagcgcagcccatgtgaggaggagaccaggagtggctggggatcccccactgtgtgcagaaggcagcagccttggaagcagggtgtgctcctcgcgtgtgggtcgcatcgataccagaaaatgactctaaaaactgaagagtgtttgagtgttcattaacacaaaacatggacatcatctgtgaaactcgctccgagagagacaggcc

SEQ ID NO: 524012 - DNA, 396 bp, Homo sapiens
  misc_feature (348)..(348): n is a, c, g, or t
  misc_feature (385)..(385): n is a, c, g, or t
ggaggcagctcctgatcaaagagcattgtactggggctcttagatcttcggccacagactgaaggctgcactgtcagcttccctacttttgaggtttttggactcagactggcttccttgctgctcagcttgcagacggcctattgtgggacttcaccttgtgatcatgaagtagaagtgattatccacattccatagaagaagaagcggactccaggaatggtctcatctccagggcagctgtccctcttctggatctctgggcaactccagtttcacagcaccctttctcctcctagcctagggatccagtgcctttagcagcccagtcatggcgacttttttaanaccagctgggggaactgggggttttcgccccaaaagncttccttaaga

SEQ ID NO: 524013 - DNA, 335 bp, Homo sapiens
gacccctatcataatgaggccccggctgccctgcatccggtgtcattaggcgatctgcccgactcagactcctatagtgccatcgcatagccactgcacccagctattttctgactgatccttgctctatctccttttttttttttaggggagggcgttttctacttggcccccagtctgatgctaactgttgggaactcggctcactgcaacctccacctcctgggttaaaggaattctcctgcctaagcctcccaagtggctgggactacaggggcgcaccaccgggcctggctaatttttgtttttctagcagagacggggtttcaccatgt

SEQ ID NO: 524014 - DNA, 1255 bp, Homo sapiens
tcctcccggttcgccaccgaggtctcgcacgcgggaagaatttcttcgcggcgcgaagaacgccgccgggaaggcgcatagcgttcgccctccataccgtggcggggcgtgcccatagggggcaacttccttcccccgagggccagaggacatcaaaaaaatcttgggacacaggcgggggttactcgagagggggacacgaacgacacgcggctctcaacaaggggtctactcgaggtggagcgtgaagagtggcaaacaaactttggaaacaagcgctcattgtgcccgagggtcttagtgggccaaagcttgtgcccgagtgtgttccctgtggggggtggggctgttatacccggttctctcgtgtgtgcccccagagggcctcgtggagagccccccgtggctgtggcgtgggtttctgtgccccctttgttgtgcagtccgacaggcagaaatagaaaagagaagtgcagacaacagaaagcagggagcgagagtcttccgggaaaagacagcattccagatgtcagcataaaccctggtggcgcccatgtgggggccccctttatacgaggatctactacaattctcgcgggggcttcccccccggtgccccactctcacacgcctctatataacaccacccctgttcaacaacaaaaacgacaacaccacaacacaccccgaacaaccagaagcgcacgagagcgccaacacacacaggcacacgaggagaggcgagacaacaccgagagggagaaaaaagaaaacacggcgcgccccacggggggaaaaaccaacgcgaaggcacaccccatagagaaccgagaaaatataaaagcgagtaacaccacaagcggctcgaacaaccctgagcgaagaaaagtaccaccccacataaaaggagagcaacacagaccaaatacacgaatgtcgagaaaacgcgcccagcagtctcaacactgcggaacacttgacgaacatgttgcacacaaacagaagaccagcaatacaacacagcaccaccacacaacgcgatcgaccaaccaaggaggaaacacaaaccccaataacacaacaaaaatataaaaataaaaaaaaaaataaataaacctattataacaaaaaaaaaaaaaaaaaaaaaccaacaaaaacaccaacaacacaacaaaaacacaaaaaaaaaacacaattaaaaacaaatcaataaaaacaaaaaaaaatacaaccactacactaccaaacaatcaat

SEQ ID NO: 524015 - DNA, 130 bp, Homo sapiens
gggggaaggggtgggagcccatactgagggcccgccgcctttactactctgttttccctattcagaacttggaactaaagtatttaaaaaaactgttttttaatgccaattaaagggccgattttttcca

SEQ ID NO: 524016 - DNA, 204 bp, Homo sapiens
gcagtaacctgtacacgttggcacgtgcgtcttttggactgcagaacacaaagtcgtggcgaactgggactgggacccaggcccaacttaaggtgcaggtgtcagcctctggtggccgtacctgatgcacgaacgccctgcgtaagctgtattcattggagatccgaggacagggcttcgattggccgccgatggtgtataccg

SEQ ID NO: 524017 - DNA, 358 bp, Homo sapiens
acccctgctgattgcctgttggacatctatcttgtgtttttctctaaccatggaaggttgcgaggacatatacagtatctgggggctgcacttactctactagctaggggcatcacatcggagagataggacagagaccagagtcgtgccagcttggggtcttgggaagagaggcatatggttactctgttctggaatgggactctgcatttctatgcagtggcccatattctgagcactttgtgcaaatgcttgtatgacgctcaagaacatctccatccagaaccccttccccatctgcagagaccatgtccaggcccttcttgtgtctgcagaggtgaagtgcacatgtggaaag

SEQ ID NO: 524018 - DNA, 239 bp, Homo sapiens
cagccgtccataaatatctgaacactttatgtcacaacatttaatataaatgggcaatttccttaaagacaaaaactagcacagttcactaacaaagaaacagataacctccatcaaatgaattgaacttgtagttcaaaatcttcccaataaggcaacttcagaccaagacagctttactggtgaattctgccaaacacttaaggtagaaataatgccaattttacacaaacttttcc

SEQ ID NO: 524019 - DNA, 861 bp, Homo sapiens
  misc_feature (11)..(11): n is a, c, g, or t
gggtctgccantcacagcagggccctggtggggatttgcactgggcactcctaatcctggagcaggatgccaggacggggatgctgatgaattcagagagcttggtacggttgaagaaaactgagtcttgtggcaatttgtgctaaaactaggtgaagttgccaaattccaaggcatcttacctaacagtctggtttggtcggctggttaccctggtgttgtgtgttacctatcctttgggcttggcttgaccatctccgttgtgagctcacctgagccctcccagggccaggttcctgacagtgttggtttctgcatatccactggaaaggtgtcattaatgacccagtgttagaatgcaagaggtcaggttattctagccctcatggctgaaggcccagtcctgggtccagcagtcctccagccagagggtctggaccatccagtgcctgtcctcgccacaggggctccaggagcattcgggtcaaatccatggacgaccctgggctacaaaccaaggcttgctgttcattcccacatcgtgtggggcagtgtcccatcccctgcagctacttggtgacttaacaactccaggagcccctgtcaggtgccctccttcaactaatagcccttcgagtcttcttgctttggacgacagaaaatgacattggggaggggaaggtgttccggctcccaggttgtctcaaatagtcctattagatactggtaaatctgtgaactgaagaagtcaattctgtcctcctgcagctacttttggccgaatggttcagggaagtatctggggtaggattaatggcaaaaagttgtttaaagggttgggacacagacttatacaacaat

SEQ ID NO: 524020 - DNA, 84 bp, Homo sapiens
gccagcaccaaccagacatctatgtacctctgtgccagcacgaaaggtcacgtcctgactttcggggccggcagtaggctgacc

SEQ ID NO: 524021 - DNA, 187 bp, Homo sapiens
ggagtaaaacgccgaggcaacattcaagcagccgtaagtcgccgtctctttgcattatgcagctgcattctatttctcaattggtaattctcgtggtggagaatttcgtaccagtgcatactcactatcatcagacaatccatattctctcatatcaatgcaccacacaatttattggaggtaccgc

SEQ ID NO: 524022 - DNA, 448 bp, Homo sapiens
  misc_feature (389)..(389): n is a, c, g, or t
  misc_feature (445)..(445): n is a, c, g, or t
acacaactgtaggaggtggctggagaccacggtttggaggtctcacccaatcaggggaaaggggatgagcaaccaattaaaggaggagtctggctgtgttttggtagagcaactgtactgtgttggggggatttgttcagcccccaattggcttgggctctccaaggcccacaggctgcactggctgagatgcccaaacagcaaagatggtgacccactctgcctcctgggcacccccatcccagggagaaattagaactctgttggccttagaacatgggcatgggtggcaggaagccctggctggggagtacctgcccagcaaggaaaaatggattggggtcccattttaaagaaacagttattgccatgcctcgacaaaacagccntttccatgctgggggaaccaccttttttcccagttcagtttggattcttaaagctngga

SEQ ID NO: 524023 - DNA, 180 bp, Homo sapiens
ccctctccgatcacgaacatataggacctgctatgagtaccaggctccctaaaacggaaacatgaaaaagcatagctcctcgcctgtaaccccaatattgtgggaagctagaggttgggcagactcacttcgagtccggagaatttgagcaccatccctgcgacaaaactgtgtgaaacc

SEQ ID NO: 524024 - DNA, 983 bp, Homo sapiens
tcataaggaagggttaaagaaaagtaaaaggaactcggtaaagtcttaccccgcctgtttaccaaaaacatcacctctagcatcaccagtattagatggcaccgccgtgccctagtgacacgatgttgtaacggcccgcggtacccgtaaccgtgcacaacgcgtagcactaatcactgtgctgccgttaacttcaggagacctgctagtgacagtggcctccacgcagggttcagcgtgtcgtctctactttatagaccagctgaagcttgacgctgcccgcagaagcaggcggagcatgcaccacagcaccagtacgcagcaagaccccgtatggagccttcacacttgcatctcaactgcgaaaccacgtacctacaccaaacccgacagcgtgcctaacactacgcaaacgctgccattcaacacaaataacgagccaggaggcgaccatcggcagccagaaacgcaacccatccgcagcagacaccatgctaaagactatcgacccagtcccaaaacgcggcaactacctcagtcacgtccaacttcgatccccaaatgaacctcggaaccaaacggcacacaaggtcctacccccataacggcgactaacacgccgccatatatccctacttcctagaacgtcccactactcacacaactacgcggctcatctaccagaacgcctccgacctgctttcggactcaacggaccaaatccccgaacttgcgtgcaacctctgccttgctcaccacggcttccgtgacgctccaaccgaccttaacaacgctccctaacggttgaattcctgaaggcttccaagcagccgggccagctaacctcccagggtccgcgactcccctattcttaacgtttccacactggccttccctggtaccgaaaacgggtcccacggagacacttacggggcgctaaccttcagccgaaggcggccttttccccccctaaaatgatattc

SEQ ID NO: 524025 - DNA, 625 bp, Homo sapiens
  misc_feature (26)..(26): n is a, c, g, or t
gactctattgcccgcaggcaggcgtntcaagcagcgcgaggcaagataggccgcttcctacaacggaaagggaaacaccgcaccgattggtcgatgcgatgggcctcactgcaccggcaggaaattcatcagcaacaggctttgtgcgtaattgaggccaatgcgccggtagcgctcatcaaggatttgggtcagcaggtccaaacgcgcgacgatcttgccgaactcaacggcaaagctgaggttactgccctcctctgatatctcgttggaaaacaacagcagcacgccattggcatcctgacgctgactgagcagccaggtggccttttcgatattgcgcgcggcattgctgacaaactgcgggttgatcgagtcggtcacataaaactgcgtacgcccgccgtgagcggtcacgagcatgctgccaatcgcgtagatgaacgcgccgacgcggtcgccgcgaaagtcagggctcaaggaataactcagggcagccaggtcactacgatctcccagtgcgggcaagggacggcgattttcgatggcctgacggatttgccgggcggcggtcactgcatccggataccccgattgacgccactggagaacgacccggggatcc

SEQ ID NO: 524026 - DNA, 180 bp, Homo sapiens
cggcccactcgcccaaggtcttgactggacggttgtcttatttccaggtgggcggacggtggtggtggagctagttaatcgggatttagaatggccctggtgagcgcgcgggaaaggagatgcctgagaaagagggcaagtaggactgggaatggctcaaataggattgcgaggaagagg

SEQ ID NO: 524027 - DNA, 743 bp, Homo sapiens
ggggcggttaaggccctggtggtctcgaaggactcgctgcggcatctgcattcatgttcctgtccccggggggtcggacgccttcccagtgcgcagcccggttcacctctccgtgccgagcgccgaggacagggtcgcgctggtgctgctttggatgcgtgagttcattatgatgggaccgaagaatccatcgaaggggcgctcgggcgagtcctggatggcaccgtgaatgccggtgtaagagggacgtgaagctccagactcgtttgactcacatgagcgatcccctcaggattgcactgctgaattgaaccagcagcgcaaaggaggtcacgtccgttccgaatggcgtagaggcaggacactgtttttcgaccgcgacgtctgtcgcaggattcggcccggtggtcacacaaatcatggagaggctggtccaagctctcacgtgcacgccatcccactgatgctgccactcgttatccacggaggcttttggatgcgggctaaggagaccctgatgcatcgttggccggtggaccgggtaaacacgattcgccataggattgcaatcaaaggcaagatgggcacgccgtgtacatggagatccagttcacaacgaggccttgcgagaagcttatctcggcttgtgctgtaatatggatctgtccttcgggagcatggtgttcagaggcgatccggtgactgtcggcgcgagccggcagcacggggagtggactatgcag

SEQ ID NO: 524028 - DNA, 158 bp, Homo sapiens
cataagaaaggaagaggtggacggatcaccatgacagtcaggaattctggatgagagatcaagccagctggacttcctgggtcgagtgacagccttggagacacctttatctgtctagcgtaaacggacttgtacactgcaccaactcagcactctgt

SEQ ID NO: 524029 - DNA, 988 bp, Homo sapiens
  misc_feature (49)..(49): n is a, c, g, or t
  misc_feature (68)..(68): n is a, c, g, or t
  misc_feature (76)..(76): n is a, c, g, or t
  misc_feature (78)..(78): n is a, c, g, or t
  misc_feature (88)..(88): n is a, c, g, or t
  misc_feature (117)..(117): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (151)..(151): n is a, c, g, or t
  misc_feature (157)..(157): n is a, c, g, or t
  misc_feature (164)..(164): n is a, c, g, or t
  misc_feature (168)..(168): n is a, c, g, or t
  misc_feature (173)..(173): n is a, c, g, or t
  misc_feature (176)..(176): n is a, c, g, or t
  misc_feature (206)..(206): n is a, c, g, or t
  misc_feature (218)..(218): n is a, c, g, or t
  misc_feature (226)..(226): n is a, c, g, or t
  misc_feature (237)..(237): n is a, c, g, or t
  misc_feature (249)..(250): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (281)..(281): n is a, c, g, or t
  misc_feature (291)..(291): n is a, c, g, or t
  misc_feature (301)..(301): n is a, c, g, or t
  misc_feature (306)..(306): n is a, c, g, or t
  misc_feature (310)..(310): n is a, c, g, or t
  misc_feature (317)..(317): n is a, c, g, or t
  misc_feature (321)..(321): n is a, c, g, or t
  misc_feature (324)..(325): n is a, c, g, or t
  misc_feature (333)..(333): n is a, c, g, or t
  misc_feature (338)..(339): n is a, c, g, or t
  misc_feature (343)..(344): n is a, c, g, or t
  misc_feature (353)..(354): n is a, c, g, or t
  misc_feature (362)..(362): n is a, c, g, or t
  misc_feature (378)..(378): n is a, c, g, or t
  misc_feature (405)..(405): n is a, c, g, or t
  misc_feature (457)..(457): n is a, c, g, or t
  misc_feature (741)..(741): n is a, c, g, or t
  misc_feature (876)..(876): n is a, c, g, or t
  misc_feature (975)..(975): n is a, c, g, or t
ggggggtaggaaggagaggggggggggggtgtatttaaaaggggggctnggcagaaatacaataactnaggggtcngnatttaatatngacaaccaaaaagtatatataaatatctngcatctatacacaacagggnaggngngtccaggncttctngagcagngagnggggnggntcccacaggccctcttctcatggtaatagngtggccctcagngcaaaggngactagaaccnggcagcccaganngggnctncncctctcctccctgcactccagngctcccaacnggtctcaggnaaagnaagnttaattngggnggnngggtaggnagggnngggnnggggcaaannctaatggngcctgagccctagggnggggagatccaggccagcggagggggnggccatagccacctcctgggatagaagctttgtagttcatagttcgattagngtgtgcttaggacataggtccagccctacagattagctgggtgaagaaggcaagtgtctggacagggcttagtctccaccctcaggcatggaaccattcagggtgaagcctgggatgtgggcacaggagactcaggctgatataaaaataacaaaatcagtaataaaaaaattataaaacctgtcgcttgtctgaatagatttgagcaacagtcttgcttttgttaaaatcctggagccgttaagtcctgaatattcttctggacatcattgctggctggaganaggagcgccaggcccggctcggctgacatctgtgaggtttggaagtctcatccagctgcctgtgctcctgagagatccttagggctgctgggagcaggccgggctggtgatctggggcgactaaacttgggaatnagcccccaggggatggaacagctcctcgggtgttttgtcactttggctggctccccctgccggaagcgggagcgatctatcgaggtccggctttagttnaggaatttgaagt

SEQ ID NO: 524030 - DNA, 357 bp, Homo sapiens
gcgtggtcgcggccgaggtacaatggaatggaatggaatggaatggaatggaatggaatggaatggaatcattccgagtggaataggagggaatgtattcgagtggaatggaaaggaatggtatcaaccagagtggaaaggatgggaatggaatggaatggaaactaatagaatggaatcaaccagagtggaatggaatggaaaggactggaatggaatggaatggaatggaatcaactcgattgtaatggaatggaatggaatggaatggaatggaatggaattaacctgaatacaatggaatggaatggaatggaacggaatggagtggaatggaatggaatcaacccgagtgca

SEQ ID NO: 524031 - DNA, 1041 bp, Homo sapiens
  misc_feature (23)..(23): n is a, c, g, or t
  misc_feature (129)..(129): n is a, c, g, or t
  misc_feature (141)..(141): n is a, c, g, or t
  misc_feature (190)..(190): n is a, c, g, or t
  misc_feature (251)..(251): n is a, c, g, or t
  misc_feature (400)..(400): n is a, c, g, or t
  misc_feature (412)..(412): n is a, c, g, or t
  misc_feature (417)..(417): n is a, c, g, or t
  misc_feature (421)..(421): n is a, c, g, or t
  misc_feature (445)..(445): n is a, c, g, or t
  misc_feature (473)..(473): n is a, c, g, or t
  misc_feature (477)..(477): n is a, c, g, or t
  misc_feature (490)..(490): n is a, c, g, or t
  misc_feature (505)..(505): n is a, c, g, or t
  misc_feature (514)..(514): n is a, c, g, or t
  misc_feature (523)..(523): n is a, c, g, or t
  misc_feature (536)..(536): n is a, c, g, or t
  misc_feature (549)..(549): n is a, c, g, or t
  misc_feature (557)..(557): n is a, c, g, or t
  misc_feature (560)..(560): n is a, c, g, or t
  misc_feature (571)..(571): n is a, c, g, or t
  misc_feature (580)..(580): n is a, c, g, or t
  misc_feature (591)..(591): n is a, c, g, or t
  misc_feature (600)..(601): n is a, c, g, or t
  misc_feature (604)..(605): n is a, c, g, or t
  misc_feature (610)..(611): n is a, c, g, or t
  misc_feature (619)..(619): n is a, c, g, or t
  misc_feature (634)..(634): n is a, c, g, or t
  misc_feature (642)..(642): n is a, c, g, or t
  misc_feature (647)..(648): n is a, c, g, or t
  misc_feature (655)..(659): n is a, c, g, or t
  misc_feature (661)..(662): n is a, c, g, or t
  misc_feature (672)..(672): n is a, c, g, or t
  misc_feature (678)..(678): n is a, c, g, or t
  misc_feature (696)..(696): n is a, c, g, or t
  misc_feature (853)..(853): n is a, c, g, or t
attcccagcttcattaccttgcnggaatgggaatgagagctgaatgtagggacaattttctagtgctgtataaagtagcctcgcatctgttttctcaaccttatccatcatttctgacattcatgcagnacttgccctgtngccaccaatgttctcggtatttcacatgcagctctctttctgccactgnaaacatgggttcaatccatttgtgaagctgtgatagtgtaactggaaagctagtgtggtgnaaattcctttattattttttgttaacatgctgatctttcccggacaaatgaactgaagggtaatttactggaactctcgtgtacagcttcatcaactgtaaccatataaatataactggaatattcttaaacaaaaagaaactaggggncctcttaagtgnaaatntatnactagccaacagagttttactatnttgattgtctggttggtttaacaaagancctngctgactcccccnctgtaaagccccccnggtaggctnttttaaagnactgtacatattngcaatcacattgngcatagantcntaatggcaganatgatcccntttgccaggcnacaacaatnnacnncagannccttgttngtaatgtaaatgatngaaaacantttgnnaatatgnnnnnanncctatgtttngctatnaaaaattttataacattnccaagacaaaaattccaagtttatgctttgaagaatttatgtaattaaaatttcactaaactaatctttttagtttaggaattatttgggttttgacactggaagttgccccaaataagcatcagaaataggagatgcttaacattgctatactacntgtgttggttaggggtttggatttgggggttctttggttttaatttttttttccacatttaaaacccttaaatgtactgtaagccccagatcgttgtccaactgggctgcggttgattgcccgtttgtgtactgttgcttggatgcggcccagtggttggtaatggaataaaggatgcctgggtccga

SEQ ID NO: 524032 - DNA, 1497 bp, Homo sapiens
  misc_feature (1046)..(1046): n is a, c, g, or t
  misc_feature (1082)..(1082): n is a, c, g, or t
tccatgcgtctgctggttgctctctagacgtctgctgctgcacatgatgcttgttgtgtcattactaacgggtcgtgtggtcttcggtctccccccgtcacagtattgtggtgtgcctcaccacgtccgttgtgggggcgcgctgtgtgccgccccctttatgtggcgcttttctcagggggggttcctacttacattatccgcgggggatcgctgagggatcgacgcctcttgtcggtcccggctgttgtttcccaggcggtgtggagcgatgcttttgttgagcccgcccccctgttggtgggggaaaaaattatccgccttgttgtgcgccccaccataggtgggtcacaccatcttgtaagatgagtggttatagcccgccgcttattatgtatggggattttgtaaccgcccggtaggaactcataaacgtgtttttgctcctatatcatgtaagccaccctctgggggggggaattaaagacaacagccgtgcggaggatgtgttaccaatgtgtggtcgcacgaagaatatgtctttgtcgccgcacattctttcggcgacacagttggtcgaagaaatatttgggtggtggagtcttttaggaaataaaaataaaaattaaaaacgcccccttttttcacaaagtttgtggcccagctcgggggtgaatggggtcccagctggtgtaggaatatggaaacgccacagaatatgtttcgtggaaaaatgaaaaatagtgttggttttttagaacggagtatccattcacccggtgtatacccagggatattgcaccaaagccttggctcttctttctcggtaatagttttctatagggtgtgttatattgtggacatttgtcagctcggtgttatatatatgaatgtgggccgccaaataatatagaagtggaagatatatatagaatttgataaataaatagtgtatatagtgggtgtgtcgcacacaagaagctcttaggacccttgtgtacactgtccacagcgccacacccccaccagtggcgttgaataatatnccaggagtgccagatgccatatgggtttaatacacnatagtgggtatagtgtgcccacaagccactcatataagctttagaaagagaaggaaataatatgttcttagggacgccacatcacccatactgtgtttccagacacatggaatagccccaccacacaccattaggactcccccaccacacacatccaatattccattgccaccaggactggactggtagattaatatttgtccaccaggaatctttatggacatgaatctaatagcttcccaaaaatagttgtgttgtttcgccaaataatccaaccattgttatgccagaaattattaattcaccaaatgaagatttataacccttgtgggtgttaagctgtgactgaactaaatctgtgggaaagcattgtgaactgtaaaagccaagtatccatataagcttatagacttta

SEQ ID NO: 524033 - DNA, 663 bp, Homo sapiens
  misc_feature (477)..(477): n is a, c, g, or t
  misc_feature (493)..(493): n is a, c, g, or t
gaaacaaacctttttattataaacaggtgtcacaagaacaaaaggccaggactctttcttgggccttggcaataaagttccaccactggtctggtcaaaagggaatggaagccaggcaacaaaccagctttgcccagggccctggttccgcccacggaaaattgctgatcccagtgcaaagttaagcattttccaagccaccacaacgtttttgaccccctctgtggccggactggccagaagccaaggggaccctccatgagctgcaagtggttacctgaaagaaaacttgctaatcttaggtttcctcttaagggtttccaatcttgtttcacaagatggccttgatgctgcgctgtgccccatgaataaatgtgtgatgtcttgcaggtgaaggtcaggccccgtctcctcatgatgctttcacagtatctgtcatccgggccctgtggtttggcatcatagtgctgggtcagnaagtgtgtgtacctgnagtatcctgaagccagggtcggtggggtcagacccagacccagcacgaagaccaacaacaaaacgcccaggcccatcaccatctcttccaacacaggctcccaggaggaagaatcttacaaaaatctggcagtttcccttcaacgggagatgggttccacctgtttgttc

SEQ ID NO: 524034 - DNA, 794 bp, Homo sapiens
gctacactatacattggtggcgtgctaccgagcatgataatgatgttggtccttgaagtttccagtgcccattaggccatcttgagtgcatgtgtctcttctaaaaatatggctcagtagcgatacagccgtgttctattaacaactctaagaggaagttcagaggttttgtttggatcttatcaacaggatttgtgacgtgcatctattcattgaactcatgtcttgattcaccgccttttttcacgttgtgccaacggaaatagggtgtcgatatttcttcatatgtaaggagatgcttcaaaatgtcaatgtgctttaaacttaaattacctctcaagagaccaaggtacatttacctcatgtgtgtatatcatgtttaatatttgtcagagcattctccaggttgtgcagttttatttctataaagtatgggtataatgtgtgctcagttactcaaatggtactgtattgttatatttgtaccccaaataacatcgtctgtacttctgttctgtatggtattgtgcaggattcttagggcttaatcagtgtaatctctgctttaagatatgtacagaaaatgtccatataaatttccattggaagtcgaatgatacttgagaagctgtaaggaggaggaaaacaaataaggctgtgttcccataagttttttaacttgtattggttttggggtattattccagaaggactgtaatggacctagagagggtgctatgttaggtcctaactacaggggaagatggaggggggactaattacttttcccacac

SEQ ID NO: 524035 - DNA, 396 bp, Homo sapiens
tcgagctcgcacccagacaaggagaggtctatgtccacgctttgggcaacaggataaagaaaaacagctactgcctggaaaagttgtttgtaagatgggaagaggtattctccagagctctgatacaactctatccagcaatagtgtagataggaacctgatggcagagataagagtcctagattcactgtggcacatataagcattcaatttccagagattacttgaagaaaaaaatagctgttattaaacacttaatatggattcagagtaatgggtacattaggtttatcaaatcccatttattcctgacaacatagctacaggtaaacatcattattatcctgatgtaaaggtgcagcagtggtgtcttacttcacatagttcagcgtctga

SEQ ID NO: 524036 - DNA, 706 bp, Homo sapiens
attattctcctgtaaaaataattgggaggggcgggtgtgttcggtgtgtgtgtgtgtgtgtgtgtgtgtgtgtgtgtatttttttttttacaggggcgcctgtctaaagtatttcacacaacatgtgtgataatcagcgcttaaaaagcagcagtgctcctatgaaggggaaatgtcagttctagagcatgggatgtgaagttctggtcatgtcaccttgcgtgtctcacccgtggaggagagaaggtgggcggcccggcgggggggtgtggctgcaccccagcaccgggagggggcacgcacgacaccagaggaggggacagccccacccatgtcaagcagcaggcaacccggttgtgcttcatttcacgggggatacagtattttttataatagggagccatatttttttaaaagagtggagatctgaatgtgatctctacctggtctcagacgttaggtgtgtcaaagctactaacaacgttccaacaaccccactctcgggcgcccactctatagaaacggggcctggctatctattacagcggcgtacttgcggacggggcgacagttgggggcccccctctagcatgggggtcccaatcacccaaaaaaaacaacacacaaacaaaacacaacatgcggcggccccgccgggcccggaaaaaagtcaaacacaagcggggggccaccggccaagcaagcc

SEQ ID NO: 524037 - DNA, 403 bp, Homo sapiens
  misc_feature (365)..(365): n is a, c, g, or t
ccggatcctttctaatgcacttgagcagcagtctccaaccacagggccacagagctgaagctggatctaccatgaaagacttgtgaatccaggacgagagactgactgggcaacatgttattcagggtctccctctgttgtccaaggctggagtgtaatagtgctatcacagctgactgcagcctcaaccttccaggctgaagtgattctcccatctgaacctaccacgtggctgagactacaggtgcttgccaccatgcccaactaatatttggaaccttcatataagtggattccagaggggtgacagcataacgtgggaccatccaggtgcaggaaaacaagcttaacacgcccactgattntacattatgctgctaccacccggcagcctctccaggcc

SEQ ID NO: 524038 - DNA, 118 bp, Homo sapiens
tttttaatacgtacaaagactgacatgtacccagggacccatttaccactgctctgttgcgcagctttgttttcagcatgtagcgatactagcgggaggatcatgtgtgctgcatcaa

SEQ ID NO: 524039 - DNA, 613 bp, Homo sapiens
  misc_feature (2)..(2): n is a, c, g, or t
  misc_feature (207)..(207): n is a, c, g, or t
  misc_feature (300)..(300): n is a, c, g, or t
  misc_feature (305)..(305): n is a, c, g, or t
  misc_feature (388)..(391): n is a, c, g, or t
  misc_feature (405)..(405): n is a, c, g, or t
  misc_feature (430)..(430): n is a, c, g, or t
  misc_feature (438)..(438): n is a, c, g, or t
  misc_feature (459)..(459): n is a, c, g, or t
  misc_feature (476)..(476): n is a, c, g, or t
  misc_feature (495)..(495): n is a, c, g, or t
  misc_feature (505)..(505): n is a, c, g, or t
  misc_feature (511)..(511): n is a, c, g, or t
  misc_feature (535)..(536): n is a, c, g, or t
  misc_feature (542)..(542): n is a, c, g, or t
  misc_feature (568)..(568): n is a, c, g, or t
gnggccaagttttacatttttaacagcccttctacatacactccatcttctctatcttagttccaagttttagttttcaatcccaattataccaattccattgttattttaagaaaaaaccttcccagttattgtcagaaactatgatttagcttaccccctccactacccagcaaactacagagaggatggggtgtaatatgagcngtacagagtcttaatgccattcatgggggccacttagtccttacatgaatctggttgctaacatttctattatattgtgacaatgactcccgnctgtnattctctgtgggagatggggggggtgaattcttaataaaagacacccggtacaaagcaacattttacttctgttgtgataaannnnaaaaaaaggtcacnttttccggatgacatgtgggacccngggatgcnggcccattctcttatcgggcncgatgcggggggtctcntccgattcacttttcaccngcgcattganggtgtncaaaaaagaaaagaaaaaaaatcnncccccnaagcttctaaaaaaggaacccgcggnacttcctcttgtgggatgtttaaaaagttagcctactaaagataa

SEQ ID NO: 524040 - DNA, 136 bp, Homo sapiens
gtgattctaaggatccccggttctcccccagtgctgggattacatcgcctgagctaccatgtcgggcctcatcctctattgactttttgagagcagaacacatttggggtgcttccgcatccatgtggctccactg

SEQ ID NO: 524041 - DNA, 376 bp, Homo sapiens
aaggagggggaaaggggattatttccgttggaggttgaaagctgggaaacccattaaaggacctcctttggttaattccaccaggaggacgttgggatccaggagattccttttttctggggccaaaccatttttaaaaacttacctggtcaggtcaaaattggttttagacccggtttacccattagaaatatttaatgtcaggggggaaaccattagggaaaccaaaatggttttaaggccttccggggttatatggaaaggaatggggctaatatggaaattaatggttccaattaacaggttccatgaaaataggaagtccattgccagtttcagacctgtttggcaaatactcagcatacttgggatccat

SEQ ID NO: 524042 - DNA, 200 bp, Homo sapiens
tttcctcactttatggaaagtcatgctgactctagcgatcccaccatccctgttcactaccataaggtggcagtgtgttttctggctcctgaaaagaactaacactgattccatagcatatccgagtggttgatggaaactgctgaaaaggccgatacccctgtggaacagtagggtaccgatctccatttctttatcat

SEQ ID NO: 524043 - DNA, 286 bp, Homo sapiens
gggacagtatctctcacccagtctggagcgcaacagcgtggtctccgctcactgcagcctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 524044 - DNA, 183 bp, Homo sapiens
tccacgccgagcgaccatacagatcagaatgccgagcgttcgtatgcacggtctcggtggacgaagttgttgctagcacacgcctgaatgtccaaaccccttggtgacacaaattatgtggacgaagttgttgcaggtcaggattgacgaagttgttgcagatcgcaatggacgaagttgttg

SEQ ID NO: 524045 - DNA, 143 bp, Homo sapiens
gcaagagcaactgatgattaaatgttgctttttataaggtttttaacttgaaaatttgaaatatttatgttgacagactccacttaggctataggagtcatatctccctgtcgaggcagctcctccgggagtgaattatacca
